United States Patent 9,061,059 (MODIFIED POLYNUCLEOTIDES FOR TREATING PROTEIN DEFICIENCY) - sequence listing, part 39

SEQ ID NO: 69567 - protein, 522 aa, Homo sapiens
MDTESTYSGYSYYSSHSKKSHRQGERTRERHKSPRNKDGRGSEKSVTIQPPTGEPLLGNDSTRTEEDDNWGETTTAITGTSEHSISQEDIARISKDMEDSVGLDCKRYLGLTVASFLGLLVFLTPIAFILLPPILWRDELEPCGTICEGLFISMAFKLLILLIGTWALFFRKRRADMPRVFVFRALLLVLIFLFVVSYWLFYGVRILDSRDRNYQGIVQYAVSLVDALLFIHYLAIVLLELRQLQPMFTLQVVRSTDGESRFYSLGHLSIQRAALVVLENYYKDFTIYNPNLLTASKFRAAKHMAGLKVYNVDGPSNNATGQSRAMIAAAARRRDSSHNELYYEEAEHERRVKKRKARLVVAVEEAFIHIQRLQAEEQQKAPGEVMDPREAAQAIFPSMARALQKYLRITRQQNYHSMESILQHLAFCITNGMTPKAFLERYLSAGPTLQYDKDRWLSTQWRLVSDEAVTNGLRDGIVFVLKCLDFSLVVNVKKIPFIILSEEFIDPKSHKFVLRLQSETSV

SEQ ID NO: 69568 - protein, 521 aa, Homo sapiens
MDTESQYSGYSYKSGHSRSSRKHRDRRDRHRSKSRDGGRGDKSVTIQAPGEPLLDNESTRGDERDDNWGETTTVVTGTSEHSISHDDLTRIAKDMEDSVPLDCSRHLGVAAGATLALLSFLTPLAFLLLPPLLWREELEPCGTACEGLFISVAFKLLILLLGSWALFFRRPKASLPRVFVLRALLMVLVFLLVVSYWLFYGVRILDARERSYQGVVQFAVSLVDALLFVHYLAVVLLELRQLQPQFTLKVVRSTDGASRFYNVGHLSIQRVAVWILEKYYHDFPVYNPALLNLPKSVLAKKVSGFKVYSLGEENSTNNSTGQSRAVIAAAARRRDNSHNEYYYEEAEHERRVRKRRARLVVAVEEAFTHIKRLQEEEQKNPREVMDPREAAQAIFASMARAMQKYLRTTKQQPYHTMESILQHLEFCITHDMTPKAFLERYLAAGPTIQYHKERWLAKQWTLVSEEPVTNGLKDGIVFLLKRQDFSLVVSTKKVPFFKLSEEFVDPKSHKFVMRLQSETSV

SEQ ID NO: 69569 - protein, 513 aa, Homo sapiens
MTTQLPAYVAILLFYVSRASCQDTFTAAVYEHAAILPNATLTPVSREEALALMNRNLDILEGAITSAADQGAHIIVTPEDAIYGWNFNRDSLYPYLEDIPDPEVNWIPCNNRNRFGQTPVQERLSCLAKNNSIYVVANIGDKKPCDTSDPQCPPDGRYQYNTDVVFDSQGKLVARYHKQNLFMGENQFNVPKEPEIVTFNTTFGSFGIFTCFDILFHDPAVTLVKDFHVDTIVFPTAWMNVLPHLSAVEFHSAWAMGMRVNFLASNIHYPSKKMTGSGIYAPNSSRAFHYDMKTEEGKLLLSQLDSHPSHSAVVNWTSYASSIEALSSGNKEFKGTVFFDEFTFVKLTGVAGNYTVCQKDLCCHLSYKMSENIPNEVYALGAFDGLHTVEGRYYLQICTLLKCKTTNLNTCGDSAETASTRFEMFSLSGTFGTQYVFPEVLLSENQLAPGEFQVSTDGRLFSLKPTSGPVLTVTLFGRLYEKDWASNASSGLTAQARIIMLIVIAPIVCSLSW

SEQ ID NO: 69570 - protein, 520 aa, Homo sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTGSGIYAPNGPKVYHYDMKTELGKLLLSEVDSHPLSSLAYPTAVNWNAYATTIKPFPVQKNTFRGFISRDGFNFTELFENAGNLTVCQKELCCHLSYRMLQKEENEVYVLGAFTGLHGRRRREYWQVCTLLKCKTTNLTTCGRPVETASTRFEMFSLSGTFGTEYVFPEVLLTEIHLSPGKFEVLKDGRLVNKNGSSGPILTVSLFGRWYTKDSLYSSCGTSNSAITYLLIFILLMIIALQNIVML

SEQ ID NO: 69571 - protein, 166 aa, Homo sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVV

SEQ ID NO: 69572 - protein, 467 aa, Homo sapiens
MNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTGSGIYAPNGPKVYHYDMKTELGKLLLSEVDSHPLSSLAYPTAVNWNAYATTIKPFPVQKNTFRGFISRDGFNFTELFENAGNLTVCQKELCCHLSYRMLQKEENEVYVLGAFTGLHGRRRREYWQVCTLLKCKTTNLTTCGRPVETASTRFEMFSLSGTFGTEYVFPEVLLTEIHLSPGKFEVLKDGRLVNKNGSSGPILTVSLFGRWYTKDSLYSSCGTSNSAITYLLIFILLMIIALQNIVML

SEQ ID NO: 69573 - protein, 102 aa, Homo sapiens
MNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPP

SEQ ID NO: 69574 - protein, 101 aa, Homo sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIP

SEQ ID NO: 69575 - protein, 500 aa, Homo sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRFGNTPVQQRLSCLAKDNSIYVVANIGDKKPCNASDSQCPPDGRYQYNTDVVFDSQGKLLARYHKYNLFAPEIQFDFPKDSELVTFDTPFGKFGIFTCFDIFSHDPAVVVVDESIDSILYPTAWYNTLPLLSAVPFHSAWAKAMGVNLLAANTHNTSMHMTGSGIYAPEAVKVYHYDMETESGQLLLSELKSRPRREPTYPAAVDWHAYASSVKPFSSEQSDFLGMIYFDEFTFTKLKRNTGNYTACQKDLCCHLTYKMSEKRTDEIYALGAFDGLHTVEGQYYLQICALLKCQTTDLETCGEPVGSAFTKFEDFSLSGTFGTRYVFPQIILSGSQLAPERHYEISRDGRLRSRSGAPLPVLVMALYGRVFEKDPPRLGQGSGKFQ

SEQ ID NO: 69576 - protein, 274 aa, Homo sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRFGNTPVQQRLSCLAKDNSIYVVANIGDKKPCNASDSQCPPDGRYQYNTDVVFDSQGKLLARYHKYNLFAPEIQFDFPKDSELVTFDTPFGKFGIFTCFDIFSHDPAVVVVDEFQLTAFSTPQHGTTRCPSSRLFPSIQHGPRPWESIYLLQIPTTPACT

SEQ ID NO: 69577 - protein, 147 aa, Homo sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRKSKKMNEPVSKELCYHCHSECNQYGQWKLYRT

SEQ ID NO: 69578 - protein, 207 aa, Homo sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRFGNTPVQQRLSCLAKDNSIYVVANIGDKKPCNASDSQCPPDGRYQYNTDVVFDSQGKLLARYHKGVESTPQKQSRCTTMTWKQRVVSCCYQN

SEQ ID NO: 69579 - protein, 186 aa, Homo sapiens
MSPKPRASGPPAKATEAGKRKSSSQPSPSDPKKKTTKVAKKGKAVRRGRRGKKGAATKMAAVTAPEAESAPAAPGPSDQPSQELPQHELPPEEPVSEGTQHDPLSQEAELEEPLSQESEVEEPLSQESQVEEPLSQESEVEEPLSQESQVEEPLSQESEMEEPLSQESQVEEPPSQESEMEELPSV

SEQ ID NO: 69580 - protein, 206 aa, Homo sapiens
MSPKPRASGPPAKATEAGKRKSSSQPSPSDPKKKTTKVAKKGKAVRRGRRGKKGAATKMAAVTAPEAESAPAAPGPSDQPSQELPQHELPPEEPVSEGTQHDPLSQEAELEEPLSQESEVEEPLSQESQVEEPLSQESEVEEPLSQESQVEEPLSQESEVEEPLSQESQVEEPLSQESEMEEPLSQESQVEEPPSQESEMEELPSV

SEQ ID NO: 69581 - protein, 139 aa, Homo sapiens [sequence omitted]

SEQ ID NO: 69582 - protein, 186 aa, Homo sapiens
MSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEVEEPLSQESQVEEPLSQESEMEELPSV

SEQ ID NO: 69583 - protein, 166 aa, Homo sapiens
MSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQESEVEEPLSQESQVEEPLSQESEVEEPLSQESQVEEPLSQESEMEELPSV

SEQ ID NO: 69584 - protein, 125 aa, Homo sapiens
MSPKPRASGPPAKATEAGKRKSSSQPSPSDPKKKTTKVAKKGKAVRRGRRGKKGAATKMAAVTAPEAESGPAAPGPSDQPSQELPQHELPPEEPVSEGTQHDPLSQESELEEPLSQERPATPLSP

SEQ ID NO: 69585 - protein, 125 aa, Homo sapiens
MSPKPRASGPPAKAKETGKRKSSSQPSPSGPKKKTTKVAEKGEAVRGGRRGKKGAATKMAAVTAPEAESGPAAPGPSDQPSQELPQHELPPEEPVSEGTQHDPLSQESELEEPLSKGRPSTPLSP

SEQ ID NO: 69586 - protein, 739 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 69587 - protein, 647 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQAFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 69588 - protein, 540 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 69589 - protein, 677 aa, Homo sapiens
MPGKMVVILGASNILWIMFAASQAFKIETTPESRYLAQIGDSVSLTCSTTGSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 69590 - protein, 521 aa, Homo sapiens
MEANWTAFLFQAHEASHHQQQAAQNSLLPLLSSAVEPPDQKPLLPIPITQKPQGAPETLKDAIGIKKEKPKTSFVCTYCSKAFRDSYHLRRHESCHTGIKLVSRPKKTPTTVVPLISTIAGDSSRTSLVSTIAGILSTVTTSSSGTNPSSSASTTAMPVTQSVKKPSKPVKKNHACEMCGKAFRDVYHLNRHKLSHSDEKPFECPICNQRFKRKDRMTYHVRSHEGGITKPYTCSVCGKGFSRPDHLSCHVKHVHSTERPFKCQTCTAAFATKDRLRTHMVRHEGKVSCNICGKLLSAAYITSHLKTHGQSQSINCNTCKQGISKTCMSEETSNQKQQQQQQQQQQQQQQQQQQHVTSWPGKQVETLRLWEEAVKARKKEAANLCQTSTAATTPVTLTTPFSITSSVSSGTMSNPVTVAAAMSMRSPVNVSSAVNITSPMNIGHPVTITSPLSMTSPLTLTTPVNLPTPVTAPVNIAHPVTITSPMNLPTPMTLAAPLNIAMRPVESMPFLPQALPTSPPW

SEQ ID NO: 69591 - protein, 521 aa, Homo sapiens; identical to SEQ ID NO: 69590

SEQ ID NO: 69592 - protein, 457 aa, Homo sapiens
MRPPSPLPARWLCVLAGALAWALGPAGGQAARLQEECDYVQMIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 69593 - protein, 416 aa, Homo sapiens
MIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 69594 - protein, 247 aa, Homo sapiens
MTRQRVWMRWAVRQPWSFSNIVSWLTSSGCWWRASTCTPCLPSPSSLSGSTSGGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 69595 - protein, 409 aa, Homo sapiens
MRAGRRPRLGPWAGGCSKMWDNLTCWPATPRGQVVVLACPLIFKLFSSIQGRNVSRSCTDEGWTHLEPGPYPIACGLDDKAASLDEQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 69596 - protein, 438 aa, Homo sapiens
MRTLLPPALLTCWLLAPVNSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 69597 - protein, 422 aa, Homo sapiens
MPLWEAPSDHPANPPATLQGHTSLPGCQEEPARDPQSGLPQITSESSSFSEGSLPSWSSGPAGAKLNASHEGIGSSSDGNGDSKAATERVVSAMDTVRRKHPEITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 69598 - protein, 77 aa, Homo sapiens
MRTLLPPALLTCWLLAPVNSIHPECRFHLEIQEEETKCAELLRSQTEKHKGHTKGFILIHAGGLKRILDPHTYPLAP

SEQ ID NO: 69599 - protein, 673 aa, Homo sapiens
MCSRVPLLLPLLLLLALGPGVQGCPSGCQCSQPQTVFCTARQGTTVPRDVPPDTVGLYVFENGITMLDAGSFAGLPGLQLLDLSQNQIASLPSGVFQPLANLSNLDLTANRLHEITNETFRGLRRLERLYLGKNRIRHIQPGAFDTLDRLLELKLQDNELRALPPLRLPRLLLLDLSHNSLLALEPGILDTANVEALRLAGLGLQQLDEGLFSRLRNLHDLDVSDNQLERVPPVIRGLRGLTRLRLAGNTRIAQLRPEDLAGLAALQELDVSNLSLQALPGDLSGLFPRLRLLAAARNPFNCVCPLSWFGPWVRESHVTLASPEETRCHFPPKNAGRLLLELDYADFGCPATTTTATVPTTRPVVREPTALSSSLAPTWLSPTEPATEAPSPPSTAPPTVGPVPQPQDCPPSTCLNGGTCHLGTRHHLACLCPEGFTGLYCESQMGQGTRPSPTPVTPRPPRSLTLGIEPVSPTSLRVGLQRYLQGSSVQLRSLRLTYRNLSGPDKRLVTLRLPASLAEYTVTQLRPNATYSVCVMPLGPGRVPEGEEACGEAHTPPAVHSNHAPVTQAREGNLPLLIAPALAAVLLAALAAVGAAYCVRRGRAMAAAAQDKGQVGPGAGPLELEGVKVPLEPGPKATEGGGEALPSGSECEVPLMGFPGPGLQSPLHAKPYI

SEQ ID NO: 69600 - protein, 845 aa, Homo sapiens
MELWRQCTHWLIQCRVLPPSHRVTWDGAQVCELAQALRDGVLLCQLLNNLLPHAINLREVNLRPQMSQFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPPKMTEYDKRCCCLREIQQTEEKYTDTLGSIQQHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 69601 - protein, 748 aa, Homo sapiens
MSQFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 69602 - protein, 813 aa, Homo sapiens
MELWRQCTHWLIQCRVLPPSHRVTWDGAQVCELAQALRDGVLLCQLLNNLLPHAINLREVNLRPQMSQFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 69603 - protein, 845 aa, Homo sapiens; identical to SEQ ID NO: 69600

SEQ ID NO: 69604 - protein, 868 aa, Homo sapiens
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMKMGMTEDDKRNCCLLEIQETEAKYYRTLEDIEKNYMSPLRLVLSPADMAAVFINLEDLIKVHHSFLRAIDVSVMVGGSTLAKVFLDFKERLLIYGEYCSHMEHAQNTLNQLLASREDFRQKVEECTLKVQDGKFKLQDLLVVPMQRVLKYHLLLKELLSHSAERPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFRTSGDRDASGAGPGPKMVAMQNYHGNPAPPGKPVLTFQTGDVLELLRGDPESPWWEGRLVQTRKSGYFPSSSVKPCPVDGRPPISRPPSREIDYTAYPWFAGNMERQQTDNLLKSHASGTYLIRERPAEAERFAISIKFNDEVKHIKVVEKDNWIHITEAKKFDSLLELVEYYQCHSLKESFKQLDTTLKYPYKSRERSASRASSRSPASCASYNFSFLSPQGLSFASQGPSAPFWSVFTPRVIGTAVARYNFAARDMRELSLREGDVVRIYSRIGGDQGWWKGETNGRIGWFPSTYVEEEGIQ

SEQ ID NO: 69605 - protein, 878 aa, Homo sapiens
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMIRYMQKMGMTEDDKRNCCLLEIQETEAKYYRTLEDIEKNYMSPLRLVLSPADMAAVFINLEDLIKVHHSFLRAIDVSVMVGGSTLAKVFLDFKERLLIYGEYCSHMEHAQNTLNQLLASREDFRQKVEECTLKVQDGKFKLQDLLVVPMQRVLKYHLLLKELLSHSAERPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKSHGKMWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFTSPADLDASGAGPGPKMVAMQNYHGNPAPPGKPVLTFQTGDVLELLRGDPESPWWEGRLVQTRKSGYFPSSSVKPCPVDGRPPISRPPSREIDYTAYPWFAGNMERQQTDNLLKSHASGTYLIRERPAEAERFAISIKFNDEVKHIKVVEKDNWIHITEAKKFDSLLELVEYYQCHSLKESFKQLDTTLKYPYKSRERSASRASSRSPASCASYNFSFLSPQGLSFASQGPSAPFWSVFTPRVIGTAVARYNFAARDMRELSLREGDVVRIYSRIGGDQGWWKGETNGRIGWFPSTYVEEEGIQ

SEQ ID NO: 69606 - protein, 868 aa, Homo sapiens
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMKMGMTEDDKRNCCLLEIQETEAKYYRTLEDIEKNYMSPLRLVLSPADMAAVFINLEDLIKVHHSFLRAIDVSVMVGGSTLAKVFLDFKERLLIYGEYCSHMEHAQNTLNQLLASREDFRQKVEECTLKVQDGKFKLQDLLVVPMQRVLKYHLLLKELLSHSAERPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFTSPADLDASGAGPGPKMVAMQNYHGNPAPPGKPVLTFQTGDVLELLRGDPESPWWEGRLVQTRKSGYFPSSSVKPCPVDGRPPISRPPSREIDYTAYPWFAGNMERQQTDNLLKSHASGTYLIRERPAEAERFAISIKFNDEVKHIKVVEKDNWIHITEAKKFDSLLELVEYYQCHSLKESFKQLDTTLKYPYKSRERSASRASSRSPASCASYNFSFLSPQGLSFASQGPSAPFWSVFTPRVIGTAVARYNFAARDMRELSLREGDVVRIYSRIGGDQGWWKGETNGRIGWFPSTYVEEEGIQ

SEQ ID NO: 69607 - protein, 839 aa, Homo sapiens
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMKMGMTEDDKRNCCLLEIQETEAKYYRTLEDIEKNYMSPLRLVLSPADMAAVFINLEDLIKVHHSFLRAIDVSVMVGGSTLAKVFLDFKERLLIYGEYCSHMEHAQNTLNQLLASREDFRQKVEECTLKVQDGKFKLQDLLVVPMQRVLKYHLLLKELLSHSAERPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFTSPADLDASGAGPGPKMVAMQNYHGNPAPPGKPVLTFQTGDVLELLRGDPESPWWEGRLVQTRKSGYFPSSSVKPCPVDGRPPISRPPSREIDYTAYPWFAGNMERQQTDNLLKSHASGTYLIRERPAEAERFAISIKFNDEVKHIKVVEKDNWIHITEAKKFDSLLELVEYYQCHSLKESFKQLDTTLKYPYKSRERSASRASSRSPVFTPRVIGTAVARYNFAARDMRELSLREGDVVRIYSRIGGDQGWWKGETNGRIGWFPSTYVEEEGIQ

SEQ ID NO: 69608 - protein, 847 aa, Homo sapiens
MEPWKQCAQWLIHCKVLPTNHRVTWDSAQVFDLAQTLRDGVLLCQLLNNLRAHSINLKEINLRPQMSQFLCLKNIRTFLTACCETFGMRKSELFEAFDLFDVRDFGKVIETLSRLSRTPIALATGIRPFPTEESINDEDIYKGLPDLIDETLVEDEEDLYDCVYGEDEGGEVYEDLMKAEEAHQPKCPENDIRSCCLAEIKQTEEKYTETLESIEKYFMAPLKRFLTAAEFDSVFINIPELVKLHRNLMQEIHDSIVNKNDQNLYQVFINYKERLVIYGQYCSGVESAISSLDYISKTKEDVKLKLEECSKRANNGKFTLRDLLVVPMQRVLKYHLLLQELVKHTTDPTEKANLKLALDAMKDLAQYVNEVKRDNETLREIKQFQLSIENLNQPVLLFGRPQGDGEIRITTLDKHTKQERHIFLFDLAVIVCKRKGDNYEMKEIIDLQQYKIANNPTTDKENKKWSYGFYLIHTQGQNGLEFYCKTKDLKKKWLEQFEMALSNIRPDYADSNFHDFKMHTFTRVTSCKVCQMLLRGTFYQGYLCFKCGARAHKECLGRVDNCGRVNSGEQGTLKLPEKRTNGLRRTPKQVDPGLPKMQVIRNYSGTPPPALHEGPPLQLQAGDTVELLKGDAHSLFWQGRNLASGEVGFFPSDAVKPCPCVPKPVDYSCQPWYAGAMERLQAETELINRVNSTYLVRHRTKESGEYAISIKYNNEAKHIKILTRDGFFHIAENRKFKSLMELVEYYKHHSLKEGFRTLDTTLQFPYKEPEHSAGQRGNRAGNSLLSPKVLGIAIARYDFCARDMRELSLLKGDVVKIYTKMSANGWWRGEVNGRVGWFPSTYVEEDE

SEQ ID NO: 69609 - protein, 556 aa, Homo sapiens
MSQFLCLKNIRTFLTACCETFGMRKSELFEAFDLFDVRDFGKVIETLSRLSRTPIALATGIRPFPTEESINDEDIYKGLPDLIDETLVEDEEDLYDCVYGEDEGGEVYEDLMKAEEAHQPKCPENDIRSCCLAEIKQTEEKYTETLESIEKYFMAPLKRFLTAAEFDSVFINIPELVKLHRNLMQEIHDSIVNKNDQNLYQVFINYKERLVIYGQYCSGVESAISSLDYISKTKEDVKLKLEECSKRANNGKFTLRDLLVVPMQRVLKYHLLLQELVKHTTDPTEKANLKLALDAMKDLAQYVNEVKRDNETLREIKQFQLSIENLNQPVLLFGRPQGDGEIRITTLDKHTKQERHIFLFDLAVIVCKRKGDNYEMKEIIDLQQYKIANNPTTDKENKKWSYGFYLIHTQGQNGLEFYCKTKDLKKKWLEQFEMALSNIRPDYADSNFHDFKMHTFTRVTSCKVCQMLLRGTFYQGYLCFKCGARAHKECLGRVDNCGRVNSGEQGTLKLPEKRTNGLRRTPKQVDPDVPCLLHFFISMAPATRSIVKSQKKNKKF

SEQ ID NO: 69610 - protein, 287 aa, Homo sapiens
MPIFTFLSEQGTLKLPEKRTNGLRRTPKQVDPGLPKMQVIRNYSGTPPPALHEGPPLQLQAGDTVELLKGDAHSLFWQGRNLASGEVGFFPSDAVKPCPCVPKPVDYSCQPWYAGAMERLQAETELINRVNSTYLVRHRTKESGEYAISIKYNNEAKHIKILTRDGFFHIAENRKFKSLMELVEYYKHHSLKEGFRTLDTTLQFPYKEPEHSAGQRGNRAGNSLLSPKVLGIAIARYDFCARDMRELSLLKGDVVKIYTKMSANGWWRGEVNGRVGWFPSTYVEEDE

SEQ ID NO: 69611 - protein, 875 aa, Homo sapiens
MEPWKQCAQWLIHCKVLPTNHRVTWDSAQVFDLAQTLRDGVLLCQLLNNLRAHSINLKEINLRPQMSQFLCLKNIRTFLTACCETFGMRKSELFEAFDLFDVRDFGKVIETLSRLSRTPIALATGIRPFPTEESINDEDIYKGLPDLIDETLVEDEEDLYDCVYGEDEGGEVYEDLMKAEEAHQPKCPENDIRSCCLAEIKQTEEKYTETLESIEKYFMAPLKRFLTAAEFDSVFINIPELVKLHRNLMQEIHDSIVNKNDQNLYQVFINYKERLVIYGQYCSGVESAISSLDYISKTKEDVKLKLEECSKRANNGKFTLRDLLVVPMQRVLKYHLLLQELVKHTTDPTEKANLKLALDAMKDLAQYVNEVKRDNETLREIKQFQLSIENLNQPVLLFGRPQGDGEIRITTLDKHTKQERHIFLFDLAVIVCKRKGDNYEMKEIIDLQQYKIANNPTTDKENKKWSYGFYLIHTQGQNGLEFYCKTKDLKKKWLEQFEMALSNIRPDYADSNFHDFKMHTFTRVTSCKVCQMLLRGTFYQGYLCFKCGARAHKECLGRVDNCGRVNSGEQGTLKLPEKRTNGLRRTPKQVDPGLPKMQVIRNYSGTPPPALHEGPPLQLQAGDTVELLKGDAHSLFWQGRNLASGEVGFFPSDAVKPCPCVPKPVDYSCQPWYAGAMERLQAETELINRVNSTYLVRHRTKESGEYAISIKYNNEAKHIKILTRDGFFHIAENRKFKSLMELVEYYKHHSLKEGFRTLDTTLQFPYKEPEHSAGQRGNRAGNSSPSLFCGFSFVTPPDYSFVPPSSTPFWSVLSPKVLGIAIARYDFCARDMRELSLLKGDVVKIYTKMSANGWWRGEVNGRVGWFPSTYVEEDE

SEQ ID NO: 69612 - protein, 251 aa, Homo sapiens [sequence omitted]

SEQ ID NO: 69613 - protein, 303 aa, Homo sapiens
MSSARFDSSDRSAWYMGPVSRQEAQTRLQGQRHGMFLVRDSSTCPGDYVLSVSENSRVSHYIINSLPNRRFKIGDQEFDHLPALLEFYKIHYLDTTTLIEPAPRYPSPPMGSVSAPNLPTAEDNLEYVRTLYDFPGNDAEDLPFKKGEILVIIEKPEEQWWSARNKDGRVGMIPVPYVEKLVRSSPHGKHGNRNSNSYGIPEPAHAYAQPQTTTPLPAVSGSPGAAITPLPSTQNGPVFAKAIQKRVPCAYDKTALALEVGDIVKVTRMNINGQWEGEVNGRKGLFPFTHVKIFDPQNPDENE

SEQ ID NO: 69614 - protein, 303 aa, Homo sapiens; identical to SEQ ID NO: 69613

SEQ ID NO: 69615 - protein, 290 aa, Homo sapiens
MGDGGAERDRGPARRAESGGGGGRCGDRSGAGDLRADGGGHSPTEVAGTSASSPAGSRESGADSDGQPGPGEADHCRRILVRDAKGTIREIVLPKGLDLDRPKRTRTSFTAEQLYRLEMEFQRCQYVVGRERTELARQLNLSETQVKVWFQNRRTKQKKDQSRDLEKRASSSASEAFATSNILRLLEQGRLLSVPRAPSLLALTPSLPGLPASHRGTSLGDPRNSSPRLNPLSSASASPPLPPPLPAVCFSSAPLLDLPAGYELGSSAFEPYSWLERKVGSASSCKKANT

SEQ ID NO: 69616 - protein, 833 aa, Homo sapiens
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQGNTMLLRVLPAVYEKQPQPINRHLTELLALMSQLEQPEQYHLLRLLHVAAKKKQLEVVQKCIPFLIGHLKDSTHNDIILNILIEIAVYEPVALNSFLPMLKEIGERFPYLTGQMARIYGAVGHVDEERARSCLTYLVSQLANMEHSFHHILLLEIKSITDTFSSILGPQSRDIFRMSNSFTAIAKLLTRQLENTKAGSGRRKISTEIEFPEKLEETKLIVTENEDHEKLQVKIQAFEDKINAGSNTPGSIRRYSLGQVSKEERKNIRFNRSKSLAFHTMLTKGVGSDDGEDENRGDIPASISLSEIDPLGQGNDKLPFKTDTERSQLGESSVSYPNIIHIDSENLSETVKENSQEETPETTASPIEYQDKLYLHLKKNLSKVKAYAMEIGKKIPVPDQCTIEDTVRSCVAKLFFTCSLKGHYCLYSKSSFILISQEPQPWIQIMFLFQQSLFPEPLSIQSHSVQFLRALWEKTQAGGAHSFETAMMESTFPQQKDLDQVQLHLEEVRFFDVFGFSETAGAWQCFMCNNPEKATVVNQDGQPLIEGKLKEKQVRWKFIKRWKTRYFTLAGNQLLFQKGKSKDDPDDCPIELSKVQSVKAVAKKRRDRSLPRAFEIFTDNKTYVFKAKDEKNAEEWLQCINVAVAQAKERESREVTTYL

SEQ ID NO: 69617 - protein, 833 aa, Homo sapiens; identical to SEQ ID NO: 69616

SEQ ID NO: 69618 - protein, 788 aa, Homo sapiens
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQGNTMLLRVLPAVYEKQPQPINRHLTELLALMSQLEQPEQYHLLRLLHVAAKKKQLEVVQKCIPFLIGHLKDSTHNDIILNILIEIAVYEPVALNSFLPMLKEIGERFPYLTGQMARIYGAVGHVDEERARSCLTYLVSQLANMEHSFHHILLLEIKSITDTFSSILGPQSRDIFRMSNSFTAIAKLLTRQLENTKAGSGRRKISTEIEFPEKLEETKLIVTENEDHEKLQVKIQAFEDKINAGSNTPGSIRRYSLGQVSKEERKNIRFNRSKSLAFHTMLTKGVGSDDGEDENRGDIPASISLSEIDPLGQGNDKLPFKTDTERSQLGESSVSYPNIIHIDSENLSETVKENSQEETPETTASPIEYQDKLYLHLKKNLSKVKAYAMEIGKKIPVPDQCTIEDTVRSCVAKLFFTCSLKGHYCLYSKSSFILISQEPQPWIQIMFLFQQDLDQVQLHLEEVRFFDVFGFSETAGAWQCFMCNNPEKATVVNQDGQPLIEGKLKEKQVRWKFIKRWKTRYFTLAGNQLLFQKGKSKDDPDDCPIELSKVQSVKAVAKKRRDRSLPRAFEIFTDNKTYVFKAKDEKNAEEWLQCINVAVAQAKERESREVTTYL

SEQ ID NO: 69619 - protein, 63 aa, Homo sapiens
MHQLFRLVLGQKDLSRAGDLFSLDDSEIEDSLTEALEQIKIISSSSDYQTNNNDQAVVEICIT

SEQ ID NO: 69620 - protein, 213 aa, Homo sapiens
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQGMVRKLSLGTCFGRYLKVFSSSIYGLWEARPRVLEAN

SEQ ID NO: 69621 - protein, 165 aa, Homo sapiens
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLAD

SEQ ID NO: 69622 - protein, 55 aa, Homo sapiens
MHQLFRLVLGQKDLSRAGDLFSLDDSEIEDSLTEALEQIKIISSSSDYQTNNNDQ

SEQ ID NO: 69623 - protein, 213 aa, Homo sapiens; identical to SEQ ID NO: 69620

SEQ ID NO: 69624 - protein, 177 aa, Homo sapiens
MHQLFRLVLGQKDLSRAGDLFSLDDSEIEDSLTEALEQIKIISSSSDYQTNNNDQAVVEICITRITTAIRETESIEKHAKALVGLWDSCLEHNLRPFGKDEDTPHAKIASDIMSCILQNYNRPPVMALAIPIAVKFLHRGNKELCRNMSNYLSLAAITKADLLADHTEVIVKSILQV

SEQ ID NO: 69625 - protein, 788 aa, Homo sapiens; identical to SEQ ID NO: 69618

SEQ ID NO: 69626 - protein, 1255 aa, Homo sapiens [sequence omitted]

SEQ ID NO: 69627 - protein, 1225 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 69628 - protein, 979 aa, Homo sapiens
MELAALCRWGLLLALLPPGAASTQDNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 69629 - protein, 603 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHS

SEQ ID NO: 69630 - protein, 1225 aa, Homo sapiens; identical to SEQ ID NO: 69627

SEQ ID NO: 69631 - protein, 1240 aa, Homo sapiens
MPRGSWKPQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 69632 - protein, 752 aa, Homo sapiens
MGTSALWALWLLLALCWAPRESGATGTGRKAKCEPSQFQCTNGRCITLLWKCDGDEDCVDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQSTATTVTYSETKDTNTTEISATSGLVPGGINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 69633 - protein, 173 aa, Homo sapiens
MGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCRNITCSPDEFTCSSGRCISRNFVCNGQDDCSDGSDELDCAPPTCGAHEFQCSTSSCIPISWVCDD

SEQ ID NO: 69634 - protein, 845 aa, Homo sapiens
MGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQRINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 69635 - protein, 873 aa, Homo sapiens
MGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQSTATTVTYSETKDTNTTEISATSGLVPGGINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 69636 - protein, 242 aa, Homo sapiens
MSDEREVAEAATGEDASSPPPKTEAASDPQHPAASEGAAAAAASPPLLRCLVLTGFGGYDKVKLQSRPAAPPAPGPGQLTLRLRACGLNFADLMARQGLYDRLPPLPVTPGMEGAGVVIAVGEGVSDRKAGDRVMVLNRSGMWQEEVTVPSVQTFLIPEAMTFEEAAALLVNYITAYMVLFDFGNLQPGHSVLVHMAAGGVGMAAVQLPYSGECDSVRNGLGQQARGTEGEWGHTSHRLSHD

SEQ ID NO: 69637 - protein, 393 aa, Homo sapiens
MSDEREVAEAATGEDASSPPPKTEAASDPQHPAASEGAAAAAASPPLLRCLVLTGFGGYDKVKLQSRPAAPPAPGPGQLTLRLRACGLNFADLMARQGLYDRLPPLPVTPGMEGAGVVIAVGEGVSDRKAGDRVMVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTYGMANLLTGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKEN

SEQ ID NO: 69638 - protein, 259 aa, Homo sapiens
MVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTYGMANLLTGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKEN

SEQ ID NO: 69639 - protein, 300 aa, Homo sapiens
MARQGLYDRLPPLPVTPGMEGAGVVIAVGEGVSDRKAGDRVMVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTYGMANLLTGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKEN

SEQ ID NO: 69640 - protein, 217 aa, Homo sapiens
MSSDFEGYEQDFAVLTAEITSKIARVPRLPPDEKKQMVANVEKQLEEAKELLEQMDLEVREIPPQSRGMYSNRMRSYKQEMGKLETDFKRSRIAYSDEVRNELLGDDGNSSENQRAHLLDNTERLERSSRRLEAGYQIAVETEQIGQEMLENLSHDREKIQRARERLRETDANLGKSSRILTGMLRRIIQNRILLVILGIIVVITILMAITFSVRRH

SEQ ID NO: 69641 - protein, 203 aa, Homo sapiens
MSSDFEGYEQDFAVLTAEITSKIARVPRLPPDEKKQMVANVEKQLEEAKELLEQMDLEVREIPPQSRGMYSNRMRSYKQEMGKLETDFKRSRIAYSDEVRNELLGDDGNSSENQRAHLLDNTERLERSSRRLEAGYQIAVETEQIGQEMLENLSHDREKIQRARERLRETDANLGKSSRILTGMLRRGCSVKKQCNLSLAPKA

SEQ ID NO: 69642 - protein, 143 aa, Homo sapiens
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGRWQLTQYCLVMWSFPSWTRPEEGPGGGPKSNLVSVQYPFRK

SEQ ID NO: 69643 - protein, 117 aa, Homo sapiens
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVSKYR

SEQ ID NO: 69644 - protein, 118 aa, Homo sapiens
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVIYFFT

SEQ ID NO: 69645 - protein, 247 aa, Homo sapiens
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVIYFYLRMYHPFPVVHCHPHSCPLPSVCSLNTLPHPPSSIPAQASPSPIPPFSLRSFALCPSTLEMLLVAQSKSLPEEQQLAPPPCLLFLYSQVPPKPQRVGGQGKGQGGEWLRRSTHEAAQTWEEKSIGAHGDF

SEQ ID NO: 69646 - protein, 116 aa, Homo sapiens
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVRRD

SEQ ID NO: 69647 - protein, 116 aa, Homo sapiens
MSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIVYFST

SEQ ID NO: 69648 - protein, 100 aa, Homo sapiens
MSTGPTAATGSNRRLQQTQNQVDEVVDIMRVNVDKVLERDQKLSELDDRADALQAGASQFETSAAKLKRKYWWKNCKMWAIGITVLVIFIIIIIVWVVSS

SEQ ID NO: 69649 - protein, 116 aa, Homo sapiens
MAGIELERCQQQANEVTEIMRNNFGKVLERGVKLAELQQRSDQLLDMSSTFNKTTQNLAQKKCWENIRYRICVGLVVVGVLLIILIVLLVVFLPQSSDSSSAPRTQDAGIASGPGN

SEQ ID NO: 69650 - protein, 260 aa, Homo sapiens
MAILFAVVARGTTILAKHAWCGGNFLEVTEQILAKIPSENNKLTYSHGNYLFHYICQDRIVYLCITDDDFERSRAFNFLNEIKKRFQTTYGSRAQTALPYAMNSEFSSVLAAQLKHHSENKGLDKVMETQAQVDELKGIMVRNIVCHLQNYQQKSCSSHVYEEPQAHYYHHHRINCVHLYHCFTSLWWIYMAKLCEEIGKKKLPLTKDMREQGVKSNPCDSSLSHTDRWYLPVSSTLFSLFKILFHASRFIFVLSTSLFL

SEQ ID NO: 69651 - protein, 220 aa, Homo sapiens
MAILFAVVARGTTILAKHAWCGGNFLEVTEQILAKIPSENNKLTYSHGNYLFHYICQDRIVYLCITDDDFERSRAFNFLNEIKKRFQTTYGSRAQTALPYAMNSEFSSVLAAQLKHHSENKGLDKVMETQAQVDELKGIMVRNIDLVAQRGERLELLIDKTENLVDSSVTFKTTSRNLARAMCMKNLKLTIIIIIVSIVFIYIIVSPLCGGFTWPSCVKK

SEQ ID NO: 69652 - protein, 179 aa, Homo sapiens
MAILFAVVARGTTILAKHAWCGGNFLEDFERSRAFNFLNEIKKRFQTTYGSRAQTALPYAMNSEFSSVLAAQLKHHSENKGLDKVMETQAQVDELKGIMVRNIDLVAQRGERLELLIDKTENLVDSSVTFKTTSRNLARAMCMKNLKLTIIIIIVSIVFIYIIVSPLCGGFTWPSCVKK

SEQ ID NO: 69653 - protein, 100 aa, Homo sapiens
MEEASEGGGNDRVRNLQSEVEGVKNIMTQNVERILARGENLEHLRNKTEDLEATSEHFKTTSQKVARKFWWKNVKMIVLICVIVFIIILFIVLFATGAFS

SEQ ID NO: 69654 - protein, 258 aa, Homo sapiens
MEEMKKTAIRLPKGKQKPIKTEWNSRCVLFTYFQGDISSVVDEHFSRALSNIKSPQELTPSSQSEGVMLKNDDSMSPNQWRYSSPWTKPQPEVPVTNRAANCNLHVPGPMAVNQFSPSLARRASVRPGELWHFSSLAGTSSLEPGYSHPFPARHLVPEPQPDGKREPLLSLLQQDRCLARPQESAARENGNPGQIAGSTGLLFNLPPGSVHYKKLYVSRGSASTSLPNETLSELETPGKYSLTPPNHWGHPHRYLQHL

SEQ ID NO: 69655 - protein, 115 aa, Homo sapiens
MKKTAIRLPKGKQKPIKTEWNSRCVLFTYFQGDISSVVDEHFSRALSNIKSPQELTPSSQSEGVMLKNDKKLYVSRGSASTSLPNETLSELETPGKYSLTPPNHWGHPHRYLQHL

SEQ ID NO: 69656 - protein, 163 aa, Homo sapiens
  MOD_RES (1)..(1): Any amino acid
XISSVVDEHFSRALSNIKSPQELTPSSQSEGVMLKNDDSMSPNQWRYSSPWTKPQPEVPVTNRAANCNLHVPGPMAVNQFSPSLARRASVRPGELWHFSSLAGTSSLEPGYSHPFPARHLVPEPQPDGKHKKLYVSRGSASTSLPNETLSELETPGKYSLTPP

SEQ ID NO: 69657 - protein, 60 aa, Homo sapiens
TPSSQSEGVMLKNDKKLYVSRGSASTSLPNETLSELETPGKYSLTPPNHWGHPHRYLQHL

SEQ ID NO: 69658 - protein, 317 aa, Homo sapiens
MSCLDVMYQVYGPPQPYFAAAYTPYHQKLAYYSKMQEAQECNASPSSSGSGSSSFSSQTPASIKEEEGSPEKERPPEAEYINSRCVLFTYFQGDISSVVDEHFSRALSQPSSYSPSCTSSKAPRSSGPWRDCSFPMSQRSFPASFWNSAYQAPVPPPLGSPLATAHSELPFAAADPYSPAALHGHLHQGATEPWHHAHPHHAHPHHPYALGGALGAQAAPYPRPAAVHEVYAPHFDPRYGPLLMPAASGRPARLATAPAPAPGSPPCELSGKGEPAGAAWAGPGGPFASPSGDVAQGLGLSVDSARRYSLCGASLLS

SEQ ID NO: 69659 - protein, 143 aa, Homo sapiens
MSCLDVMYQVYGPPQPYFAAAYTPYHQKLAYYSKMQEAQECNASPSSSGSGSSSFSSQTPASIKEEEGSPEKERPPEAEYINSRCVLFTYFQGDISSVVDEHFSRALSQPSSYSPSCTSSKAPRSSGPWRARRYSLCGASLLS

SEQ ID NO: 69660 - protein, 320 aa, Homo sapiens
MSCAEVMYHPQPYGASQYLPNPMAATTCPTAYYQPAPQPGQQKKLAVFSKMQDSLEVTLPSKQEEEDEEEEEEEKDQPAEMEYLNSRCVLFTYFQGDIGSVVDEHFSRALGQAITLHPESAISKSKMGLTPLWRDSSALSSQRNSFPTSFWTSSYQPPPAPCLGGVHPDFQVTGPPGTFSAADPSPWPGHNLHQTGPAPPPAVSESWPYPLTSQVSPSYSHMHDVYMRHHHPHAHMHHRHRHHHHHHHPPAGSALDPSYGPLLMPSVHAARIPAPQCDITKTEPTTVTSATSAWAGAFHGTVDIVPSVGFDTGWSAMARS

SEQ ID NO: 69661 - protein, 326 aa, Homo sapiens
MSCAEVMYHPQPYGASQYLPNPMAATTCPTAYYQPAPQPGQQKKLAVFSKMQDSLEVTLPSKQEEEDEEEEEEEKDQPAEMEYLNSRCVLFTYFQGDIGSVVDEHFSRALGQAITLHPESAISKSKMGLTPLWRDSSALSSQRNSFPTSFWTSSYQPPPAPCLGGVHPDFQVTGPPGTFSAADPSPWPGHNLHQTGPAPPPAVSESWPYPLTSQVSPSYSHMHDVYMRHHHPHAHMHHRHRHHHHHHHPPAGSALDPSYGPLLMPSVHAARIPAPQCDITKTEPTTVTSATSAWAGAFHGTVDIVPSVGFDTGLQHQDKSKESPWY

SEQ ID NO: 69662 - protein, 441 aa, Homo sapiens
MKAAVDLKPTLTIIKTEKVDLELFPSPDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGKLGGQDSFESIESYDSCDRLTQSWSSQSSFNSLQRVPSYDSFDSEDYPAALPNHKPKGTFKDYVRDRADLNKDKPVIPAAALAGYTGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 69663 - protein, 354 aa, Homo sapiens
MKAAVDLKPTLTIIKTEKVDLELFPSPDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 69664 - protein, 485 aa, Homo sapiens
MSYFVDSAGSSPVPYSAPRPAVVRQGPSNTYEDPRMNCGFQSNYHQQRPCYPFWDEMATQEVPTGLEHCVSDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGKLGGQDSFESIESYDSCDRLTQSWSSQSSFNSLQRVPSYDSFDSEDYPAALPNHKPKGTFKDYVRDRADLNKDKPVIPAAALAGYTGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 69665 - protein, 354 aa, Homo sapiens; identical to SEQ ID NO: 69663

SEQ ID NO: 69666 - protein, 272 aa, Homo sapiens
MKAAVDLKPTLTIIKTEKVDLELFPSPDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGKLGGQDSFESIESYDSCGQEMGKEEKQT

SEQ ID NO: 69667 - protein, 225 aa, Homo sapiens
MKAAVDLKPTLTIIKTEKVDLELFPSPGKLGGQDSFESIESYDSCDRLTQSWSSQSSFNSLQRVPSYDSFDSEDYPAALPNHKPKGTFKDYVRDRADLNKDKPVIPAAALAGYTGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 69668 - protein, 615 aa, Homo sapiens
MKALRLSASALFCLLLINGLGAAPPGRPEAQPPPLSSEHKEPVAGDAVPGPKDGSAPEVRGARNSEPQDEGELFQGVDPRALAAVLLQALDRPASPPAPSGSQQGPEEEAAEALLTETVRSQTHSLPAPESPEPAAPPRPQTPENGPEASDPSEELEALASLLQELRDFSPSSAKRQQETAAAETETRTHTLTRVNLESPGPERVWRASWGEFQARVPERAPLPPPAPSQFQARMPDSGPLPETHKFGEGVSSPKTHLGEALAPLSKAYQGVAAPFPKARRPESALLGGSEAGERLLQQGLAQVEAGRRQAEATRQAAAQEERLADLASDLLLQYLLQGGARQRGLGGRGLQEAAEERESAREEEEAEQERRGGEERVGEEDEEAAEAEAEAEEAERARQNALLFAEEEDGEAGAEDKRSQEETPGHRRKEAEGTEEGGEEEDDEEMDPQTIDSLIELSTKLHLPADDVVSIIEEVEEKRKRKKNAPPEPVPPPRAAPAPTHVRSPQPPPPAPAPARDELPDWNEVLPPWDREEDEVYPPGPYHPFPNYIRPRTLQPPSALRRRHYHHALPPSRHYPGREAQARRAQEEAEAEERRLQEQEELENYIEHVLLRRP

SEQ ID NO: 69669 - protein, 615 aa, Homo sapiens; identical to SEQ ID NO: 69668

SEQ ID NO: 69670 - protein, 377 aa, Homo sapiens
MKALRLSASALFCLLLINGLGAAPPGRPEAQPPPLSSEHKEPVAGDAVPGPKDGSAPEVRGARNSEPQDEGELFQGVDPRALAAVLLQALDRPASPPAPSGSQQGPEEEAAEALLTETVRSQTHSLPAPESPEPAAPPRPQTPENGPEASDPSEELEALASLLQELRDFSPSSAKRQQETAAAETETRTHTLTRVNLESPGPERVWRASWGEFQARVPERAPLPPPAPSQFQARMPDSGPLPETHKFGEGVSSPKTHLGEALAPLSKAYQGVAAPFPKARRPESALLGGSEAGERLLQQGLAQVEAGRRQAEATRQAAAQEERLADLASDLLLQFAAGRGPAARPCPLALPLSPGCVGTCQTPLPGPEPELPELTRG

SEQ ID NO: 69671 - protein, 827 aa, Homo sapiens
MTKLSAQVKGSLNITTPGLQIWRIEAMQMVPVPSSTFGSFFDGDCYIILAIHKTASSLSYDIHYWIGQDSSLDEQGAAAIYTTQMDDFLKGRAVQHREVQGNESEAFRGYFKQGLVIRKGGVASGMKHVETNSYDVQRLLHVKGKRNVVAGEVEMSWKSFNRGDVFLLDLGKLIIQWNGPESTRMERLRGMTLAKEIRDQERGGRTYVGVVDGENELASPKLMEVMNHVLGKRRELKAAVPDTVVEPALKAALKLYHVSDSEGNLVVREVATRPLTQDLLSHEDCYILDQGGLKIYVWKGKKANEQEKKGAMSHALNFIKAKQYPPSTQVEVQNDGAESAVFQQLFQKWTASNRTSGLGKTHTVGSVAKVEQVKFDATSMHVKPQVAAQQKMVDDGSGEVQVWRIENLELVPVDSKWLGHFYGGDCYLLLYTYLIGEKQHYLLYVWQGSQASQDEITASAYQAVILDQKYNGEPVQIRVPMGKEPPHLMSIFKGRMVVYQGGTSRTNNLETGPSTRLFQVQGTGANNTKAFEVPARANFLNSNDVFVLKTQSCCYLWCGKGCSGDEREMAKMVADTISRTEKQVVVEGQEPANFWMALGGKAPYANTKRLQEENLVITPRLFECSNKTGRFLATEIPDFNQDDLEEDDVFLLDVWDQVFFWIGKHANEEEKKAAATTAQEYLKTHPSGRDPETPIIVVKQGHEPPTFTGWFLAWDPFKWSNTKSYEDLKAELGNSRDWSQITAEVTSPKVDVFNANSNLSSGPLPIFPLEQLVNKPVEELPEGVDPSRKEEHLSIEDFTQAFGMTPAAFSALPRWKQQNLKKEKGLF

SEQ ID NO: 69672 - protein, 516 aa, Homo sapiens
MSHALNFIKAKQYPPSTQVEVQNDGAESAVFQQLFQKWTASNRTSGLGKTHTVGSVAKVEQVKFDATSMHVKPQVAAQQKMVDDGSGEVQVWRIENLELVPVDSKWLGHFYGGDCYLLLYTYLIGEKQHYLLYVWQGSQASQDEITASAYQAVILDQKYNGEPVQIRVPMGKEPPHLMSIFKGRMVVYQGGTSRTNNLETGPSTRLFQVQGTGANNTKAFEVPARANFLNSNDVFVLKTQSCCYLWCGKGCSGDEREMAKMVADTISRTEKQVVVEGQEPANFWMALGGKAPYANTKRLQEENLVITPRLFECSNKTGRFLATEIPDFNQDDLEEDDVFLLDVWDQVFFWIGKHANEEEKKAAATTAQEYLKTHPSGRDPETPIIVVKQGHEPPTFTGWFLAWDPFKWSNTKSYEDLKAELGNSRDWSQITAEVTSPKVDVFNANSNLSSGPLPIFPLEQLVNKPVEELPEGVDPSRKEEHLSIEDFTQAFGMTPAAFSALPRWKQQNLKKEKGLF

SEQ ID NO: 69673 - protein, 421 aa, Homo sapiens
MTKLSAQVKGSLNITTPGLQIWRIEAMQMVPVPSSTFGSFFDGDCYIILAIHKTASSLSYDIHYWIGQDSSLDEQGAAAIYTTQMDDFLKGRAVQHREVQGNESEAFRGYFKQGLVIRKGGVASGMKHVETNSYDVQRLLHVKGKRNVVAGEVEMSWKSFNRGDVFLLDLGKLIIQWNGPESTRMERLRGMTLAKEIRDQERGGRTYVGVVDGENELASPKLMEVMNHVLGKRRELKAAVPDTVVEPALKAALKLYHVSDSEGNLVVREVATRPLTQDLLSHEDCYILDQGGLKIYVWKGKKANEQEKKGAMSHALNFIKAKQYPPSTQVEVQNDGAESAVFQQLFQKWTASNRTSGLGKTHTVGSVGEGQAGAVREPGSRSWARRATWSTTHPPSLTCIFNEDFYAGSGLVLADGDVDKL

SEQ ID NO: 69674 - protein, 191 aa, Homo sapiens
MGKQNSKLAPEVMEDLVKSTEFNEHELKQWYKGFLKDCPSGRLNLEEFQQLYVKFFPYGDASKFAQHAFRTFDKNGDGTIDFREFICALSITSRGSFEQKLNWAFNMYDLDGDGKITRVEMLEIIEAIYKMVGTVIMMKMNEDGLTPEQRVDKIFSKMDKNKDDQITLDEFKEAAKSDPSIVLLLQCDIQK

SEQ ID NO: 69675 - protein, 191 aa, Homo sapiens; identical to SEQ ID NO: 69674

SEQ ID NO: 69676 - protein, 191 aa, Homo sapiens; identical to SEQ ID NO: 69674

SEQ ID NO: 69677 - protein, 104 aa, Homo sapiens
MGKQNSKLAPEVMEDLVKSTEFNEHELKQWYKGFLKDCPSGRLNLEEFQQLYVKFFPYGDASKFAQHAFRTFDKNGDGTIDFREFICALSITSRGSFEQKLNWA

SEQ ID NO: 69678 - protein, 118 aa, Homo sapiens
MGKQNSKLAPEVMEDLVKSTEFNEHELKQWYKGFLKDCPSGRLNLEEFQQLYVKFFPYGDASKFAQHAFRTFDKNGDGTIDFREFICALSITSRGSFEQKLNWAFNMYDLDGDGKITR

SEQ ID NO: 69679 - protein, 239 aa, Homo sapiens
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQVSGVPFLRSKDTTENVSFPHSVSQSAVPSL

SEQ ID NO: 69680 - protein, 365 aa, Homo sapiens
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQVWFQNRRAKWRKREKRWGGSSVMAEYGLYGAMVRHCIPLPDSVLNSAEGGLLGSCAPWLLGMHKKSMGMIRKPGSEDKLAGLWGSDHFKEGSSQSESGSQRGSDKVSPENGLEDVAIDLSSSARQETKKVHPGAGAQGGSNSTALEGPQPGKVGAT

SEQ ID NO: 69681 - protein, 143 aa, Homo sapiens
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSAM

SEQ ID NO: 69682 - protein, 280 aa, Homo sapiens
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQVWFQNRRAKWRKREKRWGGSSVMAEYGLYGAMVRHCIPLPDSVLNSAEGGLLGSCAPWLLEGETLGCREMK

SEQ ID NO: 69683 - protein, 218 aa, Homo sapiens
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQRVRHWAAEK

SEQ ID NO: 69684 - protein, 301 aa, Homo sapiens
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQVWFQNRRAKWRKREKRWGGSSVMAEYGLYGAMVRHCIPLPDSVLNSAEGGLLGSCAPWLLVQTSAPGGSRSLDFAGDTQAPQTPWWCLMTFS

SEQ ID NO: 69685 - protein, 236 aa, Homo sapiens
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQCKLLLLEAPVHWTLQETHRLPRPRGGA

SEQ ID NO: 69686 - protein, 427 aa, Homo sapiens
MEAMAASTSLPDPGDFDRNVPRICGVCGDRATGFHFNAMTCEGCKGFFRRSMKRKALFTCPFNGDCRITKDNRRHCQACRLKRCVDIGMMKEFILTDEEVQRKREMILKRKEEEALKDSLRPKLSEEQQRIIAILLDAHHKTYDPTYSDFCQFRPPVRVNDGGGSHPSRPNSRHTPSFSGDSSSSCSDHCITSSDMMDSSSFSNLDLSEEDSDDPSVTLELSQLSMLPHLADLVSYSIQKVIGFAKMIPGFRDLTSEDQIVLLKSSAIEVIMLRSNESFTMDDMSWTCGNQDYKYRVSDVTKAGHSLELIEPLIKFQVGLKKLNLHEEEHVLLMAICIVSPDRPGVQDAALIEAIQDRLSNTLQTYIRCRHPPPGSHLLYAKMIQKLADLRSLNEEHSKQYRCLSFQPECSMKLTPLVLEVFGNEIS

SEQ ID NO: 69687 - protein, 427 aa, Homo sapiens; identical to SEQ ID NO: 69686

SEQ ID NO: 69688 - protein, 395 aa, Homo sapiens
MSMEHAALTATGAGGSWRSMKRKALFTCPFNGDCRITKDNRRHCQACRLKRCVDIGMMKEFILTDEEVQRKREMILKRKEEEALKDSLRPKLSEEQQRIIAILLDAHHKTYDPTYSDFCQFRPPVRVNDGGGSHPSRPNSRHTPSFSGDSSSSCSDHCITSSDMMDSSSFSNLDLSEEDSDDPSVTLELSQLSMLPHLADLVSYSIQKVIGFAKMIPGFRDLTSEDQIVLLKSSAIEVIMLRSNESFTMDDMSWTCGNQDYKYRVSDVTKAGHSLELIEPLIKFQVGLKKLNLHEEEHVLLMAICIVSPDRPGVQDAALIEAIQDRLSNTLQTYIRCRHPPPGSHLLYAKMIQKLADLRSLNEEHSKQYRCLSFQPECSMKLTPLVLEVFGNEIS

SEQ ID NO: 69689 - protein, 250 aa, Homo sapiens
MEAMAASTSLPDPGDFDRNVPRICGVCGDRATGFHFNAMTCEGCKGFFRRSMKRKALFTCPFNGDCRITKDNRRHCQACRLKRCVDIGMMKEFILTDEEVQRKREMILKRKEEEALKDSLRPKLSEEQQRIIAILLDAHHKTYDPTYSDFCQFRPPVRVNDGGGSHPSRPNSRHTPSFSGDSSSSCSDHCITSSDMMDSSSFSNLDLSEEDSDDPSVTLELSQLSMLPHLADLVSYSIQKVIGFAKMIPG

SEQ ID NO: 69690 - protein, 101 aa, Homo sapiens
MEAMAASTSLPDPGDFDRNVPRICGVCGDRATGFHFNAMTCEGCKGFFRRSMKRKALFTCPFNGDCRITKDNRRHCQACRLKRCVDIGMMKEFILTDEEVQ

SEQ ID NO: 69691 - protein, 427 aa, Homo sapiens; identical to SEQ ID NO: 69686

SEQ ID NO: 69692 - protein, 106 aa, Homo sapiens
MEAMAASTSLPDPGDFDRNVPRICGVCGDRATGFHFNAMTCEGCKGFFRRSMKRKALFTCPFNGDCRITKDNRRHCQACRLKRCVDIGMMKEFILTDEEVQRKREM

SEQ ID NO: 69693 - protein, 477 aa, Homo sapiens
MEWRNKKRSDWLSMVLRTAGVEEAFGSEVSVRPHRRAPLGSTYLPPAPSGMEAMAASTSLPDPGDFDRNVPRICGVCGDRATGFHFNAMTCEGCKGFFRRSMKRKALFTCPFNGDCRITKDNRRHCQACRLKRCVDIGMMKEFILTDEEVQRKREMILKRKEEEALKDSLRPKLSEEQQRIIAILLDAHHKTYDPTYSDFCQFRPPVRVNDGGGSHPSRPNSRHTPSFSGDSSSSCSDHCITSSDMMDSSSFSNLDLSEEDSDDPSVTLELSQLSMLPHLADLVSYSIQKVIGFAKMIPGFRDLTSEDQIVLLKSSAIEVIMLRSNESFTMDDMSWTCGNQDYKYRVSDVTKAGHSLELIEPLIKFQVGLKKLNLHEEEHVLLMAICIVSPDRPGVQDAALIEAIQDRLSNTLQTYIRCRHPPPGSHLLYAKMIQKLADLRSLNEEHSKQYRCLSFQPECSMKLTPLVLEVFGNEIS

SEQ ID NO: 69694 - protein, 92 aa, Homo sapiens
MGSTWGSPGWVRLALCLTGLVLSLYALHVKAARARDRDYRALCDVGTAISCSRVFSSRLPADTLGLCPDAAELPGVSRWFCLPGLDPVLRAL

SEQ ID NO: 69695 - protein, 163 aa, Homo sapiens
MGSTWGSPGWVRLALCLTGLVLSLYALHVKAARARDRDYRALCDVGTAISCSRVFSSRWGRGFGLVEHVLGQDSILNQSNSIFGCIFYTLQLLLGCLRTRWASVLMLLSSLVSLAGSVYLAWILFFVLYDFCIVCITTYAINVSLMWLSFRKVQEPQGKAKRH

SEQ ID NO: 69696 - protein, 478 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 69697 - protein, 118 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKP

SEQ ID NO: 69698 - protein, 164 aa, Homo sapiens
MSVDPLSSKALKIKRELSENTPHLSDEALMGLSVRELNRHLRGLSAEEVTRLKQRRRTLKNRGYAASCRVKRVCQKEELQKQKSELEREVDKLARENAAMRLELDALRGKCEALQGFARSVAAARGPATLVAPASVITIVKSTPGSGSGPAHGPDPAHGPASCS

SEQ ID NO: 69699 - protein, 164 aa, Homo sapiens; identical to SEQ ID NO: 69698

SEQ ID NO: 69700 - protein, 126 aa, Homo sapiens
MSVDPLSSKALKIKRELSENTPHLSDEALMGLSVRELNRHLRGLSAEEVTRLKQRRRTLKNRGYAASCRVKRVCQKEELQKQKSELEREVDKLARENAAMRLELDALRGKCEALQGFARSVAAARG

SEQ ID NO: 69701 - protein, 164 aa, Homo sapiens; identical to SEQ ID NO: 69698

SEQ ID NO: 69702 - protein, 93 aa, Homo sapiens
MGLSVRELNRHLRGLSAEEVTRLKQRRRTLKNRGYAASCRVKRVCQKEELQKQKSELEREVDKLARENAAMRLELDALRGKCEALQGFARSVA

SEQ ID NO: 69703 - protein, 164 aa, Homo sapiens; identical to SEQ ID NO: 69698

SEQ ID NO: 69704 - protein, 135 aa, Homo sapiens
MGLSVRELNRHLRGLSAEEVTRLKQRRRTLKNRGYAASCRVKRVCQKEELQKQKSELEREVDKLARENAAMRLELDALRGKCEALQGFARSVAAARGPATLVAPASVITIVKSTPGSGSGPAHGPDPAHGPASCS

SEQ ID NO: 69705 - protein, 162 aa, Homo sapiens
MTTPNKGNKALKVKREPGENGTSLTDEELVTMSVRELNQHLRGLSKEEIVQLKQRRRTLKNRGYAASCRVKRVTQKEELEKQKAELQQEVEKLASENASMKLELDALRSKYEALQTFARTVARSPVAPARGPLAAGLGPLVPGKVAATSVITIVKSKTDARS

SEQ ID NO: 69706 - protein, 162 aa, Homo sapiens; identical to SEQ ID NO: 69705

SEQ ID NO: 69707 - protein, 156 aa, Homo sapiens
MTTNPKPNKALKVKKEAGENAPVLSDDELVSMSVRELNQHLRGLTKEEVTRLKQRRRTLKNRGYAASCRIKRVTQKEELERQRVELQQEVEKLARENSSMRLELDALRSKYEALQTFARTVARGPVAPSKVATTSVITIVKSTELSSTSVPFSAAS

SEQ ID NO: 69708 - protein, 156 aa, Homo sapiens; identical to SEQ ID NO: 69707

SEQ ID NO: 69709 - protein, 156 aa, Homo sapiens; identical to SEQ ID NO: 69707

SEQ ID NO: 69710 - protein, 346 aa, Homo sapiens
MPSPLALRPYLRSEFSPSVDARPCSSPSELPAKLLLGATLPRAPRLPRRLAWCSIDWEQVCLLQRLGAGGFGSVYKATYRGVPVAIKQVNKCTKNRLASRRSFWAELNVARLRHDNIVRVVAASTRTPAGSNSLGTIIMEFGGNVTLHQVIYGAAGHPEGDAGEPHCRTGGQLSLGKCLKYSLDVVNGLLFLHSQSIVHLDLKPANILISEQDVCKISDFGCSEKLEDLLCFQTPSYPLGGTYTHRAPELLKGEGVTPKADIYSFAITLWQMTTKQAPYSGERQHILYAVVAYDLRPSLSAAVFEDSLPGQRLGDVIQRCWRPSAAQRPSARLLLVDLTSLKAELG

SEQ ID NO: 69711 - protein, 612 aa, Homo sapiens
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQATKAQRLFQF

SEQ ID NO: 69712 - protein, 726 aa, Homo sapiens [sequence omitted]

SEQ ID NO: 69713 - protein, 761 aa, Homo sapiens
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 69714 - protein, 640 aa, Homo sapiens
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 69715 - protein, 637 aa, Homo sapiens
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 69716 - protein, 79 aa, Homo sapiens
MARRPRHSIYSSDEDDEDFEMCDHDYDGLLPKSGKRHLGKTRWTREENRTDVQCQHRWQKVLNPELIKGPWTKEEDQRN

SEQ ID NO: 69717 - protein, 103 aa, Homo sapiens
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRN

SEQ ID NO: 69718 - protein, 605 aa, Homo sapiens
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 69719 - protein, 700 aa, Homo sapiens
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 69720 - protein, 676 aa, Homo sapiens
MSRRTRCEDLDELHYQDTDSDVPEQRDSKCKVKWTHEENRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 69721 - protein, 464 aa, Homo sapiens
MPSCSTSTMPGMICKNPDLEFDSLQPCFYPDEDDFYFGGPDSTPPGEDIWKKFELLPTPPLSPSRGFAEHSSEPPSWVTEMLLENELWGSPAEEDAFGLGGLGGLTPNPVILQDCMWSGFSAREKLERAVSEKLQHGRGPPTAGSTAQSPGAGAASPAGRGHGGAAGAGRAGAALPAELAHPAAECVDPAVVFPFPVNKREPAPVPAAPASAPAAGPAVASGAGIAAPAGAPGVAPPRPGGRQTSGGDHKALSTSGEDTLSDSDDEDDEEEDEEEEIDVVTVEKRRSSSNTKAVTTFTITVRPKNAALGPGRAQSSELILKRCLPIHQQHNYAAPSPYVESEDAPPQKKIKSEASPRPLKSVIPPKAKSLSPRNSDSEDSERRRNHNILERQRRNDLRSSFLTLRDHVPELVKNEKAAKVVILKKATEYVHSLQAEEHQLLLEKEKLQARQQQLLKKIEHARTC

SEQ ID NO: 69722 - protein, 382 aa, Homo sapiens
MPSCSTSTMPGMICKNPDLEFDSLQPCFYPDEDDFYFGGPDSTPPGEDIWKKFELLPTPPLSPSRGFAEHSSEPPSWVTEMLLENELWGSPAEEDAFGLGGLGGLTPNPVILQDCMWSGFSAREKLERAVSEKLQHGRGPPTAGSTAQSPGVAPPRPGGRQTSGGDHKALSTSGEDTLSDSDDEDDEEEDEEEEIDVVTVEKRRSSSNTKAVTTFTITVRPKNAALGPGRAQSSELILKRCLPIHQQHNYAAPSPYVESEDAPPQKKIKSEASPRPLKSVIPPKAKSLSPRNSDSEDSERRRNHNILERQRRNDLRSSFLTLRDHVPELVKNEKAAKVVILKKATEYVHSLQAEEHQLLLEKEKLQARQQQLLKKIEHARTC

SEQ ID NO: 69723 - protein, 283 aa, Homo sapiens
MAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 69724 - protein, 283 aa, Homo sapiens; identical to SEQ ID NO: 69723

SEQ ID NO: 69725 - protein, 283 aa, Homo sapiens; identical to SEQ ID NO: 69723

SEQ ID NO: 69726 - protein, 282 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAG

SEQ ID NO: 69727 - protein, 309 aa, Homo sapiens
MSWCNELRLPALKQHSIGRGLESHITMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 69728 - protein, 294 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 69729 - protein, 195 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNV

SEQ ID NO: 69730 - protein, 109 aa, Homo sapiens
MSWCNELRLPALKQHSIGRGLESHITMCIPPSYADLGKAARDIFNKGFGFGLVKLDVKTKSCSGVEFSTSGSSNTDTGKVTGTLETKYKWCEYGLTFTEKWNTDNTLGT

SEQ ID NO: 69731 - protein, 204 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGS

SEQ ID NO: 69732 - protein, 255 aa, Homo sapiens
MLVIPATQEAEEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 69733 - protein, 294 aa, Homo sapiens; identical to SEQ ID NO: 69728

SEQ ID NO: 69734 - protein, 283 aa, Homo sapiens
MCNTPTYCDLGKAAKDVFNKGYGFGMVKIDLKTKSCSGVEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLSQNNFALGYKAADFQLHTHVNDGTEFGGSIYQKVNEKIETSINLAWTAGSNNTRFGIAAKYMLDCRTSLSAKVNNASLIGLGYTQTLRPGVKLTLSALIDGKNFSAGGHKVGLGFELEA

SEQ ID NO: 69735 - protein, 284 aa, Homo sapiens
MCNTPTYCDLGKAAKDVFNKGYGFGMVKIDLKTKSCSGVVEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLSQNNFALGYKAADFQLHTHVNDGTEFGGSIYQKVNEKIETSINLAWTAGSNNTRFGIAAKYMLDCRTSLSAKVNNASLIGLGYTQTLRPGVKLTLSALIDGKNFSAGGHKVGLGFELEA

SEQ ID NO: 69736 - protein, 165 aa, Homo sapiens
MCNTPTYCDLGKAAKDVFNKGYGFGMVKIDLKTKSCSGVEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLS

SEQ ID NO: 69737 - protein, 284 aa, Homo sapiens
MCNTPTYCDLGKAAKDVFNKGYGFGMVKIDLKTKSCSGVMEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDTAKSKLSQNNFALGYKAADFQLHTHVNDGTEFGGSIYQKVNEKIETSINLAWTAGSNNTRFGIAAKYMLDCRTSLSAKVNNASLIGLGYTQTLRPGVKLTLSALIDGKNFSAGGHKVGLGFELEA

SEQ ID NO: 69738 - protein, 159 aa, Homo sapiens
MCNTPTYCDLGKAAKDVFNKGYGFGMVKIDLKTKSCSGVEFSTSGHAYTDTGKASGNLETKYKVCNYGLTFTQKWNTDNTLGTEISWENKLAEGLKLTLDTIFVPNTGKKSGKLKASYKRDCFSVGSNVDIDFSGPTIYGWAVLAFEGWLAGYQMSFDT

SEQ ID NO: 69739 - protein, 353 aa, Homo sapiens
MVGDTLKLLSPLMTRYFFLLFYSTDSSDLNENQHPLDFDEMAFGKVKSGISFLIQTGVGILGNSFLLCFYNLILFTGHKLRPTDLILSQLALANSMVLFFKGIPQTMAAFGLKYLLNDTGCKFVFYYHRVGTRVSLSTICLLNGFQAIKLNPSICRWMEIKIRSPRFIDFCCLLCWAPHVLMNASVLLLVNGPLNSKNSSAKNNYGYCSYKASKRFSSLHAVLYFSPDFMSLGFMVWASGSMVFFLYRHKQQVQHNHSNRLSCRPSQEARATHTIMVLVSSFFVFYSVHSFLTIWTTVVANPGQWIVTNSVLVASCFPARSPFVLIMSDTHISQFCFACRTRKTLFPNLVVMP

SEQ ID NO: 69740 - protein, 197 aa, Homo sapiens [sequence omitted]

SEQ ID NO: 69741 - protein, 192 aa, Homo sapiens
MAPQPMIHTQQGLRTSSPSTPSPEHQEDVDSFMKQPGNETADTVLKKLDEQYQKYKFMELNLAQKKRRLKGQIPEIKQTLEILKYMQKKKESTNSMETRFLLADNLYCKASVPPTDKMCLWLGANVMLEYDIDEAQALLEKNLSTATKNLDSLEEDLDFLRDQFTTTEVNMARVYNWDVKRRNKDDSTKNKA

SEQ ID NO: 69742 - protein, 233 aa, Homo sapiens
MRPQQLHATEITSSGFRLAWPPLLTADSGYYVLELVPSAQPGAARRQQLPGNATDWIWAGLDPDTDYDVALVPESNVRLLRPQILRVRTRPGEAGPGASGPESGAGPAPTQLAALPAPEEAGPERIVISHARPRSLRVSWAPALGSAAALGYHVQFGPLRGGEAQRVEVPAGRNCTTLQGLAPGTAYLVTVTAAFRSGRESALSAKACTPDGPRPRPRPVPRAPTPGTASREP

SEQ ID NO: 69743 - protein, 445 aa, Homo sapiens
MLPWTALGLALSLRLALARSGAERGPPASAPRGDLMFLLDSSASVSHYEFSRVREFVGQLVAPLPLGTGALRASLVHVGSRPYTEFPFGQHSSGEAAQDAVRASAQRMGDTHTGLALVYAKEQLFAEASGARPGVPKVLVWVTDGGSSDPVGPPMQELKDLGVTVFIVSTGRGNFLELSAAASAPAEKHLHFVDVDDLHIIVQELRGSILDAMRPQQLHATEITSSGFRLAWPPLLTADSGYYVLELVPSAQPGAARRQQLPGNATDWIWAGLDPDTDYDVALVPESNVRLLRPQILRVRTRPGEAGPGASGPESGAGPAPTQLAALPAPEEAGPERIVISHARPRSLRVSWAPALGSAAALGYHVQFGPLRGGEAQRVEVPAGRNCTTLQGLAPGTAYLVTVTAAFRSGRESALSAKACTPDGPRPRPRPVPRAPTPGTASREP

SEQ ID NO: 69744 - protein, 64 aa, Homo sapiens
MLPWTALGLALSLRLALARSGAERGAQGPGRHRVHCQHRPRQLPGAVSRCLSPCREAPALCGRG

SEQ ID NO: 69745 - protein, 325 aa, Homo sapiens
MPSSTAMAVGALSSSLLVTCCLMVALCSPSIPLEKLAQAPEQPGQEKREHASRDGPGRVNELGRPARDEGGSGRDWKSKSGRGLAGREPWSKLKQAWVSQGGGAKAGDLQVRPRGDTPQAEALAAAAQDAIGPELAPTPEPPEEYVYPDYRGKGCVDESGFVYAIGEKFAPGPSACPCLCTEEGPLCAQPECPRLHPRCIHVDTSQCCPQCKERKNYCEFRGKTYQTLEEFVVSPCERCRCEANGEVLCTVSACPQTECVDPVYEPDQCCPICKNGPNCFAETAVIPAGREVKTDECTICHCTYEEGTWRIERQAMCTRHECRQM

SEQ ID NO: 69746 - protein, 249 aa, Homo sapiens
MTSETLWWLITLKKQLGDNEAITQEIVGCAHLENYALKMFLYADNEDRAGRFHKNMIKSFYTASLLIDVITVFGELTDENVKHRKYARWKATYIHNCLKNGETPQAGPVGIEEDNDIEENEDAGAASLPTQPTQPSSSSTYDPSNMPSGNYTGIQIPPGAHAPANTPAEVPHSTGVASNTIQPTPQTIPAIDPALFNTISQGDVRLTPEDFARAQKYCKYAGSALQYEDVSTAVQNLQKALKLLTTGRE

SEQ ID NO: 69747 - protein, 307 aa, Homo sapiens
MAALAPLPPLPAQFKSIQHHLRTAQEHDKRDPVVAYYCRLYAMQTGMKIDSKTPECRKFLSKLMDQLEALKKQLGDNEAITQEIVGCAHLENYALKMFLYADNEDRAGRFHKNMIKSFYTASLLIDVITVFGELTDENVKHRKYARWKATYIHNCLKNGETPQAGPVGIEEDNDIEENEDAGAASLPTQPTQPSSSSTYDPSNMPSGNYTGIQIPPGAHAPANTPAEVPHSTGVASNTIQPTPQTIPAIDPALFNTISQGDVRLTPEDFARAQKYCKYAGSALQYEDVSTAVQNLQKALKLLTTGRE

SEQ ID NO: 69748 - protein, 220 aa, Homo sapiens
EMAALAPLPPLPAQFKSIQHHLRTAQEHDKRDPVVAYYCRLYAMQTGMKIDSKTPECRKFLSKLMDQLEALKKQLGDNEAITQEIVGCAHLENYALKMFLYADNEDRAGRFHKNMIKSFYTASLLIDVITVFGELTDENVKHRKYARWKATYIHNCKEWGDSSSRPCWLKKIMILKKMKMLEQPLCPLSQLSHHHLQLMTQHAIRQLYWNTDSSGCTRSS

SEQ ID NO: 69749 - protein, 222 aa, Homo sapiens
MTSETLWWLITLKKQLGDNEAITQEIVGCAHLENYALKMFLYADNEDRAGRFHKNMIKSFYTASLLIDVITVFGELTDENVKHRKYARWKATYIHNCLKNGETPQAGPVGIEEDNDIEENEDAGAASLPTQPTQPSSSSTYDPSNMPSGNYTGIQIPPGAHAPANTPAEVPHSTGDVRLTPEDFARAQKYCKYAGSALQYEDVSTAVQNLQKALKLLTTGRE

SEQ ID NO: 69750 - protein, 206 aa, Homo sapiens
MAANKPKGQNSLALHKVIMVGSGGVGKSALTLQFMYDEFVEDYEPTKADSYRKKVVLDGEEVQIDILDTAGQEDYAAIRDNYFRSGEGFLCVFSITEMESFAATADFREQILRVKEDENVPFLLVGNKSDLEDKRQVSVEEAKNRAEQWNVNYVETSAKTRANVDKVFFDLMREIRARKMEDSKEKNGKKKRKSLAKRIRERCCIL

SEQ ID NO: 69751 - protein, 101 aa, Homo sapiens
MAANKPKGQNSLALHKVIMVGSGGVGKSALTLQFMYDEFVEDYEPTKADSYRKKVVLDGEEVQIDILDTAGQEDYAAIRDNYFRSGEGFLCVFSITEMESF

SEQ ID NO: 69752 - protein, 206 aa, Homo sapiens
MAANKSKGQSSLALHKVIMVGSGGVGKSALTLQFMYDEFVEDYEPTKADSYRKKVVLDGEEVQIDILDTAGQEDYAAIRDNYFRSGEGFLLVFSITEHESFTATAEFREQILRVKAEEDKIPLLVVGNKSDLEERRQVPVEEARSKAEEWGVQYVETSAKTRANVDKVFFDLMREIRTKKMSENKDKNGKKSSKNKKSFKERCCLL

SEQ ID NO: 69753 - protein, 227 aa, Homo sapiens
MAANKSKGQSSLALHKVIMVGSGGVGKSALTLQFMNVSKSLAYDKKKYTANKKVEGILEFVEDYEPTKADSYRKKVVLDGEEVQIDILDTAGQEDYAAIRDNYFRSGEGFLLVFSITEHESFTATAEFREQILRVKAEEDKIPLLVVGNKSDLEERRQVPVEEARSKAEEWGVQYVETSAKTRANVDKVFFDLMREIRTKKMSENKDKNGKKSSKNKKSFKERCCLL

SEQ ID NO: 69754 - protein, 167 aa, Homo sapiens
MAANKSKGQSSLALHKVIMVGSGGVGKSALTLQFMYDEFVEDYEPTKADSYRKKVVLDGEEVQIDILDTAGQEDYAAIRDNYFRSGEGFLLVFSITEHESFTATAEFREQILRVKAEEDKIPLLVVGNKSDLEERRQVPVEEARSKAEEWGVQYVETSAKTRANVDK

SEQ ID NO: 69755 - protein, 206 aa, Homo sapiens; identical to SEQ ID NO: 69752

SEQ ID NO: 69756 - protein, 228 aa, Homo sapiens
MKQRQSALQWVICVSQPQKTSEMAANKSKGQSSLALHKVIMVGSGGVGKSALTLQFMYDEFVEDYEPTKADSYRKKVVLDGEEVQIDILDTAGQEDYAAIRDNYFRSGEGFLLVFSITEHESFTATAEFREQILRVKAEEDKIPLLVVGNKSDLEERRQVPVEEARSKAEEWGVQYVETSAKTRANVDKVFFDLMREIRTKKMSENKDKNGKKSSKNKKSFKERCCLL

SEQ ID NO: 69757 - protein, 619 aa, Homo sapiens
MASGAYNPYIEIIEQPRQRGMRFRYKCEGRSAGSIPGEHSTDNNRTYPSIQIMNYYGKGKVRITLVTKNDPYKPHPHDLVGKDCRDGYYEAEFGQERRPLFFQNLGIRCVKKKEVKEAIITRIKAGINPFNVPEKQLNDIEDCDLNVVRLCFQVFLPDEHGNLTTALPPVVSNPIYDNRAPNTAELRICRVNKNCGSVRGGDEIFLLCDKVQKDDIEVRFVLNDWEAKGIFSQADVHRQVAIVFKTPPYCKAITEPVTVKMQLRRPSDQEVSESMDFRYLPDEKDTYGNKAKKQKTTLLFQKLCQDHVETGFRHVDQDGLELLTSGDPPTLASQSAGITVNFPERPRPGLLGSIGEGRYFKKEPNLFSHDAVVREMPTGVSSQAESYYPSPGPISSGLSHHASMAPLPSSSWSSVAHPTPRSGNTNPLSSFSTRTLPSNSQGIPPFLRIPVGNDLNASNACIYNNADDIVGMEASSMPSADLYGISDPNMLSNCSVNMMTTSSDSMGETDNPRLLSMNLENPSCNSVLDPRDLRQLHQMSSSSMSAGANSNTTVFVSQSDAFEGSDFSCADNSMINESGPSNSTNPNSHGFVQDSQYSGIGSMQNEQLSDSFPYEFFQV

SEQ ID NO: 69758 - protein, 587 aa, Homo sapiens
MASGAYNPYIEIIEQPRQRGMRFRYKCEGRSAGSIPGEHSTDNNRTYPSIQIMNYYGKGKVRITLVTKNDPYKPHPHDLVGKDCRDGYYEAEFGQERRPLFFQNLGIRCVKKKEVKEAIITRIKAGINPFNVPEKQLNDIEDCDLNVVRLCFQVFLPDEHGNLTTALPPVVSNPIYDNRAPNTAELRICRVNKNCGSVRGGDEIFLLCDKVQKDDIEVRFVLNDWEAKGIFSQADVHRQVAIVFKTPPYCKAITEPVTVKMQLRRPSDQEVSESMDFRYLPDEKDTYGNKAKKQKTTLLFQKLCQDHVNFPERPRPGLLGSIGEGRYFKKEPNLFSHDAVVREMPTGVSSQAESYYPSPGPISSGLSHHASMAPLPSSSWSSVAHPTPRSGNTNPLSSFSTRTLPSNSQGIPPFLRIPVGNDLNASNACIYNNADDIVGMEASSMPSADLYGISDPNMLSNCSVNMMTTSSDSMGETDNPRLLSMNLENPSCNSVLDPRDLRQLHQMSSSSMSAGANSNTTVFVSQSDAFEGSDFSCADNSMINESGPSNSTNPNSHGFVQDSQYSGIGSMQNEQLSDSFPYEFFQV

SEQ ID NO: 69759 - protein, 548 aa, Homo sapiens
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 69760 - protein, 551 aa, Homo sapiens
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 69761 - protein, 246 aa, Homo sapiens
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVCPQASTPALSLYVIPEHHQL

SEQ ID NO: 69762 - protein, 377 aa, Homo sapiens
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPGKDFLLSHWNDRFSSVQLRSSGDEDSWAPLQTY

SEQ ID NO: 69763 - protein, 237 aa, Homo sapiens
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKAHGIPVPARYRRSSPD

SEQ ID NO: 69764 - protein, 425 aa, Homo sapiens [sequence omitted]

SEQ ID NO: 69765 - protein, 579 aa, Homo sapiens
MLRSGPASGPSVPTGRAMPSRRVARPPAAPELGALGSPDLSSLSLAVSRSTDELEIIDEYIKENGFGLDGGQPGPGEGLPRLVSRGAASLSTVTLGPVAPPATPPPWGCPLGRLVSPAPGPGPQPHLVITEQPKQRGMRFRYECEGRSAGSILGESSTEASKTLPAIELRDCGGLREVEVTACLVWKDWPHRVHPHSLVGKDCTDGICRVRLRPHVSPRHSFNNLGIQCVRKKEIEAAIERKIQLGIDPYNAGSLKNHQEVDMNVVRICFQASYRDQQGQMRRMDPVLSEPVYDKKSTNTSELRICRINKESGPCTGGEELYLLCDKVQKEDISVVFSRASWEGRADFSQADVHRQIAIVFKTPPYEDLEIVEPVTVNVFLQRLTDGVCSEPLPFTYLPRDHDSYGVDKKRKRGMPDVLGELNSSDPHGIESKRRKKKPAILDHFLPNHGSGPFLPPSALLPDPDFFSGTVSLPGLEPPGGPDLLDDGFAYDPTAPTLFTMLDLLPPAPPHASAVVCSGGAGAVVGETPGPEPLTLDSYQAPGPGDGGTASLVGSNMFPNHYREAAFGGGLLSPGPEAT

SEQ ID NO: 69766 - protein, 576 aa, Homo sapiens
MLRSGPASGPSVPTGRAMPSRRVARPPAAPELGALGSPDLSSLSLAVSRSTEIIDEYIKENGFGLDGGQPGPGEGLPRLVSRGAASLSTVTLGPVAPPATPPPWGCPLGRLVSPAPGPGPQPHLVITEQPKQRGMRFRYECEGRSAGSILGESSTEASKTLPAIELRDCGGLREVEVTACLVWKDWPHRVHPHSLVGKDCTDGICRVRLRPHVSPRHSFNNLGIQCVRKKEIEAAIERKIQLGIDPYNAGSLKNHQEVDMNVVRICFQASYRDQQGQMRRMDPVLSEPVYDKKSTNTSELRICRINKESGPCTGGEELYLLCDKVQKEDISVVFSRASWEGRADFSQADVHRQIAIVFKTPPYEDLEIVEPVTVNVFLQRLTDGVCSEPLPFTYLPRDHDSYGVDKKRKRGMPDVLGELNSSDPHGIESKRRKKKPAILDHFLPNHGSGPFLPPSALLPDPDFFSGTVSLPGLEPPGGPDLLDDGFAYDPTAPTLFTMLDLLPPAPPHASAVVCSGGAGAVVGETPGPEPLTLDSYQAPGPGDGGTASLVGSNMFPNHYREAAFGGGLLSPGPEAT

SEQ ID NO: 69767 - protein, 579 aa, Homo sapiens; identical to SEQ ID NO: 69765

SEQ ID NO: 69768 - protein, 728 aa, Homo sapiens
MEAAAGGRGCFQPHPGLQKTLEQFHLSSMSSLGGPAAFSARWAQEAYKKESAKEAGAAAVPAPVPAATEPPPVLHLPAIQPPPPVLPGPFFMPSDRSTERCETVLEGETISCFVVGGEKRLCLPQILNSVLRDFSLQQINAVCDELHIYCSRCTADQLEILKVMGILPFSAPSCGLITKTDAERLCNALLYGGAYPPPCKKELAASLALGLELSERSVRVYHECFGKCKGLLVPELYSSPSAACIQCLDCRLMYPPHKFVVHSHKALENRTCHWGFDSANWRAYILLSQDYTGKEEQARLGRCLDDVKEKFDYGNKYKRRVPRVSSEPPASIRPKTDDTSSQSPAPSEKDKPSSWLRTLAGSSNKSLGCVHPRQRLSAFRPWSPAVSASEKELSPHLPALIRDSFYSYKSFETAVAPNVALAPPAQQKVVSSPPCAAAVSRAPEPLATCTQPRKRKLTVDTPGAPETLAPVAAPEEDKDSEAEVEVESREEFTSSLSSLSSPSFTSSSSAKDLGSPGARALPSAVPDAAAPADAPSGLEAELEHLRQALEGGLDTKEAKEKFLHEVVKMRVKQEEKLSAALQAKRSLHQELEFLRVAKKEKLREATEAKRNLRKEIERLRAENEKKMKEANESRLRLKRELEQARQARVCDKGCEAGRLRAKYSAQIEDLQVKLQHAEADREQLRADLLREREAREHLEKVVKELQEQLWPRARPEAAGSEGAAELEP

SEQ ID NO: 69769 - protein, 543 aa, Homo sapiens
MGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTEHADGLCHKLTTVCPTVKPQTQGLAKDAWEIPRESLRLEVKLGQGCFGEVWMGTWNGTTKVAIKTLKPGTMMPEAFLQEAQIMKKLRHDKLVPLYAVVSEEPIYIVTEFMSKGSLLDFLKEGDGKYLKLPQLVDMAAQIADGMAYIERMNYIHRDLRAANILVGENLVCKIADFGLARLIEDNEYTARQGAKFPIKWTAPEAALYGRFTIKSDVWSFGILQTELVTKGRVPYPGMVNREVLEQVERGYRMPCPQGCPESLHELMNLCWKKDPDERPTFEYIQSFLEDYFTATEPQYQPGENL

SEQ ID NO: 69770 - protein, 543 aa, Homo sapiens; identical to SEQ ID NO: 69769

SEQ ID NO: 69771 - protein, 543 aa, Homo sapiens; identical to SEQ ID NO: 69769

SEQ ID NO: 69772 - protein, 512 aa, Homo sapiens
MGCIKSKGKDSLSDDGVDLKTQPVRNTERTIYVRDPTSNKQQRPVPESQLLPGQRFQTKDPEEQGDIVVALYPYDGIHPDDLSFKKGEKMKVLEEHGEWWKAKSLLTKKEGFIPSNYVAKLNTLETEEWFFKDITRKDAERQLLAPGNSAGAFLIRESETLKGSFSLSVRDFDPVHGDVIKHYKIRSLDNGGYYISPRITFPCISDMIKHYQKQADGLCRRLEKACISPKPQKPWDKDAWEIPRESIKLVKRLGAGQFGEVWMGYYNNSTKVAVKTLKPGTMSVQAFLEEANLMKTLQHDKLVRLYAVVTREEPIYIITEYMAKGSLLDFLKSDEGGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMTALSQGYRMPRVENCPDELYDIMKMCWKEKAEERPTFDYLQSVLDDFYTATEGQYQQQP

SEQ ID NO: 69773 - protein, 150 aa, Homo sapiens
MGCIKSKGKDSLSDDGVDLKTQPVRNTERTIYVRDPTSNKQQRPVPESQLLPGQRFQTKDPEEQGDIVVALYPYDGIHPDDLSFKKGEKMKVLEEHGEWWKAKSLLTKKEGFIPSNYVAKLNTLETEEWFFKDITRKDAERQLLAPGNSA

SEQ ID NO: 69774 - protein, 491 aa, Homo sapiens
MGCIKSKGKDSLSDDGVDLKTQPVPESQLLPGQRFQTKDPEEQGDIVVALYPYDGIHPDDLSFKKGEKMKVLEEHGEWWKAKSLLTKKEGFIPSNYVAKLNTLETEEWFFKDITRKDAERQLLAPGNSAGAFLIRESETLKGSFSLSVRDFDPVHGDVIKHYKIRSLDNGGYYISPRITFPCISDMIKHYQKQADGLCRRLEKACISPKPQKPWDKDAWEIPRESIKLVKRLGAGQFGEVWMGYYNNSTKVAVKTLKPGTMSVQAFLEEANLMKTLQHDKLVRLYAVVTREEPIYIITEYMAKGSLLDFLKSDEGGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMTALSQGYRMPRVENCPDELYDIMKMCWKEKAEERPTFDYLQSVLDDFYTATEGQYQQQP

SEQ ID NO: 69775 - protein, 220 aa, Homo sapiens
MPLTGVGPGSCRRQIIRALCLLLLLLHAGSAKNIWKRALPARLAEKSRAEEAGAPGGPRQPRADRCPPPPRTLPPGACQAARCQADSECPRHRRCCYNGCAYACLEAVPPPPVLDWLVQPKPRWLGGNGWLLDGPEEVLQAEACSTTEDGAEPLLCPSGYECHILSPGDVAEGIPNRGQCVKQRRQADGRILRHKLYKEYPEGDSKNVAEPGRGQQKHFQ

SEQ ID NO: 69776 - protein, 111 aa, Homo sapiens
MGSSSFLVLMVSLVLVTLVAVEGVKEGIEKAGVCPADNVRCFKSDPPQCHTDQDCLGERKCCYLHCGFKCVIPVKELEEGGNKDEDVSRPYPEPGWEAKCPGSSSTRCPQK

SEQ ID NO: 69777 - protein, 224 aa, Homo sapiens
MRTQSLLLLGALLAVGSQLPAVFGRKKGEKSGGCPPDDGPCLLSVPDQCVEDSQCPLTRKCCYRACFRQCVPRVSVKLGSCPEDQLRCLSPMNHLCHKDSDCSGKKRCCHSACGRDCRDPARGTAPGCPGQANSDLGSVALHLSWGPTERVHDGRPGALPAGQHYLYQRWFQPSDNHWPADTSLQPIHPWFLLLGVKVHSLSSEEGLCITPVLCTTAIRASHPS

SEQ ID NO: 69778 - protein, 123 aa, Homo sapiens
MRTQSLLLLGALLAVGSQLPAVFGRKKGEKSGGCPPDDGPCLLSVPDQCVEDSQCPLTRKCCYRACFRQCVPRVSVKLGSCPEDQLRCLSPMNHLCHKDSDCSGKKRCCHSACGRDCRDPARG

SEQ ID NO: 69779 - protein, 548 aa, Homo sapiens
MPALRPLLPLLLLLRLTSGAGLLPGLGSHPGVCPNQLSPNLWVDAQSTCERECSRDQDCAAAEKCCINVCGLHSCVAARFPGSPAAPTTAASCEGFVCPQQGSDCDIWDGQPVCRCRDRCEKEPSFTCASDGLTYYNRCYMDAEACLRGLHLHIVPCKHVLSWPPSSPGPPETTARPTPGAAPVPPALYSSPSPQAVQVGGTASLHCDVSGRPPPAVTWEKQSHQRENLIMRPDQMYGNVVVTSIGQLVLYNARPEDAGLYTCTARNAAGLLRADFPLSVVQREPARDAAPSIPAPAECLPDVQACTGPTSPHLVLWHYDPQRGGCMTFPARGCDGAARGFETYEACQQACARGPGDACVLPAVQGPCRGWEPRWAYSPLLQQCHPFVYGGCEGNGNNFHSRESCEDACPVPRTPPCRACRLRSKLALSLCRSDFAIVGRLTEVLEEPEAAGGIARVALEDVLKDDKMGLKFLGTKYLEVTLSGMDWACPCPNMTAGDGPLVIMGEVRDGVAVLDAGSYVRAASEKRVKKILELLEKQACELLNRFQD

SEQ ID NO: 69780 - protein, 576 aa, Homo sapiens
MWAPRCRRFWSRWEQVAALLLLLLLLGVPPRSLALPPIRYSHAGICPNDMNPNLWVDAQSTCRRECETDQECETYEKCCPNVCGTKSCVAARYMDVKGKKGPVGMPKEATCDHFMCLQQGSECDIWDGQPVCKCKDRCEKEPSFTCASDGLTYYNRCYMDAEACSKGITLAVVTCRYHFTWPNTSPPPPETTMHPTTASPETPELDMAAPALLNNPVHQSVTMGETVSFLCDVVGRPRPEITWEKQLEDRENVVMRPNHVRGNVVVTNIAQLVIYNAQLQDAGIYTCTARNVAGVLRADFPLSVVRGHQAAATSESSPNGTAFPAAECLKPPDSEDCGEEQTRWHFDAQANNCLTFTFGHCHRNLNHFETYEACMLACMSGPLAACSLPALQGPCKAYAPRWAYNSQTGQCQSFVYGGCEGNGNNFESREACEESCPFPRGNQRCRACKPRQKLVTSFCRSDFVILGRVSELTEEPDSGRALVTVDEVLKDEKMGLKFLGQEPLEVTLLHVDWACPCPNVTVSEMPLIIMGEVDGGMAMLRPDSFVGASSARRVRKLREVMHKKTCDVLKEFLGLH

SEQ ID NO: 69781 - protein, 282 aa, Homo sapiens
MDVKGKKGPVGMPKEATCDHFMCLQQGSECDIWDGQPVCKCKDRCEKEPSFTCAQANNCLTFTFGHCHRNLNHFETYEACMLACMSGPLAACSLPALQGPCKAYAPRWAYNSQTGQCQSFVYGGCEGNGNNFESREACEESCPFPRGNQRCRACKPRQKLVTSFCRSDFVILGRVSELTEEPDSGRALVTVDEVLKDEKMGLKFLGQEPLEVTLLHVDWACPCPNVTVSEMPLIIMGEVDGGMAMLRPDSFVGASSARRVRKLREVMHKKTCDVLKEFLGLH

SEQ ID NO: 69782 - protein, 502 aa, Homo sapiens
MPLVKRNIEPRHLCRGALPEGITSELECVTNSTLAAIIRQLSSLSKHAEDIFGELFNEANNFYIRANSLQDRIDRLAVKVTQLDSTVEEVSLQDINMKKAFKSSTVQDQQVVSKNSIPNPVADIYNQSDKPPPLNILTPYRDDKKDGLKFYTDPSYFFDLWKEKMLQDTEDKRKEKRRQKEQKRIDGTTREVKKVRKARNRRQEWNMMAYDKELRPDNRLSQSVYHGASSEGSLSPDTRSHASDVTDYSYPATPNHSLHPQPVTPSYAAGDVPPHGPASQAAEHEYRPPSASARHMALNRPQQPPPPPPPQAPEGSQASAPMAPADYGMLPAQIIEYYNPSGPPPPPPPPVIPSAQTAFVSPLQMPMQPPFPASASSTHAAPPHPPSTGLLVTAPPPPGPPPPPPGPPGPGSSLSSSPMHGPPVAEAKRQEPAQPPISDARSDLLAAIRMGIQLKKVQEQREQEAKREPVGNDVATILSRRIAVEYSDSDDDSEFDENDWSD

SEQ ID NO: 69783 - protein, 499 aa, Homo sapiens
MPLVKRNIEPRHLCRGALPEGITSELECVTNSTLAAIIRQLSSLSKHAEDIFGELFNEANNFYIRANSLQDRIDRLAVKVTQLDSTVEEVSLQDINMKKAFKSSTVQDQQVVSKNSIPNPVADIYNQSDKPPPLNILTPYRDDKKDGLKFYTDPSYFFDLWKEKMLQDTEDKRKEKRRQKREKHKLNPNRNQQVNVRKVRTRKEEWERRKMGIEFMSDAKKLEQAGSAKEDRVPSGSHASDVTDYSYPATPNHSLHPQPVTPSYAAGDVPPHGPASQAAEHEYRPPSASARHMALNRPQQPPPPPPPQAPEGSQASAPMAPADYGMLPAQIIEYYNPSGPPPPPPPPVIPSAQTAFVSPLQMPMQPPFPASASSTHAAPPHPPSTGLLVTAPPPPGPPPPPPGPPGPGSSLSSSPMHGPPVAEAKRQEPAQPPISDARSDLLAAIRMGIQLKKVQEQREQEAKREPVGNDVATILSRRIAVEYSDSDDDSEFDENDWSD

SEQ ID NO: 69784 - protein, 783 aa, Homo sapiens
MEDEQPDSLEGWVPVREGLFAEPERHRLRFLVAWNGAEGKFAVTCHDRTAQQRRLREGARLGPEPEPKPEAAVSPSSWAGLLSAAGLRGAHRQLAALWPPLERCFPRLPPELDVGGGGAWGLGLGLWALLWPTRAGPGEAALQELCGQLERYLGAAADGCGGATVRDALFPAEGGAADCESPREFRERALRARWVEADARLRQVIQGHGKANTMVALMNVYQEEDEAYQELVTVATMFFQYLLQPFRAMREVATLCKLDILKSLDEDDLGPRRVVALEKEAEEWTRRAEEAVVSIQDITVNYFKETVKALAGMQKEMEQDAKRFGQAAWATAIPRLEKLQLMLARETLQLMRAKELCLNHKRAEIQGKMEDLPEQEKNTNVVDELEIQFYEIQLELYEVKFEILKNEEILLTTQLDSLKRLIKEKQDEVVYYDPCENPEELKVIDCVVGLQDDKNLEVKELRRQCQQLESKRGRICAKRASLRSRKDQCKENHRFRLQQAEESIRYSRQHHSIQMKRDKIKEEEQKKKEWINQERQKTLQRLRSFKDKRLAQSVRNTSGSEPVAPNLPSDLSQQMCLPASHAVSVIHPSSRKTRGVPLSEAGNVKSPKCQNCHGNIPVQVFVPVGDQTHSKSSEELSLPPPPPPPPPPPPPPPPPPPPLRALSSSSQAATHQNLGFRAPVKDDQPRPLVCESPAERPRDSLESFSCPGSMDEVLASLRHGRAQGVKLKKVHPDLGPNPSSKPTSNRRTSDLERSIKAALQRIKRVSADSEEDSDEQDPGQWDG

SEQ ID NO: 69785 - protein, 809 aa, Homo sapiens
MEDEQPDSLEGWVPVREGLFAEPERHRLRFLVAWNGAEGKFAVTCHDRTAQQRRLREGARLGPEPEPKPEAAVSPSSWAGLLSAAGLRGAHRQLAALWPPLERCFPRLPPELDVGGGGAWGLGLGLWALLWPTRAGPGEAALQELCGQLERYLGAAADGCGGATVRDALFPAEGGAADCESPREFRERALRARWVEADARLRQVIQGHGKANTMVALMNVYQEEDEAYQELVTVATMFFQYLLQPFRAMREVATLCKLDILKSLDEDDLGPRRVVALEKEAEEWTRRAEEAVVSIQDITVNYFKETVKALAGMQKEMEQDAKRFGQAAWATAIPRLEKLQLMLARETLQLMRAKELCLNHKRAEIQGKMEDLPEQEKNTNVVDELEIQFYEIQLELYEVKFEILKNEEILLTTQLDSLKRLIKEKQDEVVYYDPCENPEELKVIDCVVGLQDDKNLEVKELRRQCQQLESKRGRICAKRASLRSRKDQCKENHRFRLQQAEESIRYSRQHHSIQMKRDKIKEEEQKKKEWINQERQKTLQRLRSFKDKRLAQSVRNTSGSEPVAPNLPSDLSQQMCLPASHAVSVIHPSSRKTRGVPLSEAGNVKSPKCQNCHGNIPVQVFVPVGDQTHSKSSEELSLPPPPPPPPPPPPPPPPPPPPLRALSSSSQAATHQNLGFRAPVKDDQPRPLVCESPAERPRDSLESFSCPGSMDEVLASLRHGRAPLRKVEVPAVRPPHASINEHILAAIRQGVKLKKVHPDLGPNPSSKPTSNRRTSDLERSIKAALQRIKRVSADSEEDSDEQDPGQWDG

SEQ ID NO: 69786 - protein, 483 aa, Homo sapiens
MPVPPPPPPPLPPPPPPLGAPPPPPPSAPPVSTDTSSLRRADPKGRSALLADIQQGTRLRKVTQINDRSAPQIESSKGTNKEGGGSANTRGASTPPTLGDLFAGGFPVLRPAGQRDVAGGKTGQGPGSRAPSPRLPNKTISGPLIPPASPRLGNTSEAHGAARTAPPRPNVPAPPPPTPPPPPPPLPPPLPSSSPIKTPLVSPPGPLTKGNLPVVAPPVPCAPPPPPPPPPPTPPPLPPASVLSDKAVKPQLAPLHLPPIPPPLPLLPPCGYPGLKAEPASPAQDAQEPPAPPPPLPPYASCSPRASLPAPPLPGVNSSSETPPPLPPKSPSFQAPPQKAGAQALPAPPAPPGSQPFLQKKRHGRPGAGGGKLNPPPAPPARSPTTELSSKSQQATAWTPTQQPGGQLRNGSLHIIDDFESKFTFHSVEDFPPPDEYKPCQKIYPSKIPRSRTPGPWLQAEAVGQSSDDIKGRNSQLSLKTLR

SEQ ID NO: 69787 - protein, 483 aa, Homo sapiens
MPVPPPPPPPLPPPPPPLGAPPPPPPSAPPVSTDTSSLRRADPKGRSALLADIQQGTRLRKVTQINDRSAPQIESSKGTNKEGGGSANTRGASTPPTLGDLFAGGFPVLRPAGQRDVAGGKTGQGPGSRAPSPRLPNKTISGPLIPPASPRLGNTSEAHGAARTAPPRPNVPAPPPPTPPPPPPPLPPPLPSSSPIKTPLVSPPGPLTKGNLPVVAPPVPCAPPPPPPPPPPTPPPLPPASVLSDKAVKPQLAPLHLPPIPPPLPLLPPCGYPGLKAEPASPAQDAQEPPAPPPPLPPYASCSPRASLPAPPLPGVNSSSETPPPLPPKSPSFQAPPQKAGAQALPAPPAPPGSQPFLQKKRHGRPGAGGGKLNPPPAPPARSPTTELSSKSQQATAWTPTQQPGGQLRNGSLHIIDDFESKFTFHSVEDFPPPDEYKPCQKIYPSKIPRSRTPGPWLQAEAVGQSSDDIKGRNSQVTQASCL

SEQ ID NO: 69788 - protein, 483 aa, Homo sapiens; identical to SEQ ID NO: 69787

SEQ ID NO: 69789 - protein, 309 aa, Homo sapiens
MAVNQSHTENRRGALIPNGESLLKRSPNVELSFPQRSEGSNVFSGRKTGTLFLTSYRVIFITSCSISDPMLSFMMPFDLMTNLTVEQPVFAANFIKGTIQAAPYGGWEGQATFKLVFRNGDAIEFAQLMVKAASAAARGFPLRTLNDWFSSMGIYVITGEGNMCTPQMPCSVIVYGAPPAGYGAPPPGYGAPPAGYGAQPVGNEGPPVGYRASPVRYGAPPLGYGAPPAGYGAPPLGYGAPPLGYGTPPLGYGAPPLGYGAPPAGNEGPPAGYRASPAGSGARPQESTAAQAPENEASLPSASSSQVHS

SEQ ID NO: 69790 - protein, 309 aa, Homo sapiens; identical to SEQ ID NO: 69789

SEQ ID NO: 69791 - protein, 309 aa, Homo sapiens; identical to SEQ ID NO: 69789

SEQ ID NO: 69792 - protein, 235 aa, Homo sapiens [sequence omitted]

SEQ ID NO: 69793 - protein, 466 aa, Homo sapiens
MPYEIKKVFASLPQVERGVSKIIGGDPKGNNFLYTNGKCVILRNIDDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 69794 - protein, 606 aa, Homo sapiens
MPYEIKKVFASLPQVERGVSKIIGGDPKGNNFLYTNGKCVILRNIDNPALADIYTEHAHQVVVAKYAPSGFYIASGDVSGKLRIWDTTQKEHLLKYEYQPFAGKIKDIAWTEDSKRIAVVGEGREKFGAVFLWDSGSSVGEITGHNKVINSVDIKQSRPYRLATGSDDNCAAFFEGPPFKFKFTIGDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 69795 - protein, 441 aa, Homo sapiens
MLTWVWYLIMTSVLQASVSSVDHSRFVNCVRFSPDGNRFATASADGQIYIYDGKTGEKVCALGGSKAHDGGIYAISWSPDSTHLLSASGDKTSKIWDVSVNSVVSTFPMGSTVLDQQLGCLWQKDHLLSVSLSGYINYLDRNNPSKPLHVIKGHSKSIQCLTVHKNGGKSYIYSGSHDGHINYWDSETGENDSFAGKGHTNQVSRMTVDESGQLISCSMDDTVRYTSLMLRDYSGQGVVKLDVQPKCVAVGPGGYAVVVCIGQIVLLKDQRKCFSIDNPGYEPEVVAVHPGGDTVAIGGVDGNVRLYSILGTTLKDEGKLLEAKGPVTDVAYSHDGAFLAVCDASKVVTVFSVADGYSENNVFYGHHAKIVCLAWSPDNEHFASGGMDMMVYVWTLSDPETRVKIQDAHRLHHVSSLAWLDEHTLVTTSHDASVKEWTITY

SEQ ID NO: 69796 - protein, 176 aa, Homo sapiens
PAETEKVFASLPQVERGVSKIIGGDPKGNNFLYTNGKCVILRNIDDHSRFVNCVRFSPDGNRFATASADGQCLPAPVTAQSRRLPNASPDMQNLDIALPTSADSSSEPKPQSMEKLPPWSAHFPWAPRFWTSSWAAYGRRTTCSVSPCPGTSTIWTETTPASPCTSSRVTVNRSSV

SEQ ID NO: 69797 - protein, 606 aa, Homo sapiens; identical to SEQ ID NO: 69794

SEQ ID NO: 69798 - protein, 466 aa, Homo sapiens; identical to SEQ ID NO: 69793

SEQ ID NO: 69799 - protein, 1224 aa, Homo sapiens
MLPYTVNFKVSARTLTGALNAHNKAAVDWGWQGLIAYGCHSLVVVIDSITAQTLQVLEKHKADVVKVKWARENYHHNIGSPYCLRLASADVNGKIIVWDVAAGVAQCEIQEHAKPIQDVQWLWNQDASRDLLLAIHPPNYIVLWNADTGTKLWKKSYADNILSFSFDPFDPSHLTLLTSEGIVFISDFSPSKPPSGPGKKVYISSPHSSPAHNKLATATGAKKALNKVKILITQEKPSAEFITLNDCLQLAYLPSKRNHMLLLYPREILILDLEVNQTVGVIAIERTGVPFLQVIPCFQRDGLFCLHENGCITLRVRRSYNNIFTTSNEEPDPDPVQELTYDLRSQCDAIRVTKTVRPFSMVCCPVNENAAALVVSDGRVMIWELKSAVCNRNSRNSSSGVSPLYSPVSFCGIPVGVLQNKLPDLSLDNMIGQSAIAGEEHPRGSILREVHLKFLLTGLLSGLPAPQFAIRMCPPLTTKNIKMYQPLLAVGTSNGSVLVYHLTSGLLHKELSIHSCEVKGIEWTSLTSFLSFATSTPNNMGLVRNELQLVDLPTGRSIAFRGERGNDESAIEMIKVSHLKQYLAVVFRDKPLELWDVRTCTLLREMSKNFPTITALEWSPSHNLKSLRKKQLATREAMARQTVVSDTELSIVESSVISLLQEAESKSELSQNISAREHFVFTDIDGQVYHLTVEGNSVKDSARIPPDGSMGSITCIAWKGDTLVLGDMDGNLNFWDLKGRVSRGIPTHRSWVRKIRFAPGKGNQKLIAMYNDGAEVWDTKEVQMVSSLRSGRNVTFRILDVDWCTSDKVILASDDGCIRVLEMSMKSACFRMDEQELTEPVWCPYLLVPRASLALKAFLLHQPWNGQYSLDISHVDYPENEEIKNLLQEQLNSLSNDIKKLLLDPEFTLLQRCLLVSRLYGDESELHFWTVAAHYLHSLSQEKSASTTAPKEAAPRDKLSNPLDICYDVLCENAYFQKFQLERVNLQEVKRSTYDHTRKCTDQLLLLGQTDRAVQLLLETSADNQHYYCDSLKACLVTTVTSSGPSQSTIKLVATNMIANGKLAEGVQLLCLIDKAADACRYLQTYGEWNRAAWLAKVRLNPEECADVLRRWVDHLCSPQVNQKSKALLVLLSLGCFFSVAETLHSMRYFDRAALFVEACLKYGAFEVTEDTEKLITAIYADYARSLKNLGFKQGAVLFASKAGAAGKDLLNELESPKEEPIEE

SEQ ID NO: 69800 - protein, 485 aa, Homo sapiens
MAAVWQQVLAVDARYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRPPGSVVPTSAAEASRAMAGDTSLSENYAFAGMYHVFDQHVDEAVPRVRFANDDRHRLACCSLDGSISLCQLVPAPPTVLRVLRGHTRGVSDFAWSLSNDILVSTSLDATMRIWASEDGRCIREIPDPDSAELLCCTFQPVNNNLTVVGNAKHNVHVMNISTGKKVKGGSSKLTGRVLALSFDAPGRLLWAGDDHGSVFSFLFDMATGKLTKAKRLVVHEGSPVTSISARSWVSREARDPSLLINACLNKLLLYRVVDNEGTLQLKRSFPIEQSSHPVRSIFCPLMSFRQGACVVTGSEDMCVHFFDVERAAKAAVNKLQGHSAPVLDVSFNCDESLLASSDASGMVIVWRREQK

SEQ ID NO: 69801 - protein, 485 aa, Homo sapiens; identical to SEQ ID NO: 69800

SEQ ID NO: 69802 - protein, 630 aa, Homo sapiens
MEAVVLPWQIFGVRELPVERGVTMKGPRLFRAPGHVPTGLKCHPDQEHMIYPLGCTVLIQAINTKEQNFLQGHGNNVSCLAISRSGEYIASGQVTFMGFKADIILWDYKNRELLARLSLHKGKIEALAFSPNDLYLVSLGGPDDGSVVVWSIAKRDAICGSPAAGLNVGNATNVIFSRCRDEMFMTAGNGTIRVWELDLPNRKIWPTECQTGQLKRIVMSIGVDDDDSFFYLGTTTGDILKMNPRTKLLTDVGPAKDKFSLGVSAIRCLKMGGLLVGSGAGLLVFCKSPGYKPIKKIQLQGGITSITLRGEGHQFLVGTEESHIYRVSFTDFKETLIATCHFDAVEDIVFPFGTAELFATCAKKDIRVWHTSSNRELLRITVPNMTCHGIDFMRDGKSIISAWNDGKIRAFAPETGRLMYVINNAHRIGVTAIATTSDCKRVISGGGEGEVRVWQIGCQTQKLEEALKEHKSSVSCIRVKRNNEECVTASTDGTCIIWDLVRLRRNQMILANTLFQCVCYHPEEFQIITSGTDRKIAYWEVFDGTVIRELEGSLSGSINGMDITQEGVHFVTGGNDHLVKVWDYNEGEVTHVGVGHSGNITRIRISPGNQYIVSVSADGAILRWKYPYTS

SEQ ID NO: 69803 - protein, 620 aa, Homo sapiens
MDNKISPEAQVAELELDAVIGFNGHVPTGLKCHPDQEHMIYPLGCTVLIQAINTKEQNFLQGHGNNVSCLAISRSGEYIASGQVTFMGFKADIILWDYKNRELLARLSLHKGKIEALAFSPNDLYLVSLGGPDDGSVVVWSIAKRDAICGSPAAGLNVGNATNVIFSRCRDEMFMTAGNGTIRVWELDLPNRKIWPTECQTGQLKRIVMSIGVDDDDSFFYLGTTTGDILKMNPRTKLLTDVGPAKDKFSLGVSAIRCLKMGGLLVGSGAGLLVFCKSPGYKPIKKIQLQGGITSITLRGEGHQFLVGTEESHIYRVSFTDFKETLIATCHFDAVEDIVFPFGTAELFATCAKKDIRVWHTSSNRELLRITVPNMTCHGIDFMRDGKSIISAWNDGKIRAFAPETGRLMYVINNAHRIGVTAIATTSDCKRVISGGGEGEVRVWQIGCQTQKLEEALKEHKSSVSCIRVKRNNEECVTASTDGTCIIWDLVRLRRNQMILANTLFQCVCYHPEEFQIITSGTDRKIAYWEVFDGTVIRELEGSLSGSINGMDITQEGVHFVTGGNDHLVKVWDYNEGEVTHVGVGHSGNITRIRISPGNQYIVSVSADGAILRWKYPYTS

SEQ ID NO: 69804 - protein, 552 aa, Homo sapiens
MDNKISPEAQVAELELDAVIGFNDIILWDYKNRELLARLSLHKGKIEALAFSPNDLYLVSLGGPDDGSVVVWSIAKRDAICGSPAAGLNVGNATNVIFSRCRDEMFMTAGNGTIRVWELDLPNRKIWPTECQTGQLKRIVMSIGVDDDDSFFYLGTTTGDILKMNPRTKLLTDVGPAKDKFSLGVSAIRCLKMGGLLVGSGAGLLVFCKSPGYKPIKKIQLQGGITSITLRGEGHQFLVGTEESHIYRVSFTDFKETLIATCHFDAVEDIVFPFGTAELFATCAKKDIRVWHTSSNRELLRITVPNMTCHGIDFMRDGKSIISAWNDGKIRAFAPETGRLMYVINNAHRIGVTAIATTSDCKRVISGGGEGEVRVWQIGCQTQKLEEALKEHKSSVSCIRVKRNNEECVTASTDGTCIIWDLVRLRRNQMILANTLFQCVCYHPEEFQIITSGTDRKIAYWEVFDGTVIRELEGSLSGSINGMDITQEGVHFVTGGNDHLVKVWDYNEGEVTHVGVGHSGNITRIRISPGNQYIVSVSADGAILRWKYPYTS

SEQ ID NO: 69805 - protein, 1322 aa, Homo sapiens
MAWMTYISNWFEQDDWYEGLQRANMSQVRQVGLLAAGCQPWNKDVCAASGDRFAYCATLAIYIYQLDHRYNEFKLHAIMSEHKKTITAISWCPHNPDLFASGSTDNLVIIWNVAEQKVIAKLDSTKGIPASLSWCWNAEDVVAFVSHRGPLFIWTISGPDSGVIVHKDAHSFLSDICMFRWHTHQKGKVVFGHIDGSLSIFHPGNKNQKHVLRPESLEGTDEEDPVTALEWDPLSTDYLLVVNLHYGIRLVDSESLSCITTFNLPSAAASVQCLAWVPSAPGMFITGDSQVGVLRIWNVSRTTPIDNLKLKKTGFHCLHVLNSPPRKKFSVQSPTKNHYTSSTSEAVPPPTLTQNQAFSLPPGHAVCCFLDGGVGLYDMGAKKWDFLRDLGHVETIFDCKFKPDDPNLLATASFDGTIKVWDINTLTAVYTSPGNEGVIYSLSWAPGGLNCIAGGTSRNGAFIWNVQKGKIIQRFNEHGTNGIFCIAWSHKDSKRIATCSSDGFCIIRTIDGKVLHKYKHPAAVFGCDWSQNNKDMIATGCEDTNVRVYYVATSSDQPLKVFSGHTAKVFHVKWSPLREGILCSGSDDGTVRIWDYTQDACINILNGHTAPVRGLMWNTEIPYLLISGSWDYTIKVWDTREGTCVDTVYDHGADVYGLTCHPSRPFTMASCSRDSTVRLWSLTALVTPVQINILADRSWEEIIGNTDYAIEPGTPPLLCGKVSRDIRQEIEKLTANSQVKKLRWFSECLSPPGGSDNLWNLVAVIKGQDDSLLPQNYCKGIMHLKHLIKFRTSEAQELTTVKMSKFGGGIGVPAKEERLKEAAEIHLRLGQIQRYCELMVELGEWDKALSIAPGVSVKYWKKLMQRRADQLIQEDKDDVIPYCIAIGDVKKLVHFFMSRGQLKEALLVAQAACEGNMQPLHVSVPKGASYSDDIYKEDFNELLHKVSKELAEWYFQDGRAVLAACCHLAIDNIELAMAYLIRGNELELAVCVGTVLGESAAPATHYALELLARKCMMISVCFPCVGYSVPFCYVNRNLAADLLLMIPDNELHLIKLCAFYPGCTEEINDLHDKCKLPTVEECMQLAETARADDNIFETVKYYLLSQEPEKALPIGISFVKEYISSSDWTLDTIYPVLDLLSYIRTEKLLLHTCTEARNELLILCGYIGALLAIRRQYQSIVPALYEYTSQLLKRREVSVPLKIEYLSEELDAWRACTQSTNRSLEDSPYTPPSDSQRMIYATLLKRLKEESLKGIIGPDYVTGSNLPSHSDIHISCLTGLKIQGPVFFLEDGKSAISLNDALMWAKVNPFSPLGTGIRLNPF

SEQ ID NO: 69806 - protein, 130 aa, Homo sapiens
MSQVRQVGLLAAGCQPWNKDVCAASGDRFAYCATLAIYIYQLDHRYNEFKLHAIMSEHKKTITAISWCPHNPDLFASGSTDNLVIIWNVAEQKVIAKLDRARPPSPKIIYIKIINIIEENIHNSEMQWII

SEQ ID NO: 69807 - protein, 1298 aa, Homo sapiens
MSQVRQVGLLAAGCQPWNKDVCAASGDRFAYCATLAIYIYQLDHRYNEFKLHAIMSEHKKTITAISWCPHNPDLFASGSTDNLVIIWNVAEQKVIAKLDSTKGIPASLSWCWNAEDVVAFVSHRGPLFIWTISGPDSGVIVHKDAHSFLSDICMFRWHTHQKGKVVFGHIDGSLSIFHPGNKNQKHVLRPESLEGTDEEDPVTALEWDPLSTDYLLVVNLHYGIRLVDSESLSCITTFNLPSAAASVQCLAWVPSAPGMFITGDSQVGVLRIWNVSRTTPIDNLKLKKTGFHCLHVLNSPPRKKFSVQSPTKNHYTSSTSEAVPPPTLTQNQAFSLPPGHAVCCFLDGGVGLYDMGAKKWDFLRDLGHVETIFDCKFKPDDPNLLATASFDGTIKVWDINTLTAVYTSPGNEGVIYSLSWAPGGLNCIAGGTSRNGAFIWNVQKGKIIQRFNEHGTNGIFCIAWSHKDSKRIATCSSDGFCIIRTIDGKVLHKYKHPAAVFGCDWSQNNKDMIATGCEDTNVRVYYVATSSDQPLKVFSGHTAKVFHVKWSPLREGILCSGSDDGTVRIWDYTQDACINILNGHTAPVRGLMWNTEIPYLLISGSWDYTIKVWDTREGTCVDTVYDHGADVYGLTCHPSRPFTMASCSRDSTVRLWSLTALVTPVQINILADRSWEEIIGNTDYAIEPGTPPLLCGKVSRDIRQEIEKLTANSQVKKLRWFSECLSPPGGSDNLWNLVAVIKGQDDSLLPQNYCKGIMHLKHLIKFRTSEAQELTTVKMSKFGGGIGVPAKEERLKEAAEIHLRLGQIQRYCELMVELGEWDKALSIAPGVSVKYWKKLMQRRADQLIQEDKDDVIPYCIAIGDVKKLVHFFMSRGQLKEALLVAQAACEGNMQPLHVSVPKGASYSDDIYKEDFNELLHKVSKELAEWYFQDGRAVLAACCHLAIDNIELAMAYLIRGNELELAVCVGTVLGESAAPATHYALELLARKCMMISVCFPCVGYSVPFCYVNRNLAADLLLMIPDNELHLIKLCAFYPGCTEEINDLHDKCKLPTVEECMQLAETARADDNIFETVKYYLLSQEPEKALPIGISFVKEYISSSDWTLDTIYPVLDLLSYIRTEKLLLHTCTEARNELLILCGYIGALLAIRRQYQSIVPALYEYTSQLLKRREVSVPLKIEYLSEELDAWRACTQSTNRSLEDSPYTPPSDSQRMIYATLLKRLKEESLKGIIGPDYVTGSNLPSHSDIHISCLTGLKIQGPVFFLEDGKSAISLNDALMWAKVNPFSPLGTGIRLNPF

SEQ ID NO: 69808 - protein, 1283 aa, Homo sapiens
MSQVRQVGLLAAGCQPWNKDVCAASGDRFAYCATLAIYIYQLDHRYNEFKLHAIMSEHKKTITAISWCPHNPDLFASGSTDNLVIIWNVAEQKVIAKLDSTKGIPASLSWCWNAEDVVAFVSHRGPLFIWTISGPDSGVIVHKDAHSFLSDICMFRWHTHQKGKVVFGHIDGSLSIFHPGNKNQKHVLRPESLEGTDEEDPVTALEWDPLSTDYLLVVNLHYGIRLVDSESLSCITTFNLPSAAASVQCLAWVPSAPGMFITGDSQVGVLRIWNVSRTTPIDNLKLKKTGFHCLHVLNSPPRKKFSVQSPTKNHYTSSTSEAVPPPTLTQNQAFSLPPGHAVCCFLDGGVGLYDMGAKKWDFLRDLGHVETIFDCKFKPDDPNLLATASFDGTIKVWDINTLTAVYTSPGNEGVIYSLSWAPGGLNCIAGGTSRNGAFIWNVQKGKIIQRFNEHGTNGIFCIAWSHKDSKRIATCSSDGFCIIRTIDGKVLHKYKHPAAVFGCDWSQNNKDMIATGCEDTNVRVYYVATSSDQPLKVFSGHTAKVFHVKWSPLREGILCSGSDDGTVRIWDYTQDACINILNGHTAPVRGLMWNTEIPYLLISGSWDYTIKVWDTREGTCVDTVYDHGADVYGLTCHPSRPFTMASCSRDSTVRLWSLTALVTPVQINILADRSWEEIIGNTDYAIEPGTPPLLCGKVSRDIRQEIEKLTANSQVKKLRWFSECLSPPGGSDNLWNLVAVIKGQDDSLLPQNYCKGIMHLKHLIKFRTSEAQELTTVKMSKFGGGIGVPAKEERLKEAAEIHLRLGQIQRYCELMVELGEWDKALSIAPGVSVKYWKKLMQRRADQLIQEDKDDVIPYCIAIGDVKKLVHFFMSRGQLKEALLVAQAACEGNMQPLHVSVPKGASYSDDIYKEDFNELLHKVSKELAEWYFQDGRAVLAACCHLAIDNIELAMAYLIRGNELELAVCVGTVLGESAAPATHYALELLARKCMMISVWNLAADLLLMIPDNELHLIKLCAFYPGCTEEINDLHDKCKLPTVEECMQLAETARADDNIFETVKYYLLSQEPEKALPIGISFVKEYISSSDWTLDTIYPVLDLLSYIRTEKLLLHTCTEARNELLILCGYIGALLAIRRQYQSIVPALYEYTSQLLKRREVSVPLKIEYLSEELDAWRACTQSTNRSLEDSPYTPPSDSQRMIYATLLKRLKEESLKGIIGPDYVTGSNLPSHSDIHISCLTGLKIQGPVFFLEDGKSAISLNDALMWAKVNPFSPLGTGIRLNPF

SEQ ID NO: 69809 - protein, 1182 aa, Homo sapiens
MITVSNQEGDTIRQTQVRSEPSNMQFFLMKMDDRTSAAESMISVVLGKKTLFFLNLNEPDNPADLEFQQDFGNIVCYNWYGDGRIMIGFSCGHFVVISTHTGELGQEIFQARNHKDNLTSIAVSQTLNKVATCGDNCIKIQDLVDLKDMYVILNLDEENKGLGTLSWTDDGQLLALSTQRGSLHVFLTKLPILGDACSTRIAYLTSLLEVTVANPVEGELPITVSVDVEPNFVAVGLYHLAVGMNNRAWFYVLGENAVKKLKDMEYLGTVASICLHSDYAAALFEGKVQLHLIESEILDAQEERETRLFPAVDDKCRILCHALTSDFLIYGTDTGVVQYFYIEDWQFVNDYRHPVSVKKIFPDPNGTRLVFIDEKSDGFVYCPVNDATYEIPDFSPTIKGVLWENWPMDKGVFIAYDDDKVYTYVFHKDTIQGAKVILAGSTKVPFAHKPLLLYNGELTCQTQSGKVNNIYLSTHGFLSNLKDTGPDELRPMLAQNLMLKRFSDAWEMCRILNDEAAWNELARACLHHMEVEFAIRVYRRIGNVGIVMSLEQIKGIEDYNLLAGHLAMFTNDYNLAQDLYLASSCPIAALEMRRDLQHWDSALQLAKHLAPDQIPFISKEYAIQLEFAGDYVNALAHYEKGITGDNKEHDEACLAGVAQMSIRMGDIRRGVNQALKHPSRVLKRDCGAILENMKQFSEAAQLYEKGLYYDKAASVYIRSKNWAKVGDLLPHVSSPKIHLQYAKAKEADGRYKEAVVAYENAKQWQSVIRIYLDHLNNPEKAVNIVRETQSLDGAKMVARFFLQLGDYGSAIQFLVMSKCNNEAFTLAQQHNKMEIYADIIGSEDTTNEDYQSIALYFEGEKRYLQAGKFFLLCGQYSRALKHFLKCPSSEDNVAIEMAIETVGQAKDELLTNQLIDHLLGENDGMPKDAKYLFRLYMALKQYREAAQTAIIIAREEQSAGNYRNAHDVLFSMYAELKSQKIKIPSEMATNLMILHSYILVKIHVKNGDHMKGARMLIRVANNISKFPSHIVPILTSTVIECHRAGLKNSAFSFAAMLMRPEYRSKIDAKYKKKIEGMVRRPDISEIEEATTPCPFCKFLLPECELLCPGCKNSIPYCIATGRHMLKDDWTVCPHCDFPALYSELKIMLNTESTCPMCSERLNAAQLKKISDCTQYLRTEEEL

SEQ ID NO: 69810 - protein, 1342 aa, Homo sapiens
MKRIFSLLEKTWLGAPIQFAWQKTSGNYLAVTGADYIVKIFDRHGQKRSEINLPGNCVAMDWDKDGDVLAVIAEKSSCIYLWDANTNKTSQLDNGMRDQMSFLLWSKVGSFLAVGTVKGNLLIYNHQTSRKIPVLGKHTKRITCGCWNAENLLALGGEDKMITVSNQEGDTIRQTQVRSEPSNMQFFLMKMDDRTSAAESMISVVLGKKTLFFLNLNEPDNPADLEFQQDFGNIVCYNWYGDGRIMIGFSCGHFVVISTHTGELGQEIFQARNHKDNLTSIAVSQTLNKVATCGDNCIKIQDLVDLKDMYVILNLDEENKGLGTLSWTDDGQLLALSTQRGSLHVFLTKLPILGDACSTRIAYLTSLLEVTVANPVEGELPITVSVDVEPNFVAVGLYHLAVGMNNRAWFYVLGENAVKKLKDMEYLGTVASICLHSDYAAALFEGKVQLHLIESEILDAQEERETRLFPAVDDKCRILCHALTSDFLIYGTDTGVVQYFYIEDWQFVNDYRHPVSVKKIFPDPNGTRLVFIDEKSDGFVYCPVNDATYEIPDFSPTIKGVLWENWPMDKGVFIAYDDDKVYTYVFHKDTIQGAKVILAGSTKVPFAHKPLLLYNGELTCQTQSGKVNNIYLSTHGFLSNLKDTGPDELRPMLAQNLMLKRFSDAWEMCRILNDEAAWNELARACLHHMEVEFAIRVYRRIGNVGIVMSLEQIKGIEDYNLLAGHLAMFTNDYNLAQDLYLASSCPIAALEMRRDLQHWDSALQLAKHLAPDQIPFISKEYAIQLEFAGDYVNALAHYEKGITGDNKEHDEACLAGVAQMSIRMGDIRRGVNQALKHPSRVLKRDCGAILENMKQFSEAAQLYEKGLYYDKAASVYIRSKNWAKVGDLLPHVSSPKIHLQYAKAKEADGRYKEAVVAYENAKQWQSVIRIYLDHLNNPEKAVNIVRETQSLDGAKMVARFFLQLGDYGSAIQFLVMSKCNNEAFTLAQQHNKMEIYADIIGSEDTTNEDYQSIALYFEGEKRYLQAGKFFLLCGQYSRALKHFLKCPSSEDNVAIEMAIETVGQAKDELLTNQLIDHLLGENDGMPKDAKYLFRLYMALKQYREAAQTAIIIAREEQSAGNYRNAHDVLFSMYAELKSQKIKIPSEMATNLMILHSYILVKIHVKNGDHMKGARMLIRVANNISKFPSHIVPILTSTVIECHRAGLKNSAFSFAAMLMRPEYRSKIDAKYKKKIEGMVRRPDISEIEEATTPCPFCKFLLPECELLCPGCKNSIPYCIATGRHMLKDDWTVCPHCDFPALYSELKIMLNTESTCPMCSERLNAAQLKKISDCTQYLRTEEEL

SEQ ID NO: 69811 - protein, 480 aa, Homo sapiens
KRIFSLLEKTWLGAPIQFAWQKTSGNYLAVTGADYIVKIFDRHGQKRSEINLPGNCVAMDWDKDGDVLAVIAEKSSCIYLWDANTNKTSQLDNGMRDQMSFLLWSKVGSFLAVGTVKGNLLIYNHQTSRKIPVLGKHTKRITCGCWNAENLLALGGEDKMITVSNQEGDTIRQTQVRSEPSNMQFFLMKMDDRTSAAESMISVVLGKKTLFFLNLNEPDNPADLEFQQDFGNIVCYNWYGDGRIMIGFSCGHFVVISTHTGELGQEIFQARNHKDNLTSIAVSQTLNKVATCGDNCIKIQDLVDLKDMYVILNLDEENKGLGTLSWTDDGQLLALSTQRGSLHVFLTKLPILGDACSTRIAYLTSLLEVTVANPVEGELPITVSVDVEPNFVAVGLYHLAVGMNNRAWFYVLGENAVKKLKDMEYLGTVASICLHSDYAAALFEGKVQLHLKAKSWMLKKNVRLGFSQQWMISAVSYAMP

SEQ ID NO: 69812 - protein, 481 aa, Homo sapiens
MKRIFSLLEKTWLGAPIQFAWQKTSGNYLAVTGADYIVKIFDRHGQKRSEINLPGNCVAMDWDKDGDVLAVIAEKSSCIYLWDANTNKTSQLDNGMRDQMSFLLWSKVGSFLAVGTVKGNLLIYNHQTSRKIPVLGKHTKRITCGCWNAENLLALGGEDKMITVSNQEGDTIRQTQVRSEPSNMQFFLMKMDDRTSAAESMISVVLGKKTLFFLNLNEPDNPADLEFQQDFGNIVCYNWYGDGRIMIGFSCGHFVVISTHTGELGQEIFQARNHKDNLTSIAVSQTLNKVATCGDNCIKIQDLVDLKDMYVILNLDEENKGLGTLSWTDDGQLLALSTQRGSLHVFLTKLPILGDACSTRIAYLTSLLEVTVANPVEGELPITVSVDVEPNFVAVGLYHLAVGMNNRAWFYVLGENAVKKLKDMEYLGTVASICLHSDYAAALFEGKVQLHLKAKSWMLKKNVRLGFSQQWMISAVSYAMP

SEQ ID NO: 69813 - protein, 943 aa, Homo sapiens
MGLTKQYLRYVASAVFGVIGSQKGNIVFVTLRGEKGRYVAVPACEHVFIWDLRKGEKILILQGLKQEVTCLCPSPDGLHLAVGYEDGSIRIFSLLSGEGNVTFNGHKAAITTLKYDQLGGRLASGSKDTDIIVWDVINESGLYRLKGHKDAITQALFLREKNLLVTSGKDTMVKWWDLDTQHCFKTMVGHRTEVWGLVLLSEEKRLITGASDSELRVWDIAYLQEIEDPEEPDPKKIKGSSPGIQDTLEAEDGAFETDEAPEDRILSCRKAGSIMREGRDRVVNLAVDKTGRILACHGTDSVLELFCILSKKEIQKKMDKKMKKARKKAKLHSSKGEEEDPEVNVEMSLQDEIQRVTNIKTSAKIKSFDLIHSPHGELKAVFLLQNNLVELYSLNPSLPTPQPVRTSRITIGGHRSDVRTLSFSSDNIAVLSAAADSIKIWNRSTLQCIRTMTCEYALCSFFVPGDRQVVIGTKTGKLQLYDLASGNLLETIDAHDGALWSMSLSPDQRGFVTGGADKSVKFWDFELVKDENSTQKRLSVKQTRTLQLDEDVLCVSYSPNQKLLAVSLLDCTVKIFYVDTLKFFLSLYGHKLPVICMDISHDGALIATGSADRNVKIWGLDFGDCHKSLFAHDDSVMYLQFVPKSHLFFTAGKDHKIKQWDADKFEHIQTLEGHHQEIWCLAVSPSGDYVVSSSHDKSLRLWERTREPLILEEEREMEREAEYEESVAKEDQPAVPGETQGDSYFTGKKTIETVKAAERIMEAIELYREETAKMKEHKAICKAAGKEVPLPSNPILMAYGSISPSAYVLEIFKGIKSSELEESLLVLPFSYVPDILKLFNEFIQLGSDVELICRCLFFLLRIHFGQITSNQMLVPVIEKLRETTISKVSQVRDVIGFNMAGLDYLKRECEAKSEVMFFADATSHLEEKKRKRKKREKLILTLT

SEQ ID NO: 69814 - protein, 40 aa, Homo sapiens
MGLTKQYLRYVASAVFGVIGSQKGLASQASSSFVFFATEF

SEQ ID NO: 69815 - protein, 536 aa, Homo sapiens
MATRAQPGPLSQAGSAGVAALATVGVASGPGPGRPGPLQDETLGVASVPSQWRAVQGIRWETKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGGLYSGEVLVWDLSRLEDPLLWRTGLTDDTHTDPVSQVVWLPEPGHSHRFQVLSVATDGKVLLWQGIGVGQLQLTEGFALVMQQLPRSTKLKKHPRGETEVGATAVAFSSFDPRLFILGTEGGFPLKCSLAAGEAALTRMPSSVPLRAPAQFTFSPHGGPIYSVSCSPFHRNLFLSAGTDGHVHLYSMLQAPPLTSLQLSLKYLFAVRWSPVRPLVFAAASGKGDVQLFDLQKSSQKPTVLIKQTQDESPVYCLEFNSQQTQLLAAGDAQGTVKVWQLSTEFTEQGPREAEDLDCLAAEVAA

SEQ ID NO: 69816 - protein, 139 aa, Homo sapiens
AGVAALATVGVASGPGPGRPGPLQDETLGVASVPSQWRAVQGIRWETKSCQTASIATASASAQARNHVDAQVQTEAPVPVSVQPPSQYDIPRLAAFLRRVEAMVIRELNKNWQSHAFDGFEVNWTEQQQMAGPWGLEHA

SEQ ID NO: 69817 - protein, 272 aa, Homo sapiens
LSQAGSAGVAALATVGVASGPGPGRPGPLQDETLGVASVPSQWRAVQGIRWETKSCQTASIATASASAQARNHVDAQVQTEAPVPVSVQPPSQYDIPRLAAFLRRVEAMVIRELNKNWQSHAFDGFEVNWTEQQQMVSCLYTLGYPPAQAQGLHVTSISWNSTGSVVACAYGRLDHGDWSTLKSFVCAWNLDRRDLRPQQPSAVVEVPSAVLCLAFHPTQPSHVAGELPAVSASSPLRTQLPALQRAQGSFPWALWPGDRKAGPDPLSLEPR

SEQ ID NO: 69818 - protein, 1170 aa, Homo sapiens
MFFYLSKKISIPNNVKLQCVSWNKEQGFIACGGEDGLLKVLKLETQTDDAKLRGLAAPSNLSMNQTLEGHSGSVQVVTWNEQYQKLTTSDENGLIIVWMLYKGSWIEEMINNRNKSVVRSMSWNADGQKICIVYEDGAVIVGSVDGNRIWGKDLKGIQLSHVTWSADSKVLLFGMANGEIHIYDNQGNFMIKMKLSCLVNVTGAISIAGIHWYHGTEGYVEPDCPCLAVCFDNGRCQIMRHENDQNPVLIDTGMYVVGIQWNHMGSVLAVAGFQKAAMQDKDVNIVQFYTPFGEHLGTLKVPGKEISALSWEGGGLKIALAVDSFIYFANIRPNYKWGYCSNTVVYAYTRPDRPEYCVVFWDTKNNEKYVKYVKGLISITTCGDFCILATKADENHPQFVLVLCNSIGTPLDPKYIDIVPLFVAMTKTHVIAASKEAFYTWQYRVAKKLTALEINQITRSRKEGRERIYHVDDTPSGSMDGVLDYSKTIQGTRDPICAITASDKILIVGRESGTIQRYSLPNVGLIQKYSLNCRAYQLSLNCNSSRLAIIDISGVLTFFDLDARVTDSTGQQVVGELLKLERRDVWDMKWAKDNPDLFAMMEKTRMYVFRNLDPEEPIQTSGYICNFEDLEIKSVLLDEILKDPEHPNKDYLINFEIRSLRDSRALIEKVGIKDASQFIEDNPHPRLWRLLAEAALQKLDLYTAEQAFVRCKDYQGIKFVKRLGKLLSESMKQAEVVGYFGRFEEAERTYLEMDRRDLAIGLRLKLGDWFRVLQLLKTGSGDADDSLLEQANNAIGDYFADRQKWLNAVQYYVQGRNQERLAECYYMLEDYEGLENLAISLPENHKLLPEIAQMFVRVGMCEQAVTAFLKCSQPKAAVDTCVHLNQWNKAVELAKNHSMKEIGSLLARYASHLLEKNKTLDAIELYRKANYFFDAAKLMFKIADEEAKKGSKPLRVKKLYVLSALLIEQYHEQMKNAQRGKVKGKSSEATSALAGLLEEEVLSTTDRFTDNAWRGAEAYHFFILAQRQLYEGCVDTALKTALHLKDYEDIIPPVEIYSLLALCACASRAFGTCSKAFIKLKSLETLSSEQKQQYEDLALEIFTKHTSKDNRKPELDSLMEGGEGKLPTCVATGSPITEYQFWMCSVCKHGVLAQEISHYSFCPLCHSPVG

SEQ ID NO: 69819 - protein, 1181 aa, Homo sapiens
MFFYLSKKISIPNNVKLQCVSWNKEQGFIACGGEDGLLKVLKLETQTDDAKLRGLAAPSNLSMNQTLEGHSGSVQVVTWNEQYQKLTTSDENGLIIVWMLYKGSWIEEMINNRNKSVVRSMSWNADGQKICIVYEDGAVIVGSVDGNRIWGKDLKGIQLSHVTWSADSKVLLFGMANGEIHIYDNQGNFMIKMKLSCLVNVTGAISIAGIHWYHGTEGYVEPDCPCLAVCFDNGRCQIMRHENDQNPVLIDTGMYVVGIQWNHMGSVLAVAGFQKAAMQDKDVNIVQFYTPFGEHLGTLKVPGKEISALSWEGGGLKIALAVDSFIYFANIRPNYKWGYCSNTVVYAYTRPDRPEYCVVFWDTKNNEKYVKYVKGLISITTCGDFCILATKADENHPQEENEMETFGATFVLVLCNSIGTPLDPKYIDIVPLFVAMTKTHVIAASKEAFYTWQYRVAKKLTALEINQITRSRKEGRERIYHVDDTPSGSMDGVLDYSKTIQGTRDPICAITASDKILIVGRESGTIQRYSLPNVGLIQKYSLNCRAYQLSLNCNSSRLAIIDISGVLTFFDLDARVTDSTGQQVVGELLKLERRDVWDMKWAKDNPDLFAMMEKTRMYVFRNLDPEEPIQTSGYICNFEDLEIKSVLLDEILKDPEHPNKDYLINFEIRSLRDSRALIEKVGIKDASQFIEDNPHPRLWRLLAEAALQKLDLYTAEQAFVRCKDYQGIKFVKRLGKLLSESMKQAEVVGYFGRFEEAERTYLEMDRRDLAIGLRLKLGDWFRVLQLLKTGSGDADDSLLEQANNAIGDYFADRQKWLNAVQYYVQGRNQERLAECYYMLEDYEGLENLAISLPENHKLLPEIAQMFVRVGMCEQAVTAFLKCSQPKAAVDTCVHLNQWNKAVELAKNHSMKEIGSLLARYASHLLEKNKTLDAIELYRKANYFFDAAKLMFKIADEEAKKGSKPLRVKKLYVLSALLIEQYHEQMKNAQRGKVKGKSSEATSALAGLLEEEVLSTTDRFTDNAWRGAEAYHFFILAQRQLYEGCVDTALKTALHLKDYEDIIPPVEIYSLLALCACASRAFGTCSKAFIKLKSLETLSSEQKQQYEDLALEIFTKHTSKDNRKPELDSLMEGGEGKLPTCVATGSPITEYQFWMCSVCKHGVLAQEISHYSFCPLCHSPVG

SEQ ID NO: 69820 - protein, 559 aa, Homo sapiens
MTKTHVIAASKEAFYTWQYRVAKKLTALEINQITRSRKEGRERIYHVDDTPSGSMDGVLDYSKTIQGTRDPICAITASDKILIVGRESGTIQRYSLPNVGLIQKYSLNCRAYQLSLNCNSSRLAIIDISGVLTFFDLDARVTDSTGQQVVGELLKLERRDVWDMKWAKDNPDLFAMMEKTRMYVFRNLDPEEPIQTSGYICNFEDLEIKSVLLDEILKDPEHPNKDYLINFEIRSLRDSRALIEKVGIKDASQFIEDNPHPRLWRLLAEAALQKLDLYTAEQAFVRCKDYQGIKFVKRLGKLLSESMKQAEVVGYFGRFEEAERTYLEMDRRDLAIGLRLKLGDWFRVLQLLKTGSGDADDSLLEQANNAIGDYFADRQKWLNAVQYYVQGRNQERLAECYYMLEDYEGLENLAISLPENHKLLPIADEEAKKGSKPLRVKKLYVLSALLIEQYHEQMKNAQRGKVKGKSSEATSALAGLLEEEVLSTTDRFTDNAWRGAEAYHFFILAQRQLYEGCVDTALKTVEKGNCQHALPQEAQSLSINSGCAVYANTVSLLRK

SEQ ID NO: 69821 - protein, 951 aa, Homo sapiens
MCCTEGSLRKRDSQRAPEAVLCLQLWQRTVPLDTLKGLGTCFPSGPELRGAGIAAAMERASERRTASALFAGFRALGLFSNDIPHVVRFSALKRRFYVTTCVGKSFHTYDVQKLSLVAVSNSVPQDICCMAADGRLVFAAYGNVFSAFARNKEIVHTFKGHKAEIHFLQPFGDHIISVDTDGILIIWHIYSEEEYLQLTFDKSVFKISAILHPSTYLNKILLGSEQGSLQLWNVKSNKLLYTFPGWKVGVTALQQAPAVDVVAIGLMSGQVIIHNIKFNETLMKFRQDWGPITSISFRTDGHPVMAAGSPCGHIGLWDLEDKKLINQMRNAHSTAIAGLTFLHREPLLVTNGADNALRIWIFDGPTGEGRLLRFRMGHSAPLTNIRYYGQNGQQILSASQDGTLQSFSTVHEKFNKSLGHGLINKKRVKRKGLQNTMSVRLPPITKFAAEEARESDWDGIIACHQGKLSCSTWNYQKSTIGAYFLKPKELKKDDITATAVDITSCGNFAVIGLSSGTVDVYNMQSGIHRGSFGKDQAHKGSVRGVAVDGLNQLTVTTGSEGLLKFWNFKNKILIHSVSLSSSPNIMLLHRDSGILGLALDDFSISVLDIETRKIVREFSGHQGQINDMAFSPDGRWLISAAMDCSIRTWDLPSGCLIDCFLLDSAPLNVSMSPTGDFLATSHVDHLGIYLWSNISLYSVVSLRPLPADYVPSIVMLPGTCQTQDVEVSEETVEPSDELIEYDSPEQLNEQLVTLSLLPESRWKNLLNLDVIKKKNKPKEPPKVPKSAPFFIPTIPGLVPRYAAPEQNNDPQQSKVVNLGVLAQKSDFCLKLEEGLVNNKYDTALNLLKESGPSGIETELRSLSPDCGGSIEVMQSFLKMIGMMLDRKRDFELAQAYLALFLKLHLKMLPSEPVLLEEITNLSSQVEENWTHLQSLFNQSMCILNYLKSALL

SEQ ID NO: 69822 - protein, 951 aa, Homo sapiens; identical to SEQ ID NO: 69821

SEQ ID NO: 69823 - protein, 412 aa, Homo sapiens
MAGSVGLALCGQTLVVRGGSRFLATSIASSDDDSLFIYDCSAAEKKSQENKGEDAPLDQGSGAILASTFSKSGSYFALTDDSKRLILFRTKPWQCLSVRTVARRCTALTFIASEEKVLVADKSGDVYSFSVLEPHGCGRLELGHLSMLLDVAVSPDDRFILTADRDEKIRVSWAAAPHSIESFCLGHTEFVSRISVVPTQPGLLLSSSGDGTLRLWEYRSGRQLHCCHLASLQELVDPQAPQKFAASRIAFWCQENCVALLCDGTPVVYIFQLDARRQQLVYRQQLAFQHQVWDVAFEETQGLWVLQDCQEAPLVLYRPVGDQWQSVPESTVLKKVSGVLRGNWAMLEGSAGADASFSSLYKATFDNVTSYLKKKEERLQQQLEKKQRRRSPPPGPDGHAKKMRPGEATLSC

SEQ ID NO: 69824 - protein, 412 aa, Homo sapiens; identical to SEQ ID NO: 69823

SEQ ID NO: 69825 - protein, 677 aa, Homo sapiens
MAAHHRQNTAGRRKVQVSYVIRDEVEKYNRNGVNALQLDPALNRLFTAGRDSIIRIWSVNQHKQDPYIASMEHHTDWVNDIVLCCNGKTLISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLNRDGTQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWTLKGIHNFRASGDYDNDCTNPITPLCTQPDQVIKGGASIIQCHILNDKRHILTKDTNNNVAYWDVLKACKVEDLGKVDFEDEIKKRFKMVYVPNWFSVDLKTGMLTITLDESDCFAAWVSAKDAGFSSPDGSDPKLNLGGLLLQALLEYWPRTHVNPMDEEENEVNHVNGEQENRVQKGNGYFQVPPHTPVIFGEAGGRTLFRLLCRDSGGETESMLLNETVPQWVIDITVDKNMPKFNKIPFYLQPHASSGAKTLKKDRLSASDMLQVRKVMEHVYEKIINLDNESQTTSSSNNEKPGEQEKEEDIAVLAEEKIELLCQDQVLDPNMDLRTVKHFIWKSGGDLTLHYRQKST

SEQ ID NO: 69826 - protein, 595 aa, Homo sapiens
MECQSAQVISASSDTTVKVWNAHKGFCMSTLRTHKDYVKALAYAKDKELVASAGLDRQIFLWDVNTLTALTASNNTVTTSSLSGNKDSIYSLAMNQLGTIIVSGSTEKVLRVWDPRTCAKLMKLKGHTDNVKALLLNRDGTQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWTLKGIHNFRASGDYDNDCTNPITPLCTQPDQVIKGGASIIQCHILNDKRHILTKDTNNNVAYWDVLKACKVEDLGKVDFEDEIKKRFKMVYVPNWFSVDLKTGMLTITLDESDCFAAWVSAKDAGFSSPDGSDPKLNLGGLLLQALLEYWPRTHVNPMDEEENEVNHVNGEQENRVQKGNGYFQVPPHTPVIFGEAGGRTLFRLLCRDSGGETESMLLNETVPQWVIDITVDKNMPKFNKIPFYLQPHASSGAKTLKKDRLSASDMLQVRKVMEHVYEKIINLDNESQTTSSSNNEKPGEQEKEEDIAVLAEEKIELLCQDQVLDPNMDLRTVKHFIWKSGGDLTLHYRQKST

SEQ ID NO: 69827 - protein, 121 aa, Homo sapiens
MPKFNKIPFYLQPHASSGAKTLKKDRLSASDMLQVRKVMEHVYEKIINLDNESQTTSSSNNEKPGEQEKEEDIAVLAEEKIELLCQDQVRVLDPNMDLRTVKHFIWKSGGDLTLHYRQKST

SEQ ID NO: 69828 - protein, 402 aa, Homo sapiens
MAAHHRQNTAGRRKVQCLSGSSDGTIRLWSLGQQRCIATYRVHDEGVWALQVNDAFTHVYSGGRDRKIYCTDLRNPDIRVLICEEKAPVLKMELDRSADPPPAIWVATTKSTVNKWACKVEDLGKVDFEDEIKKRFKMVYVPNWFSVDLKTGMLTITLDESDCFAAWVSAKDAGFSSPDGSDPKLNLGGLLLQALLEYWPRTHVNPMDEEENEVNHVNGEQENRVQKGNGYFQVPPHTPVIFGEAGGRTLFRLLCRDSGGETESMLLNETVPQWVIDITVDKNMPKFNKIPFYLQPHASSGAKTLKKDRLSASDMLQVRKVMEHVYEKIINLDNESQTTSSSNNEKPGEQEKEEDIAVLAEEKIELLCQDQVLDPNMDLRTVKHFIWKSGGDLTLHYRQKST

SEQ ID NO: 69829 - protein, 216 aa, Homo sapiens
MDALEDYVWPRATSELILLPVTGLECVGDRLLAGEGPDVLVYSLDFGGHLRMIKRVQNLLGHYLIHGFRVRPEPNGDLDLEAMVAVFGSKGLRVVKISWGQGHFWELWRSGLWNMSDWIWDARWLEGNIALALGHNSVVLYDPVVGCILQEVPCTDRCTLSSACLIGDAWKELTIVAGAVSNQLLVWYPATAFTLYLSARPTPFCCVLTPRMCTRL

SEQ ID NO: 69830 - protein, 1151 aa, Homo sapiens
MGSAARWEGSFSREFSSLLSRGCLSTSRIDMDALEDYVWPRATSELILLPVTGLECVGDRLLAGEGPDVLVYSLDFGGHLRMIKRVQNLLGHYLIHGFRVRPEPNGDLDLEAMVAVFGSKGLRVVKISWGQGHFWELWRSGLWNMSDWIWDARWLEGNIALALGHNSVVLYDPVVGCILQEVPCTDRCTLSSACLIGDAWKELTIVAGAVSNQLLVWYPATALADNKPVAPDRRISGHVGIIFSMSYLESKGLLATASEDRSVRIWKVGDLRVPGGRVQNIGHCFGHSARVWQVKLLENYLISAGEDCVCLVWSHEGEILQAFRGHQGRGIRAIAAHERQAWVITGGDDSGIRLWHLVGRGYRGLGVSALCFKSRSRPGTLKAVTLAGSWRLLAVTDTGALYLYDVEVKCWEQLLEDKHFQSYCLLEAAPGPEGFGLCAMANGEGRVKVVPINTPTAAVDQTLFPGKVHSLSWALRGYEELLLLASGPGGVVACLEISAAPSGKAIFVKERCRYLLPPSKQRWHTCSAFLPPGDFLVCGDRRGSVLLFPSRPGLLKDPGVGGKARAGAGAPVVGSGSSGGGNAFTGLGPVSTLPSLHGKQGVTSVTCHGGYVYTTGRDGAYYQLFVRDGQLQPVLRQKSCRGMNWLAGLRIVPDGSMVILGFHANEFVVWNPRSHEKLHIVNCGGGHRSWAFSDTEAAMAFAYLKDGDVMLYRALGGCTRPHVILREGLHGREITCVKRVGTITLGPEYGVPSFMQPDDLEPGSEGPDLTDIVITCSEDTTVCVLALPTTTGSAHALTAVCNHISSVRAVAVWGIGTPGGPQDPQPGLTAHVVSAGGRAEMHCFSIMVTPDPSTPSRLACHVMHLSSHRLDEYWDRQRNRHRMVKVDPETRYMSLAVCELDQPGLGPLVAAACSDGAVRLFLLQDSGRILQLLAETFHHKRCVLKVHSFTHEAPNQRRRLLLCSAATDGSLAFWDLTTMLDHDSTVLEPPVDPGLPYRLGTPSLTLQAHSCGINSLHTLPTREGHHLVASGSEDGSLHVFVLAVEMLQLEEAVGEAGLVPQLRVLEEYSVPCAHAAHVTGLKILSPSIMVSASIDQRLTFWRLGHGEPTFMNSTVFHVPDVADMDCWPVSPEFGHRCALGGQGLEVYNWYD

SEQ ID NO: 69831 - protein, 1070 aa, Homo sapiens
MIKRVQNLLGHYLIHGFRVRPEPNGDLDLEAMVAVFGSKGLRVVKISWGQGHFWELWRSGLWNMSDWIWDARWLEGNIALALGHNSVVLYDPVVGCILQEVPCTDRCTLSSACLIGDAWKELTIVAGAVSNQLLVWYPATALADNKPVAPDRRISGHVGIIFSMSYLESKGLLATASEDRSVRIWKVGDLRVPGGRVQNIGHCFGHSARVWQVKLLENYLISAGEDCVCLVWSHEGEILQAFRGHQGRGIRAIAAHERQAWVITGGDDSGIRLWHLVGRGYRGLGVSALCFKSRSRPGTLKAVTLAGSWRLLAVTDTGALYLYDVEVKCWEQLLEDKHFQSYCLLEAAPGPEGFGLCAMANGEGRVKVVPINTPTAAVDQTLFPGKVHSLSWALRGYEELLLLASGPGGVVACLEISAAPSGKAIFVKERCRYLLPPSKQRWHTCSAFLPPGDFLVCGDRRGSVLLFPSRPGLLKDPGVGGKARAGAGAPVVGSGSSGGGNAFTGLGPVSTLPSLHGKQGVTSVTCHGGYVYTTGRDGAYYQLFVRDGQLQPVLRQKSCRGMNWLAGLRIVPDGSMVILGFHANEFVVWNPRSHEKLHIVNCGGGHRSWAFSDTEAAMAFAYLKDGDVMLYRALGGCTRPHVILREGLHGREITCVKRVGTITLGPEYGVPSFMQPDDLEPGSEGPDLTDIVITCSEDTTVCVLALPTTTGSAHALTAVCNHISSVRAVAVWGIGTPGGPQDPQPGLTAHVVSAGGRAEMHCFSIMVTPDPSTPSRLACHVMHLSSHRLDEYWDRQRNRHRMVKVDPETRYMSLAVCELDQPGLGPLVAAACSDGAVRLFLLQDSGRILQLLAETFHHKRCVLKVHSFTHEAPNQRRRLLLCSAATDGSLAFWDLTTMLDHDSTVLEPPVDPGLPYRLGTPSLTLQAHSCGINSLHTLPTREGHHLVASGSEDGSLHVFVLAVEMLQLEEAVGEAGLVPQLRVLEEYSVPCAHAAHVTGLKILSPSIMVSASIDQRLTFWRLGHGEPTFMNSTVFHVPDVADMDCWPVSPEFGHRCALGGQGLEVYNWYD

SEQ ID NO: 69832 - protein, 1518 aa, Homo sapiens
MAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPIHQWLSCVYKDHSIYIWDVKDINRVGKVWSELFHSSYVWNVEVYPEFEDQRACLPSGSFLTCSSDNTIRFWNLDSSPDSHWQKNIFSNTLLKVVYVENDIQHLQDMSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGLAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRSISLGDSEGPIVATLAQPLRRPSSVGELASLGQELQAITTATTPSLDSEGQEPALRSWGNHEARANLRLTLSSACDGLLQPPVDTQPGVTVPAVSFPAPSPVEESALRLHGSAFRPSLPAPESPGLPAHPSNPQLPEARPGIPGGTASLLEPTSGALGLLQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 69833 - protein, 414 aa, Homo sapiens
MAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPIHQWLSCVYKDHSIYIWDVKDINRVGKVWSELFHSSYVWNVEALS

SEQ ID NO: 69834 - protein, 483 aa, Homo sapiens
MAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPIHQWLSCVYKDHSIYIWDVKDINRVGKVWSELFHSSYVWNVEVYPEFEDQRACLPSGSFLTCSSDNTIRFWNLDSSPDSHWQKNIFSNLAPALQMCGRGHSRQPNTPSPGEIAS

SEQ ID NO: 69835 - protein, 1523 aa, Homo sapiens
MAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPIHQWLSCVYKDHSIYIWDVKDINRVGKVWSELFHSSYVWNVEVYPEFEDQRACLPSGSFLTCSSDNTIRFWNLDSSPDSHWQKNIFSNTLLKVVYVENDIQHLQDMSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGLAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRELFPAALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRSISLGDSEGPIVATLAQPLRRPSSVGELASLGQELQAITTATTPSLDSEGQEPALRSWGNHEARANLRLTLSSACDGLLQPPVDTQPGVTVPAVSFPAPSPVEESALRLHGSAFRPSLPAPESPGLPAHPSNPQLPEARPGIPGGTASLLEPTSGALGLLQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 69836 - protein, 433 aa, Homo sapiens
GGYARNDAGEKLPSVMAGVPARRGQSSPPPAPPICLRRRTRLSTASEETVQNRVSLEKVLGITAQNSSGLTCDPGTGHVAYLAGMWRMGPASESCGEDSIAPSLSRTVPGMYCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPIHQWLSCVYKDHSIYIWDVKDINRVGKVWSELFHSSYVWNVE

SEQ ID NO: 69837 - protein, 698 aa, Homo sapiens
MSAVVAQTLHVFGLRSHVANNIFYFDEQIIIFPSGNHCVKYNVDQKWQKFIPGSEKSQGMLALSISPNRRYLAISETVQEKPAITIYELSSIPCRKRKVLNNFDFQVQKFISMAFSPDSKYLLAQTSPPESNLVYWLWEKQKVMAIVRIDTQNNPVYQVSFSPQDNTQVCVTGNGMFKLLRFAEGTLKQTSFQRGEPQNYLAHTWVADDKIVVGTDTGKLFLFESGDQRWETSIMVKEPTNGSKSLDVIQESESLIEFPPVSSPLPSYEQMVAASSHSQMSMPQVFAIAAYSKGFACSAGPGRVLLFEKMEEKDFYRESREIRIPVDPQSNDPSQSDKQDVLCLCFSPSEETLVASTSKNQLYSITMSLTEISKGEPAHFEYLMYPLHSAPITGLATCIRKPLIATCSLDRSIRLWNYETNTLELFKEYQEEAYSISLHPSGHFIVVGFADKLRLMNLLIDDIRSFKEYSVRGCGECSFSNGGHLFAAVNGNVIHVYTTTSLENISSLKGHTGKIRSIVWNADDSKLISGGTDGAVYEWNLSTGKRETECVLKSCSYNCVTVSPDAKIIFAVGSDHTLKEIADSLILREISAFDVTYTAIVISHSGRMMFVGTSVGTIRAMKYPLPLQKEFNEYQAHAGPITKVSRALSPGTQSHTCLLRALFIPSTSQCLFSLLLLSYLFIHHSLNHHLLTMNILFV

SEQ ID NO: 69838 - protein, 166 aa, Homo sapiens
MSAVVAQTLHVFGLRSHVANNIFYFDEQIIIFPSGNHCVKYNVDQKWQKFIPGSEKSQGMLALSISPNRRYLAISETVQEKPAITIYELSSIPCRKRKVLNNFDFQVQKFISMAFSPDSKYLLAQTSPPESNLVYWLWEKQKVMAIVRIDTQNNPVYQVSFSPQDN

SEQ ID NO: 69839 - protein, 1490 aa, Homo sapiens
MAGNSLVLPIVLWGRKAPTHCISAVLLTDDGATIVTGCHDGQICLWDLSVELQINPRALLFGHTASITCLSKACASSDKQYIVSASESGEMCLWDVSDGRCIEFTKLACTHTGIQFYQFSVGNQREGRLLCHGHYPEILVVDATSLEVLYSLVSKISPDWISSMSIIRSHRTQEDTVVALSVTGILKVWIVTSEISDMQDTEPIFEEESKPIYCQNCQSISFCAFTQRSLLVVCSKYWRVFDAGDYSLLCSGPSENGQTWTGGDFVSSDKVIIWTENGQSYIYKLPASCLPASDSFRSDVGKAVENLIPPVQHILLDRKDKELLICPPVTRFFYGCREYFHKLLIQGDSSGRLNIWNISDTADKQGSEEGLAMTTSISLQEAFDKLNPCPAGIIDQLSVIPNSNEPLKVTASVYIPAHGRLVCGREDGSIVIVPATQTAIVQLLQGEHMLRRGWPPHRTLRGHRNKVTCLLYPHQVSARYDQRYLISGGVDFSVIIWDIFSGEMKHIFCVHGGEITQLLVPPENCSARVQHCICSVASDHSVGLLSLREKKCIMLASRHLFPIQVIKWRPSDDYLVVGCSDGSVYVWQMDTGALDRCVMGITAVEILNACDEAVPAAVDSLSHPAVNLKQAMTRRSLAALKNMAHHKLQTLATNLLASEASDKGNLPKYSHNSLMVQAIKTNLTDPDIHVLFFDVEALIIQLLTEEASRPNTALISPENLQKASGSSDKGGSFLTGKRAAVLFQQVKETIKENIKEHLLDDEEEDEEIMRQRREESDPEYRSSKSKPLTLLEYNLTMDTAKLFMSCLHAWGLNEVLDEVCLDRLGMLKPHCTVSFGLLSRGGHMSLMLPGYNQPACKLSHGKTEVGRKLPASEGVGKGTYGVSRAVTTQHLLSIISLANTLMSMTNATFIGDHMKKGPTRPPRPSTPDLSKARGSPPTSSNIVQGQIKQVAAPVVSARSDADHSGSDPPSAPALHTCFLVNEGWSQLAAMHCVMLPDLLGLDKFRPPLLEMLARRWQDRCLEVREAAQALLLAELRRIEQAGRKEAIDAWAPYLPQYIDHVISPGVTSEAAQTITTAPDASGPEAKVQEEEHDLVDDDITTGCLSSVPQMKKISTSYEERRKQATAIVLLGVIGAEFGAEIEPPKLLTRPRSSSQIPEGFGLTSGGSNYSLARHTCKALTFLLLQPPSPKLPPHSTIRRTAIDLIGRGFTVWEPYMDVSAVLMGLLELCADAEKQLANITMGLPLSPAADSARSARHALSLIATARPPAFITTIAKEVHRHTALAANTQSQQNMHTTTLARAKGEILRVIEILIEKMPTDVVDLLVEVMDIIMYCLEGSLVKKKGLQECFPAICRFYMVSYYERNHRIAVGARHGSVALYDIRTGKCQTIHGHKGPITAVAFAPDGRYLATYSNTDSHISFWQMNTSLLGSIGMLNSAPQLRCIKTYQVPPVQPASPGSHNALKLARLIWTSNRNVILMAHDGKEHRFMV

SEQ ID NO: 69840 - protein, 1457 aa, Homo sapiens
MAGNSLVLPIVLWGRKAPTHCISAVLLTDDGATIVTGCHDGQICLWDLSVELQINPRALLFGHTASITCLSKACASSDKQYIVSASESGEMCLWDVSDGRCIEFTKLACTHTGIQFYQFSVGNQREGRLLCHGHYPEILVVDATSLEVLYSLVSKISPDWISSMSIIRSHRTQEDTVVALSVTGILKVWIVTSEISDMQDTEPIFEEESKPIYCQNCQSISFCAFTQRSLLVVCSKYWRVFDAGDYSLLCSGPSENGQTWTGGDFVSSDKVIIWTENGQSYIYKLPASCLPASDSFRSDVGKAVENLIPPVQHILLDRKDKELLICPPVTRFFYGCREYFHKLLIQGDSSGRLNIWNISDTADKQGSEEGLAMTTSISLQEAFDKLNPCPAGIIDQLSVIPNSNEPLKVTASVYIPAHGRLVCGREDGSIVIVPATQTAIVQLLQGEHMLRRGWPPHRTLRGHRNKVTCLLYPHQVSARYDQRYLISGGVDFSVIIWDIFSGEMKHIFCVHGGEITQLLVPPENCSARVQHCICSVASDHSVGLLSLREKKCIMLASRHLFPIQVIKWRPSDDYLVVGCSDGSVYVWQMDTGALDRCVMGITAVEILNACDEAVPAAVDSLSHPAVNLKQAMTRRSLAALKNMAHHKLQTLATNLLASEASDKGNLPKYSHNSLMVQAIKTNLTDPDIHVLFFDVEALIIQLLTEEASRPNTALISPENLQKASGSSDKGGSFLTGKRAAVLFQQVKETIKENIKEHLLDDEEEDEEIMRQRREESDPEYRSSKSKPLTLLEYNLTMDTAKLFMSCLHAWGLNEVLDEVCLDRLGMLKPHCTVSFGLLSRGGHMSLMLPGYNQPACKLSHGKTEVGRKLPASEGVGKGTYGVSRAVTTQHLLSIISLANTLMSMTNATFIGDHMKKGPTRPPRPSTPDLSKARGSPPTSSNIVQGQIKQGWSQLAAMHCVMLPDLLGLDKFRPPLLEMLARRWQDRCLEVREAAQALLLAELRRIEQAGRKEAIDAWAPYLPQYIDHVISPGVTSEAAQTITTAPDASGPEAKVQEEEHDLVDDDITTGCLSSVPQMKKISTSYEERRKQATAIVLLGVIGAEFGAEIEPPKLLTRPRSSSQIPEGFGLTSGGSNYSLARHTCKALTFLLLQPPSPKLPPHSTIRRTAIDLIGRGFTVWEPYMDVSAVLMGLLELCADAEKQLANITMGLPLSPAADSARSARHALSLIATARPPAFITTIAKEVHRHTALAANTQSQQNMHTTTLARAKGEILRVIEILIEKMPTDVVDLLVEVMDIIMYCLEGSLVKKKGLQECFPAICRFYMVSYYERNHRIAVGARHGSVALYDIRTGKCQTIHGHKGPITAVAFAPDGRYLATYSNTDSHISFWQMNTSLLGSIGMLNSAPQLRCIKTYQVPPVQPASPGSHNALKLARLIWTSNRNVILMAHDGKEHRFMV

SEQ ID NO: 69841 - protein, 1457 aa, Homo sapiens; identical to SEQ ID NO: 69840

SEQ ID NO: 69842 - protein, 815 aa, Homo sapiens
MAGNSLVLPIVLWGRKAPTHCISAVLLTDDGATIVTGCHDGQICLWDLSVELQINPRALLFGHTAVLFQQVKETIKENIKEHLLDDEEEDEEIMRQRREESDPEYRSSKSKPLTLLEYNLTMDTAKLFMSCLHAWGLNEVLDEVCLDRLGMLKPHCTVSFGLLSRGGHMSLMLPGYNQPACKLSHGKTEVGRKLPASEGVGKGTYGVSRAVTTQHLLSIISLANTLMSMTNATFIGDHMKKGPTRPPRPSTPDLSKARGSPPTSSNIVQGQIKQVAAPVVSARSDADHSGSDPPSAPALHTCFLVNEGWSQLAAMHCVMLPDLLGLDKFRPPLLEMLARRWQDRCLEVREAAQALLLAELRRIEQAGRKEAIDAWAPYLPQYIDHVISPGVTSEAAQTITTAPDASGPEAKVQEEEHDLVDDDITTGCLSSVPQMKKISTSYEERRKQATAIVLLGVIGAEFGAEIEPPKLLTRPRSSSQIPEGFGLTSGGSNYSLARHTCKALTFLLLQPPSPKLPPHSTIRRTAIDLIGRGFTVWEPYMDVSAVLMGLLELCADAEKQLANITMGLPLSPAADSARSARHALSLIATARPPAFITTIAKEVHRHTALAANTQSQQNMHTTTLARAKGEILRVIEILIEKMPTDVVDLLVEVMDIIMYCLEGSLVKKKGLQECFPAICRFYMVSYYERNHRIAVGARHGSVALYDIRTGKCQTIHGHKGPITAVAFAPDGRYLATYSNTDSHISFWQMNTSLLGSIGMLNSAPQLRCIKTYQVPPVQPASPGSHNALKLARLIWTSNRNVILMAHDGKEHRFMV

SEQ ID NO: 69843 - protein, 1102 aa, Homo sapiens
MRTSLQAVALWGQKAPPHSITAIMITDDQRTIVTGSQEGQLCLWNLSHELKISAKELLFGHSASVTCLARARDFSKQPYIVSAAENGEMCVWNVTNGQCMEKATLPYRHTAICYYHCSFRMTGEGWLLCCGEYQDVLIIDAKTLAVVHSFRSSQFPDWINCMCIVHSMRIQEDSLLVVSVAGELKVWDLSSSINSIQEKQDVYEKESKFLESLNCQTIRFCTYTERLLLVVFSKCWKVYDYCDFSLLLTEVSRNGQFFAGGEVIAAHRILIWTEDGHSYIYQLLNSGLSKSIYPADGRVLKETIYPHLLCSTSVQENKEQSRPFVMGYMNERKEPFYKVLFSGEVSGRITLWHIPDVPVSKFDGSPREIPVTATWTLQDNFDKHDTMSQSIIDYFSGLKDGAGTAVVTSSEYIPSLDKLICGCEDGTIIITQALNAAKARLLEGGSLVKDSPPHKVLKGHHQSVTSLLYPHGLSSKLDQSWMLSGDLDSCVILWDIFTEEILHKFFLEAGPVTSLLMSPEKFKLRGEQIICCVCGDHSVALLHLEGKSCLLHARKHLFPVRMIKWHPVENFLIVGCADDSVYIWEIETGTLERHETGERARIILNCCDDSQLVKSVLPIASETLKHKSIEQRSSSPYQLGPLPCPGLQVESSCKVTDAKFCPRPFNVLPVKTKWSNVGFHILLFDLENLVELLLPTPLSDVDSSSSFYGGEVLRRAKSTVEKKTLTLRKSKTACGPLSAEALAKPITESLAQGDNTIKFSEENDGIKRQKKMKISKKMQPKPSRKVDASLTIDTAKLFLSCLLPWGVDKDLDYLCIKHLNILKLQGPISLGISLNEDNFSLMLPGWDLCNSGMIKDYSGVNLFSRKVLDLSDKYTATLPNQVGIPRGLENNCDSLRESDTIVYLLSRLFLVNKLVNMPLELACRVGSSFRMESIHNKMRGAGNDILNMSSFYSCLRNGKNESHVPEADLSLLKLISCWRDQSVQVTEAIQAVLLAEVQQHMKSLGKIPVNSQPVSMAENGNCEMKQMLPKLEWTEELELQCVRNTLPLQTPVSPVKHDSNSNSANFQDVEDMPDRCALEESESPGEPRHHSWIAKVCPCKVS

SEQ ID NO: 69844 - protein, 1102 aa, Homo sapiens; identical to SEQ ID NO: 69843

SEQ ID NO: 69845 - protein, 1099 aa, Homo sapiens
MRTSLQAVALWGQKAPPHSITAIMITDDQRTIVTGSQEGQLCLWNLSHELKISAKELLFGHSASVTCLARARDFSKQPYIVSAAENGEMCVWNVTNGQCMEKATLPYRHTAICYYHCSFRMTGEGWLLCCGEYQDVLIIDAKTLAVVHSFRSSQFPDWINCMCIVHSMRIQDSLLVVSVAGELKVWDLSSSINSIQEKQDVYEKESKFLESLNCQTIRFCTYTERLLLVVFSKCWKVYDYCDFSLLLTEVSRNGQFFAGGEVIAAHRILIWTEDGHSYIYQLLNSGLSKSIYPADGRVLKETIYPHLLCSTSVQENKSRPFVMGYMNERKEPFYKVLFSGEVSGRITLWHIPDVPVSKFDGSPREIPVTATWTLQDNFDKHDTMSQSIIDYFSGLKDGAGTAVVTSSEYIPSLDKLICGCEDGTIIITQALNAAKARLLEGGSLVKDSPPHKVLKGHHQSVTSLLYPHGLSSKLDQSWMLSGDLDSCVILWDIFTEEILHKFFLEAGPVTSLLMSPEKFKLRGEQIICCVCGDHSVALLHLEGKSCLLHARKHLFPVRMIKWHPVENFLIVGCADDSVYIWEIETGTLERHETGERARIILNCCDDSQLVKSVLPIASETLKHKSIEQRSSSPYQLGPLPCPGLQVESSCKVTDAKFCPRPFNVLPVKTKWSNVGFHILLFDLENLVELLLPTPLSDVDSSSSFYGGEVLRRAKSTVEKKTLTLRKSKTACGPLSAEALAKPITESLAQGDNTIKFSEENDGIKRQKKMKISKKMQPKPSRKVDASLTIDTAKLFLSCLLPWGVDKDLDYLCIKHLNILKLQGPISLGISLNEDNFSLMLPGWDLCNSGMIKDYSGVNLFSRKVLDLSDKYTATLPNQVGIPRGLENNCDSLRESDTIVYLLSRLFLVNKLVNMPLELACRVGSSFRMESIHNKMRGAGNDILNMSSFYSCLRNGKNESHVPEADLSLLKLISCWRDQSVQVTEAIQAVLLAEVQQHMKSLGKIPVNSQPVSMAENGNCEMKQMLPKLEWTEELELQCVRNTLPLQTPVSPVKHDSNSNSANFQDVEDMPDRCALEESESPGEPRHHSWIAKVCPCKVS

SEQ ID NO: 69846 - protein, 775 aa, Homo sapiens
MRTSLQAVALWGQKAPPHSITAIMITDDQRTIVTGSQEGQLCLWNLSHELKISAKELLFGHSASVTCLARARDFSKQPYIVSAAENGEMCVWNVTNGQCMEKATLPYRHTAICYYHCSFRMTGEGWLLCCGEYQDVLIIDAKTLAVVHSFRSSQFPDWINCMCIVHSMRIQEDSLLVVSVAGELKVWDLSSSINSIQEKQDVYEKESKFLESLNCQTIRFCTYTERLLLVVFSKCWKVYDYCDFSLLLTEVSRNGQFFAGGEVIAAHRILIWTEDGHSYIYQLLNSGLSKSIYPADGRVLKETIYPHLLCSTSVQENKEQSRPFVMGYMNERKEPFYKVLFSGEVSGRITLWHIPDVPVSKFDGSPREIPVTATWTLQDNFDKHDTMSQSIIDYFSGLKDGAGTAVVTSSEYIPSLDKLICGCEDGTIIITQALNAAKARLLEGGSLVKDSPPHKVLKGHHQSVTSLLYPHGLSSKLDQSWMLSGDLDSCVILWDIFTEEILHKFFLEAGPVTSLLMSPEKFKLRGEQIICCVCGDHSVALLHLEGKSCLLHARKHLFPVRMIKWHPVENFLIVGCADDSVYIWEIETGTLERHETGERARIILNCCDDSQLVKSVLPIASETLKHKSIEQRSSSPYQLGPLPCPGLQVESSCKVTDAKFCPRPFNVLPVKTKWSNVGFHILLFDLENLVELLLPTPLSDVDSSSSFYGGEVLRRAKSTVEKKTLTLRKSKTACGPLSAEALAKPITESLAQGDNTIKFSEENDGIKRQKKMKIS

SEQ ID NO: 69847 - protein, 342 aa, Homo sapiens
MRKETPPPLVPPAAREWNLPPNAPACMERQLEAARYRSDGALLLGASSLSGRCWAGSLWLFKDPCAAPNEGFCSAGVQTEAGVADLTWVGERGILVASDSGAVELWELDENETLIVSKFCKYEHDDIVSTVSVLSSGTQAVSGSKDICIKVWDLAQQVVLSSYRAHAAQVTCVAASPHKDSVFLSCSEDNRILLWDTRCPKPASQIGCSAPGYLPTSLAWHPQQSEVFVFGDENGTVSLVDTKSTSCVLSSAVHSQCVTGLVFSPHSVPFLASLSEDCSLAVLDSSLSELFRSQAHRDFVRDATWSPLNHSLLTTVGWDHQVVHHVVPTEPLPAPGPASVTE

SEQ ID NO: 69848 - protein, 278 aa, Homo sapiens
MRKETPPPLVPPAAREWNLPPNAPACMERQLEAARYRSDGALLLGASSLSGRCWAGSLWLFKDPCAAPNEGFCSAGVQTEAGVADLTWVGERGILVASDSAHAAQVTCVAASPHKDSVFLSCSEDNRILLWDTRCPKPASQIGCSAPGYLPTSLAWHPQQSEVFVFGDENGTVSLVDTKSTSCVLSSAVHSQCVTGLVFSPHSVPFLASLSEDCSLAVLDSSLSELFRSQAHRDFVRDATWSPLNHSLLTTVGWDHQVVHHVVPTEPLPAPGPASVTE

SEQ ID NO: 69849 - protein, 291 aa, Homo sapiens
  MOD_RES (1)..(1): Any amino acid
XCAAPNEGFCSAGVQTEAGVADLTWVGERGILVASDSGAVELWELDENETLIVSKFCKYEHDDIVSTVSVLSSGTQAVSGSKDICIKVWDLAQQVVLSSYRAHAAQVTCVAASPHKDSVFLSCSEDNRILLWDTRCPKPASQIGCSAPGYLPTSLAWHPQQSEVFVFGDENGTVSLVDTKSTSCVLSSAVHSQCVTGLVFSPHRLDLSQPSPPSDSVPFLASLSEDCSLAVLDSSLSELFRSQAHRDFVRDATWSPLNHSLLTTVGWDHQVVHHVVPTEPLPAPGPASVTE

SEQ ID NO: 69850 - protein, 313 aa, Homo sapiens
MKLTDSVLRSFRVAKVFRENSDKINCFDFSPNGETVISSSDDDSIVLYDCQEGKPKRTLYSKKYGVDLIRYTHAANTVVYSSNKIDDTIRYLSLHDNKYIRYFPGHSKRVVALSMSPVDDTFISGSLDKTIRLWDLRSPNCQGLMHLQGKPVCSFDPEGLIFAAGVNSEMVKLYDLRSFDKGPFATFKMQYDRTCEWTGLKFSNDGKLILISTNGSFIRLIDAFKGVVMHTFGGYANSKAVTLEASFTPDSQFIMIGSEDGKIHVWNGESGIKVAVLDGKHTGPITCLQFNPKFMTFASACSNMAFWLPTIDD

SEQ ID NO: 69851 - protein, 452 aa, Homo sapiens
MMGCFALQTVDTELTADSVEWCPLQGCRHLLACGTYQLRRPEDRPAGPQNKGGMEVKEPQVRLGRLFLYSFNDNNSIHPLVEVQRKDTSAILDMKWCHIPVAGHALLGLADASGSIQLLRLVESEKSHVLEPLSSLALEEQCLALSLDWSTGKTGRAGDQPLKIISSDSTGQLHLLMVNETRPRLQKVASWQAHQFEAWIAAFNYWHPEIVYSGGDDGLLRGWDTRVPGKFLFTSKRHTMGVCSIQSSPHREHILATGSYDEHILLWDTRNMKQPLADTPVQGGVWRIKWHPFHHHLLLAACMHSGFKILNCQKAMEERQEATVLTSHTLPDSLVYGADWSWLLFRSLQRAPSWSFPSNLGTKTADLKGASELPTPCHECREDNDGEGHARPQSGMKPLTEGMRKNGTWLQATAATTRDCGVNPEEADSAFSLLATCSFYDHALHLWEWEGN

SEQ ID NO: 69852 - protein, 357 aa, Homo sapiens
MSAFEKPQIIAHIQKGFNYTVFDCKWVPCSAKFVTMGNFARGTGVIQLYEIQHGDLKLLREIEKAKPIKCGTFGATSLQQRYLATGDFGGNLHIWNLEAPEMPVYSVKGHKEIINAIDGIGGLGIGEGAPEIVTGSRDGTVKVWDPRQKDDPVANMEPVQGENKRDCWTVAFGNAYNQEERVVCAGYDNGDIKLFDLRNMALRWETNIKNGVCSLEFDRKDISMNKLVATSLEGKFHVFDMRTQHPTKGFASVSEKAHKSTVWQVRHLPQNRELFLTAGGAGGLHLWKYEYPIQRSKKDSEGIEMGVAGSVSLLQNVTLSTQPISSLDWSPDKRGLCVCSSFDQTVRVLIVTKLNKI

SEQ ID NO: 69853 - protein, 288 aa, Homo sapiens
MSAFEKPQIIAHIQKGFNYTVFDCKWVPCSAKFVTMGNFARGTGVIQLYEIQHGDLKLLREIEKAKPIKCGTFGATSLQQRYLATGDFGGNLHIWNLEAPEMPVYSVKGHKEIINAIDGIGGLGIGEGAPEIVTGSRDGTVKVWDPRQKDDPVANMEPVQGENKRDCWTVAFGNAYNQEERVVCAGYDNGDIKLFDLRNMALRWETNIKNGVCSLEFDRKDISMNKLVATSLEGKFHVFDMRTQHPTKGFASVSEKAHKSTVWQVRHLPQNRELFLTAGGAGGLHLWK

SEQ ID NO: 69854 - protein, 1271 aa, Homo sapiens
  MOD_RES (1)..(1): Any amino acid
XRDFQSEVLLSAMELFHMTSGGDAAMFRDGKEPQPSAEAAAAPSLANISCFTQKLVEKLYSGMFSADPRHILLFILEHIMVVIETASSQRDTVLSTLYSSLNKVILYCLSKPQQSLSECLGLLSILGFLQEHWDVVFATYNSNISFLLCLMHCLLLLNERSYPEGFGLEPKPRMSTYHQVFLSPNEDVKEKREDLPSLSDVQHNIQKTVQTLWQQLVAQRQQTLEDAFKIDLSVKPGEREVKIEEVTPLWEETMLKAWQHYLASEKKSLASRSNVAHHSKVTLWSGSLSSAMKLMPGRQAKDPECKTEDFVSCIENYRRRGQELYASLYKDHVQRRKCGNIKAANAWARIQEQLFGELGLWSQGEETKPCSPWELDWREGPARMRKRIKRLSPLEALSSGRHKESQDKNDHISQTNAENQDELTLREAEGEPDEVGVDCTQLTFFPALHESLHSEDFLELCRERQVILQELLDKEKVTQKFSLVIVQGHLVSEGVLLFGHQHFYICENFTLSPTGDVYCTRHCLSNISDPFIFNLCSKDRSTDHYSCQCHSYADMRELRQARFLLQDIALEIFFHNGYSKFLVFYNNDRSKAFKSFCSFQPSLKGKATSEDTLSLRRYPGSDRIMLQKWQKRDISNFEYLMYLNTAAGRTCNDYMQYPVFPWVLADYTSETLNLANPKIFRDLSKPMGAQTKERKLKFIQRFKEVEKTEGDMTVQCHYYTHYSSAIIVASYLVRMPPFTQAFCALQGGSFDVADRMFHSVKSTWESASRENMSDVRELTPEFFYLPEFLTNCNGVEFGCMQDGTVLGDVQLPPWADGDPRKFISLHRKALESDFVSANLHHWIDLIFGYKQQGPAAVDAVNIFHPYFYGDRMDLSSITDPLIKSTILGFVSNFGQVPKQLFTKPHPARTAAGKPLPGKDVSTPVSLPGHPQPFFYSLQSLRPSQVTVKDMYLFSLGSESPKGAIGHIVSTEKTILAVERNKVLLPPLWNRTFSWGFDDFSCCLGSYGSDKVLMTFENLAAWGRCLCAVCPSPTTIVTSGTSTVVCVWELSMTKGRPRGLRLRQALYGHTQAVTCLAASVTFSLLVSGSQDCTCILWDLDHLTHVTRLPAHREGISAITISDVSGTIVSCAGAHLSLWNVNGQPLASITTAWGPEGAITCCCLMEGPAWDTSQIIITGSQDGMVRVWKTEDVKMSVPGRPAGEEPPAQPPSPRGHKWEKNLALSRELDVSIALTGKPSKTSPAVTALAVSRNHTKLLVGDERGRIFCWSADG

SEQ ID NO: 69855 - protein, 2267 aa, Homo sapiens
  MOD_RES (1)..(1): Any amino acid
XKLASQAIEPDVLRQFLGLGIPSSLSATTKILDSSHTHRGNPGCSGSQTAQGLAEGPWPAAPDAGLHPGVTQAPQPLGESQDSTTALQTALSLISMTSPRNLQPQRAALAPSFVEFDMSVEGYGCLFIPTLSTVMGTSTEYSVSGGIGTGATRPFPPPGGLTFSCWFLISRHGAATEGHPLRFLTLVRHLARTEQPFVCFSVSLCPDDLSLVVSTEEKEFQPLDVMEPEDDSEPSAGCQLQVRCGQLLACGQWHHLAVVVTKEMKRHCTVSTCLDGQVIGSAKMLYIQALPGPFLSMDPSAFVDVYGYIATPRVWKQKSSLIWRLGPTYLFEEAISMETLEVINKLGPRYCGNFQAVHVQGEDLDSEATPFVAEERVSFGLHIASSSITSVADIRNAYNEVDSRLIAKEMNISSRDNAMPVFLLRNCAGHLSGSLRTIGAVAVGQLGVRVFHSSPAASSLDFIGGPAILLGLISLATDDHTMYAAVKVLHSVLTSNAMCDFLMQHICGYQIMAFLLRKKASLLNHRIFQLILSVAGTVELGFRSSAITNTGVFQHILCNFELWMNTADNLELSLFSHLLEILQSPREGPRNAEAAHQAQLIPKLIFLFNEPSLIPSKISTIIGILACQLRGHFSTQDLLRIGLFVVYTLKPSSVNERQICMDGALDPSLPAGSQTSGKTIWLRNQLLEMLLSVISSPQLHLSSESKEEMFLKLGPDWFLLLLQGHLHASTTVLALKLLLYFLASPSLRTRFRDGLCAGSWVERSTEGVDIVMDNLKSQSPLPEQSPCLLPGFRVLNDFLAHHVHIPEVYLIVSTFFLQTPLTELMDGPKDSLDAMLQWLLQRHHQEEVLQAGLCTEGALLLLEMLKATMSQPLAGSEDGAWAQTFPASVLQFLSLVHRTYPQDPAWRAPEFLQTLAIAAFPLGAQKGVGAESTRNTSSPEAAAEGDSTVEGLQAPTKAHPARRKLREFTQLLLRELLLGASSPKQWLPLEVLLEASPDHATSQQKRDFQSEVLLSAMELFHMTSGGDAAMFRDGKEPQPSAEAAAAPSLANISCFTQKLVEKLYSGMFSADPRHILLFILEHIMVVIETASSQRDTVLSTLYSSLNKVILYCLSKPQQSLSECLGLLSILGFLQEHWDVVFATYNSNISFLLCLMHCLLLLNERSYPEGFGLEPKPRMSTYHQVFLSPNEDVKEKREDLPSLSDVQHNIQKTVQTLWQQLVAQRQQTLEDAFKIDLSVKPGEREVKIEEVTPLWEETMLKAWQHYLASEKKSLASRSNVAHHSKVTLWSGSLSSAMKLMPGRQAKDPECKTEDFVSCIENYRRRGQELYASLYKDHVQRRKCGNIKAANAWARIQEQLFGELGLWSQGEETKPCSPWELDWREGPARMRKRIKRLSPLEALSSGRHKESQDKNDHISQTNAENQDELTLREAEGEPDEVGVDCTQLTFFPALHESLHSEDFLELCRERQVILQELLDKEKVTQKFSLVIVQGHLVSEGVLLFGHQHFYICENFTLSPTGDVYCTRHCLSNISDPFIFNLCSKDRSTDHYSCQCHSYADMRELRQARFLLQDIALEIFFHNGYSKFLVFYNNDRSKAFKSFCSFQPSLKGKATSEDTLSLRRYPGSDRIMLQKWQKRDISNFEYLMYLNTAAGRTCNDYMQYPVFPWVLADYTSETLNLANPKIFRDLSKPMGAQTKERKLKFIQRFKEVEKTEGDMTVQCHYYTHYSSAIIVASYLVRMPPFTQAFCALQGGSFDVADRMFHSVKSTWESASRENMSDVRELTPEFFYLPEFLTNCNGVEFGCMQDGTVLGDVQLPPWADGDPRKFISLHRKALESDFVSANLHHWIDLIFGYKQQGPAAVDAVNIFHPYFYGDRMDLSSITDPLIKSTILGFVSNFGQVPKQLFTKPHPARTAAGKPLPGKDVSTPVSLPGHPQPFFYSLQSLRPSQVTVKDMYLFSLGSESPKGAIGHIVSTEKTILAVERNKVLLPPLWNRTFSWGFDDFSCCLGSYGSDKVLMTFENLAAWGRCLCAVCPSPTTIVTSGTSTVVCVWELSMTKGRPRGLRLRQALYGHTQAVTCLAASVTFSLLVSGSQDCTCILWDLDHLTHVTRLPAHREGISAITISDVSGTIVSCAGAHLSLWNVNGQPLASITTAWGPEGAITCCCLMEGPAWDTSQIIITGSQDGMVRVWKTEDVKMSVPGLQMGRKREAAEALAQQCQAEGGRGDWGLSSAYRRNPQGLLPHSSQGRASGNHSSAAQPSPWPMGLL

SEQ ID NO: 69856 - protein, 3184 aa, Homo sapiens
MEAEDLSKAEDRNEDPGSKNEGQLAAVQPDVPHGGQSSSPTALWDMLERKFLEYQQLTHKSPIERQKSLLSLLPLFLKAWEHSVGIICFPSLQRLAEDVSDQLAQQLQKALVGKPAEQARLAAGQLLWWKGDVDQDGYLLLKSVYVLTGTDSETLGRVAESGLPALLLQCLYLFFVFPLDKDELLESDLQVQKMFVQMLLNICSDSQGLEGLLSGSELQSLLIATTCLREHSCCFWKEPTFCVLRAISKAQNLSIIQYLQATDCVRLSLQNLSRLTDTLPAPEVSEAVSLILGFVKDSYPVSSALFLEFENSEGYPLLLKVLLRYDGLTQSEVDPHLEELLGLVVWLTTCGRSELKVFDSITYPQLEGFKFHHEASGVTVKNLQAFQVLQNVFHKASDSVLCIQVLSVIRTMWAWNARNFFLLEWTLQPISQFVEIMPLKPAPVQEHFFQLLEALVFELHYVPHEILRKVQHLIKESPGPSCTLMALQSILSIAGGDPLFTDIFRDSGLLGLLLAQLRKQAKIMRKSGNKVSTPGVQDPERELTCVMLRIVVTLLKGSVRNAVVLKDHGMVPFIKIFLDDECYREASLSILEQLSAINAEEYMSIIVGALCSSTQGELQLKLDLLKSLLRILVTPKGRAAFRVSSGFNGLLSLLSDLEGSLQEPPLQAWGAVSPRQTLELVLYTLCAVSAALHWDPVNGYFFRRNGLFEKLAEDLCLLGCFGALEEEGNLLRSWVDTKARPFADLLGTAFSSSGSLPPRIQSCLQILGFLDSMASGTLHLRGDLKESLRTKQGPVVDVQKGETGSDPQRNFKQWPDLEERMDEGDAAIMHPGVVCIMVRLLPRLYHEDHPQLSEEIQCSLASHIQSLVKSEKNRQVMCEAGLLGTLMASCHRALVTSGSPLHSRLIRIFEKLASQAIEPDVLRQFLGLGIPSSLSATTKILDSSHTHRGNPGCSGSQTAQGLAEGPWPAAPDAGLHPGVTQAPQPLGESQDSTTALQTALSLISMTSPRNLQPQRAALAPSFVEFDMSVEGYGCLFIPTLSTVMGTSTEYSVSGGIGTGATRPFPPPGGLTFSCWFLISRHGAATEGHPLRFLTLVRHLARTEQPFVCFSVSLCPDDLSLVVSTEEKEFQPLDVMEPEDDSEPSAGCQLQVRCGQLLACGQWHHLAVVVTKEMKRHCTVSTCLDGQVIGSAKMLYIQALPGPFLSMDPSAFVDVYGYIATPRVWKQKSSLIWRLGPTYLFEEAISMETLEVINKLGPRYCGNFQAVHVQGEDLDSEATPFVAEERVSFGLHIASSSITSVADIRNAYNEVDSRLIAKEMNISSRDNAMPVFLLRNCAGHLSGSLRTIGAVAVGQLGVRVFHSSPAASSLDFIGGPAILLGLISLATDDHTMYAAVKVLHSVLTSNAMCDFLMQHICGYQIMAFLLRKKASLLNHRIFQLILSVAGTVELGFRSSAITNTGVFQHILCNFELWMNTADNLELSLFSHLLEILQSPREGPRNAEAAHQAQLIPKLIFLFNEPSLIPSKISTIIGILACQLRGHFSTQDLLRIGLFVVYTLKPSSVNERQICMDGALDPSLPAGSQTSGKTIWLRNQLLEMLLSVISSPQLHLSSESKEEMFLKLGPDWFLLLLQGHLHASTTVLALKLLLYFLASPSLRTRFRDGLCAGSWVERSTEGVDIVMDNLKSQSPLPEQSPCLLPGFRVLNDFLAHHVHIPEVYLIVSTFFLQTPLTELMDGPKDSLDAMLQWLLQRHHQEEVLQAGLCTEGALLLLEMLKATMSQPLAGSEDGAWAQTFPASVLQFLSLVHRTYPQDPAWRAPEFLQTLAIAAFPLGAQKGVGAESTRNTSSPEAAAEGDSTVEGLQAPTKAHPARRKLREFTQLLLRELLLGASSPKQWLPLEVLLEASPDHATSQQKRDFQSEVLLSAMELFHMTSGGDAAMFRDGKEPQPSAEAAAAPSLANISCFTQKLVEKLYSGMFSADPRHILLFILEHIMVVIETASSQRDTVLSTLYSSLNKVILYCLSKPQQSLSECLGLLSILGFLQEHWDVVFATYNSNISFLLCLMHCLLLLNERSYPEGFGLEPKPRMSTYHQVFLSPNEDVKEKREDLPSLSDVQHNIQKTVQTLWQQLVAQRQQTLEDAFKIDLSVKPGEREVKIEEVTPLWEETMLKAWQHYLASEKKSLASRSNVAHHSKVTLWSGSLSSAMKLMPGRQAKDPECKTEDFVSCIENYRRRGQELYASLYKDHVQRRKCGNIKAANAWARIQEQLFGELGLWSQGEETKPCSPWELDWREGPARMRKRIKRLSPLEALSSGRHKESQDKNDHISQTNAENQDELTLREAEGEPDEVGVDCTQLTFFPALHESLHSEDFLELCRERQVILQELLDKEKVTQKFSLVIVQGHLVSEGVLLFGHQHFYICENFTLSPTGDVYCTRHCLSNISDPFIFNLCSKDRSTDHYSCQCHSYADMRELRQARFLLQDIALEIFFHNGYSKFLVFYNNDRSKAFKSFCSFQPSLKGKATSEDTLSLRRYPGSDRIMLQKWQKRDISNFEYLMYLNTAAGRTCNDYMQYPVFPWVLADYTSETLNLANPKIFRDLSKPMGAQTKERKLKFIQRFKEVEKTEGDMTVQCHYYTHYSSAIIVASYLVRMPPFTQAFCALQGGSFDVADRMFHSVKSTWESASRENMSDVRELTPEFFYLPEFLTNCNGVEFGCMQDGTVLGDVQLPPWADGDPRKFISLHRKALESDFVSANLHHWIDLIFGYKQQGPAAVDAVNIFHPYFYGDRMDLSSITDPLIKSTILGFVSNFGQVPKQLFTKPHPARTAAGKPLPGKDVSTPVSLPGHPQPFFYSLQSLRPSQVTVKDMYLFSLGSESPKGAIGHIVSTEKTILAVERNKVLLPPLWNRTFSWGFDDFSCCLGSYGSDKVLMTFENLAAWGRCLCAVCPSPTTIVTSGTSTVVCVWELSMTKGRPRGLRLRQALYGHTQAVTCLAASVTFSLLVSGSQDCTCILWDLDHLTHVTRLPAHREGISAITISDVSGTIVSCAGAHLSLWNVNGQPLASITTAWGPEGAITCCCLMEGPAWDTSQIIITGSQDGMVRVWKTEDVKMSVPGRPAGEEPPAQPPSPRGHKWEKNLALSRELDVSIALTGKPSKTSPAVTALAVSRNHTKLLVGDERGRIFCWSADG

SEQ ID NO: 69857 - protein, 654 aa, Homo sapiens
MEAEDLSKAEDRNEDPGSKNEGQLAAVQPDVPHGGQSSSPTALWDMLERKFLEYQQLTHKSPIERQKSLLSLLPLFLKAWEHSVGIICFPSLQRLAEDVSDQLAQQLQKALVGKPAEQARLAAGQLLWWKGDVDQDGYLLLKSVYVLTGTDSETLGRVAESGLPALLLQCLYLFFVFPLDKDELLESDLQVQKMFVQMLLNICSDSQGLEGLLSGSELQSLLIATTCLREHSCCFWKEPTFCVLRAISKAQNLSIIQYLQATDCVRLSLQNLSRLTDTLPAPEVSEAVSLILGFVKDSYPVSSALFLEFENSEGYPLLLKVLLRYDGLTQSEVDPHLEELLGLVVWLTTCGRSELKVFDSITYPQLEGFKFHHEASGVTVKNLQAFQVLQNVFHKASDSVLCIQVLSVIRTMWAWNARNFFLLEWTLQPISQFVEIMPLKPAPVQEHFFQLLEALVFELHYVPHEILRKVQHLIKESPGPSCTLMALQSILSIAGGDPLFTDIFRDSGLLGLLLAQLRKQAKIMRKSGNKVSTPGVQDPERELTCVMLRIVVTLLKGSVRNAVVLKDHGMVPFIKIFLDDECYREASLSILEQLSAINAEEYMSIIVGALCSSTQGELQLKLDLLKVISSPPLRLASLWICTKRSTFAQAFVFM

SEQ ID NO: 69858 - protein, 552 aa, Homo sapiens
  MOD_RES (1)..(1): Any amino acid
XDDTVVWAEECVACANWLWMNTADNLELSLFSHLLEILQSPREGPRNAEAAHQAQLIPKLIFLFNEPSLIPSKISTIIGILACQLRGHFSTQDLLRIGLFVVYTLKPSSVNERQICMDGALDPSLPAGSQTSGKTIWLRNQLLEMLLSVISSPQLHLSSESKEEMFLKLGPDWFLLLLQGHLHASTTVLALKLLLYFLASPSLRTRFRDGLCAGSWVERSTEGVDIVMDNLKSQSPLPEQSPCLLPGFRVLNDFLAHHVHIPEVYLIVSTFFLQTPLTELMDGPKDSLDAMLQWLLQRHHQEEVLQAGLCTEGALLLLEMLKATMSQPLAGSEDGAWAQTFPASVLQFLSLVHRTYPQDPAWRAPEFLQTLAIAAFPLGAQKGVGAESTRNTSSPEAAAEGDSTVEGLQAPTKAHPARRKLREFTQLLLRELLLGASSPKQWLPLEVLLEASPDHATSQQKRDFQSEVLLSAMELFHMTSGGDAAMFRDGKEPQPSAEAAAAPSLANISCFTQKLVEKLYSGMFSADPRHILLFILEHIMVISAPLQARDFS

SEQ ID NO: 69859 - protein, 1042 aa, Homo sapiens
MEAEDLSKAEDRNEDPGSKNEGQLAAVQPDVPHGGQSSSPTALWDMLERKFLEYQQLTHKSPIERQKSLLSLLPLFLKAWEHSVGIICFPSLQRLAEDVSDQLAQQLQKALVGKPAEQARLAAGQLLWWKGDVDQDGYLLLKSVYVLTGTDSETLGRVAESGLPALLLQCLYLFFVFPLDKDELLESDLQVQKMFVQMLLNICSDSQGLEGLLSGSELQSLLIATTCLREHSCCFWKEPTFCVLRAISKAQNLSIIQYLQATDCVRLSLQNLSRLTDTLPAPEVSEAVSLILGFVKDSYPVSSALFLEFENSEGYPLLLKVLLRYDGLTQSEVDPHLEELLGLVVWLTTCGRSELKVFDSITYPQLEGFKFHHEASGVTVKNLQAFQVLQNVFHKASDSVLCIQVLSVIRTMWAWNARNFFLLEWTLQPISQFVEIMPLKPAPVQEHFFQLLEALVFELHYVPHEILRKVQHLIKESPGPSCTLMALQSILSIAGGDPLFTDIFRDSGLLGLLLAQLRKQAKIMRKSGNKVSTPGVQDPERELTCVMLRIVVTLLKGSVRNAVVLKDHGMVPFIKIFLDDECYREASLSILEQLSAINAEEYMSIIVGALCSSTQGELQLKLDLLKSLLRILVTPKGRAAFRVSSGFNGLLSLLSDLEGSLQEPPLQAWGAVSPRQTLELVLYTLCAVSAALHWDPVNGYFFRRNGLFEKLAEDLCLLGCFGALEEEGNLLRSWVDTKARPFADLLGTAFSSSGSLPPRIQSCLQILGFLDSMASGTLHLRGDLKESLRTKQGPVVDVQKGETGSDPQRNFKQWPDLEERMDEGDAAIMHPGVVCIMVRLLPRLYHEDHPQLSEEIQCSLASHIQSLVKSEKNRQVMCEAGLLGTLMASCHRALVTSGSPLHSRLIRIFEKLASQAIEPDVLRQFLGLGIPSSLSATTKILDSSHTHRGNPGCSGSQTAQGLAEGPWPAAPDAGLHPGVTQAPQPLGESQDSTTALQTALSLISMTSPHIWKPNIWKDNLAQKPVAGDAAQCNIFPPASSVL

SEQ ID NO: 69860 - protein, 3176 aa, Homo sapiens
MEAEDLSKAEDRNEDPGSKNEGQLAAVQPDVPHGGQSSSPTALWDMLERKFLEYQQLTHKSPIERQKSLLSLLPLFLKAWEHSVGIICFPSLQRLAEDVSDQLAQQLQKALVGKPAEQARLAAGQLLWWKGDVDQDGYLLLKSVYVLTGTDSETLGRVAESGLPALLLQCLYLFFVFPLDKDELLESDLQVQKMFVQMLLNICSDSQGLEGLLSGSELQSLLIATTCLREHSCCFWKEPTFCVLRAISKAQNLSIIQYLQATDCVRLSLQNLSRLTDTLPAPEVSEAVSLILGFVKDSYPVSSALFLEFENSEGYPLLLKVLLRYDGLTQSEVDPHLEELLGLVVWLTTCGRSELKVFDSITYPQLEGFKFHHEASGVTVKNLQAFQVLQNVFHKASDSVLCIQVLSVIRTMWAWNARNFFLLEWTLQPISQFVEIMPLKPAPVQEHFFQLLEALVFELHYVPHEILRKVQHLIKESPGPSCTLMALQSILSIAGGDPLFTDIFRDSGLLGLLLAQLRKQAKIMRKSGNKVSTPGVQDPERELTCVMLRIVVTLLKGSVRNAVVLKDHGMVPFIKIFLDDECYREASLSILEQLSAINAEEYMSIIVGALCSSTQGELQLKLDLLKSLLRILVTPKGRAAFRVSSGFNGLLSLLSDLEGSLQEPPLQAWGAVSPRQTLELVLYTLCAVSAALHWDPVNGYFFRRNGLFEKLAEDLCLLGCFGALEEEGNLLRSWVDTKARPFADLLGTAFSSSGSLPPRIQSCLQILGFLDSMASGTLHLRGDLKESLRTKQGPVVDVQKGETGSDPQRNFKQWPDLEERMDEGDAAIMHPGVVCIMVRLLPRLYHEDHPQLSEEIQCSLASHIQSLVKSEKNRQVMCEAGLLGTLMASCHRALVTSGSPLHSRLIRIFEKLASQAIEPDVLRQFLGLGIPSSLSATTKILDSSHTHRGNPGCSGSQTAQGLAEGPWPAAPDAGLHPGVTQAPQPLGESQDSTTALQTALSLISMTSPRNLQPQRAALAPSFVEFDMSVEGYGCLFIPTLSTVMGTSTEYSVSGGIGTGATRPFPPPGGLTFSCWFLISRHGAATEGHPLRFLTLVRHLARTEQPFVCFSVSLCPDDLSLVVSTEEKEFQPLDVMEPEDDSEPSAGCQLQVRCGQLLACGQWHHLAVVVTKEMKRHCTVSTCLDGQVIGSAKMLYIQALPGPFLSMDPSAFVDVYGYIATPRVWKQKSSLIWRLGPTYLFEEAISMETLEVINKLGPRYCGNFQAVHVQGEDLDSEATPFVAEERVSFGLHIASSSITSVADIRNAYNEVDSRLIAKEMNISSRDNAMPVFLLRNCAGHLSGSLRTIGAVAVGQLGVRVFHSSPAASSLDFIGGPAILLGLISLATDDHTMYAAVKVLHSVLTSNAMCDFLMQHICGYQIMAFLLRKKASLLNHRIFQLILSVAGTVELGFRSSAITNTGVFQHILCNFELWMNTADNLELSLFSHLLEILQSPREGPRNAEAAHQAQLIPKLIFLFNEPSLIPSKISTIIGILACQLRGHFSTQDLLRIGLFVVYTLKPSSVNERQICMDGALDPSLPAGSQTSGKTIWLRNQLLEMLLSVISSPQLHLSSESKEEMFLKLGPDWFLLLLQGHLHASTTVLALKLLLYFLASPSLRTRFRDGLCAGSWVERSTEGVDIVMDNLKSQSPLPEQSPCLLPGFRVLNDFLAHHVHIPEVYLIVSTFFLQTPLTELMDGPKDSLDAMLQWLLQRHHQEEVLQAGLCTEGALLLLEMLKATMSQPLAGSEDGAWAQTFPASVLQFLSLVHRTYPQDPAWRAPEFLQTLAIAAFPLGAQKGVGAESTRNTSSPEAAAEGDSTVEGLQAPTKAHPARRKLREFTQLLLRELLLGASSPKQWLPLEVLLEASPDHATSQQKRDFQSEVLLSAMELFHMTSGGDAAMFRDGKEPQPSAEAAAAPSLANISCFTQKLVEKLYSGMFSADPRHILLFILEHIMVVIETASSQRDTVLSTLYSSLNKVILYCLSKPQQSLSECLGLLSILGFLQEHWDVVFATYNSNISFLLCLMHCLLLLNERSYPEGFGLEPKPRMSTYHQVFLSPNEDVKEKREDLPSLSDVQHNIQKTVQTLWQQLVAQRQQTLEDAFKIDLSVKPGEREVKIEEVTPLWEETMLKAWQHYLASEKKSLASRSNVAHHSKVTLWSGSLSSAMKLMPGRQAKDPECKTEDFVSCIENYRRRGQELYASLYKDHVQRRKCGNIKAANAWARIQEQLFGELGLWSQGEETKPCSPWELDWREGPARMRKRIKRLSPLEALSSGRHKESQDKNDHISQTNAENQDELTLREAEGEPDEVGVDCTQLTFFPALHESLHSEDFLELCRERQVILQELLDKEKVTQKFSLVIVQGHLVSEGVLLFGHQHFYICENFTLSPTGDVYCTRHCLSNISDPFIFNLCSKDRSTDHYSCQCHSYADMRELRQARFLLQDIALEIFFHNGYSKFLVFYNNDRSKAFKSFCSFQPSLKGKATSEDTLSLRRYPGSDRIMLQKWQKRDISNFEYLMYLNTAAGRTCNDYMQYPVFPWVLADYTSETLNLANPKIFRDLSKPMGAQTKERKLKFIQRFKEVEKTEGDMTVQCHYYTHYSSAIIVASYLVRMPPFTQAFCALQGGSFDVADRMFHSVKSTWESASRENMSDVRELTPEFFYLPEFLTNCNGVEFGCMQDGTVLGDVQLPPWADGDPRKFISLHRKALESDFVSANLHHWIDLIFGYKQQGPAAVDAVNIFHPYFYGDRMDLSSITDPLIKSTILGFVSNFGQVPKQLFTKPHPARTAAGKPLPGKDVSTPVSLPGHPQPFFYSLQSLRPSQVTVKDMYLFSLGSESPKGAIGHIVSTEKTILAVERNKVLLPPLWNRTFSWGFDDFSCCLGSYGSDKVLMTFENLAAWGRCLCAVCPSPTTIVTSGTSTVVCVWELSMTKGRPRGLRLRQALYGHTQAVTCLAASVTFSLLVSGSQDCTCILWDLDHLTHVTRLPAHREGISAITISDVSGTIVSCAGAHLSLWNVNGQPLASITTAWGPEGAITCCCLMEGPAWDTSQIIITGSQDGMVRVWKTEDVKMSVPGLQMGRKREAAEALAQQCQAEGGRGDWGLSSAYRRNPQGLLPHSSQGRASGNHSSAAQPSPWPMGLL

SEQ ID NO: 69861 - protein, 1052 aa, Homo sapiens
LNSDLLCHGMEAEDLSKAEDRNEDPGSKNEGQLAAVQPDVPHGGQSSSPTALWDMLERKFLEYQQLTHKSPIERQKSLLSLLPLFLKAWEHSVGIICFPSLQRLAEDVSDQLAQQLQKALVGKPAEQARLAAGQLLWWKGDVDQDGYLLLKSVYVLTGTDSETLGRVAESGLPALLLQCLYLFFVFPLDKDELLESDLQVQKMFVQMLLNICSDSQGLEGLLSGSELQSLLIATTCLREHSCCFWKEPTFCVLRAISKAQNLSIIQYLQATDCVRLSLQNLSRLTDTLPAPEVSEAVSLILGFVKDSYPVSSALFLEFENSEGYPLLLKVLLRYDGLTQSEVDPHLEELLGLVVWLTTCGRSELKVFDSITYPQLEGFKFHHEASGVTVKNLQAFQVLQNVFHKASDSVLCIQVLSVIRTMWAWNARNFFLLEWTLQPISQFVEIMPLKPAPVQEHFFQLLEALVFELHYVPHEILRKVQHLIKESPGPSCTLMALQSILSIAGGDPLFTDIFRDSGLLGLLLAQLRKQAKIMRKSGNKVSTPGVQDPERELTCVMLRIVVTLLKGSVRNAVVLKDHGMVPFIKIFLDDECYREASLSILEQLSAINAEEYMSIIVGALCSSTQGELQLKLDLLKSLLRILVTPKGRAAFRVSSGFNGLLSLLSDLEGSLQEPPLQAWGAVSPRQTLELVLYTLCAVSAALHWDPVNGYFFRRNGLFEKLAEDLCLLGCFGALEEEGNLLRSWVDTKARPFADLLGTAFSSSGSLPPRIQSCLQILGFLDSMASGTLHLRGDLKESLRTKQGPVVDVQKGETGSDPQRNFKQWPDLEERMDEGDAAIMHPGVVCIMVRLLPRLYHEDHPQLSEEIQCSLASHIQSLVKSEKNRQVMCEAGLLGTLMASCHRALVTSGSPLHSRLIRIFEKLASQAIEPDVLRQFLGLGIPSSLSATTKILDSSHTHRGNPGCSGSQTAQGLAEGPWPAAPDAGLHPGVTQAPQPLGESQDSTTALQTALSLISMTSPVAGSQTSGKTIWLRNQLLEMLLSVISSPQLHLSSE

SEQ ID NO: 69862 - protein, 624 aa, Homo sapiens
MLQKWQKRDISNFEYLMYLNTAAGRTCNDYMQYPVFPWVLADYTSETLNLANPKIFRDLSKPMGAQTKERKLKFIQRFKEVEKTEGDMTVQCHYYTHYSSAIIVASYLVRMPPFTQAFCALQGGSFDVADRMFHSVKSTWESASRENMSDVRELTPEFFYLPEFLTNCNGVEFGCMQDGTVLGDVQLPPWADGDPRKFISLHRKALESDFVSANLHHWIDLIFGYKQQGPAAVDAVNIFHPYFYGDRMDLSSITDPLIKSTILGFVSNFGQVPKQLFTKPHPARTAAGKPLPGKDVSTPVSLPGHPQPFFYSLQSLRPSQVTVKDMYLFSLGSESPKGAIGHIVSTEKTILAVERNKVLLPPLWNRTFSWGFDDFSCCLGSYGSDKVLMTFENLAAWGRCLCAVCPSPTTIVTSGTSTVVCVWELSMTKGRPRGLRLRQALYGHTQAVTCLAASVTFSLLVSGSQDCTCILWDLDHLTHVTRLPAHREGISAITISDVSGTIVSCAGAHLSLWNVNGQPLASITTAWGPEGAITCCCLMEGPAWDTSQIIITGSQDGMVRVWKTEDVKMSVPGRPAGEEPPAQPPTLSMADGTSMKRMSTHTRRAEQHAGNCDLVMPSCTRNYT

SEQ ID NO: 69863 - protein, 567 aa, Homo sapiens
MDDKDIDKELRQKLNFSYCEETEIEGQKKVEESREASSQTPEKGEVQDSEAKGTPPWTPLSNVHELDTSSEKDKESPDQILRTPVSHPLKCPETPAQPDSRSKLLPSDSPSTPKTMLSRLVISPTGKLPSRGPKHLKLTPAPLKDEMTSLALVNINPFTPESYKKLFLQSGGKRKIRGDLEEAGPEEGKGGLPAKRCVLRETNMASRYEKEFLEVEKIGVGEFGTVYKCIKRLDGCVYAIKRSMKTFTELSNENSALHEVYAHAVLGHHPHVVRYYSSWAEDDHMIIQNEYCNGGSLQAAISENTKSGNHFEEPKLKDILLQISLGLNYIHNSSMVHLDIKPSNIFICHKMQSESSGVIEEVENEADWFLSANVMYKIGDLGHATSINKPKVEEGDSRFLANEILQEDYRHLPKADIFALGLTIAVAAGAESLPTNGAAWHHIRKGNFPDVPQELSESFSSLLKNMIQPDAEQRPSAAALARNTVLRPSLGKTEELQQQLNLEKFKTATLERELREAQQAQSPQGYTHHGDTGVSGTHTGSRSTKRLVGGKSARSSSFTSGEREPLH

SEQ ID NO: 69864 - protein, 281 aa, Homo sapiens
MVTILMRAINSLGIHVLDSSRPTDPLSHSSNSSSEPAMFIEDKAVDTLAYLSDGDARAGLNGLQLAVLARLSSRKMFCKKSGQSYSPSRVLITENDVKEGLQRSHILYDRAGEEHYNCISALHKSMRGSDQNASLYWLARMLEGGEDPLYVARRLVRFASEDIGLADPSALTQAVAAYQGCHFIGMPECEVLLAQCVVYFARAPKSIEVYSAYNNVKACLRNHQGPLPPVPLHLRNAPTRLMKDLGYGKGYKYNPMYSEPVDQEYLPEELRGVDFFKQRRC

SEQ ID NO: 69865 - protein, 445 aa, Homo sapiens
MLQGKPLADTMRPDTLQDYFGQSKAVGQDTLLRSLLETNEIPSLILWGPPGCGKTTLAHIIASNSKKHSIRFVTLSATNAKTNDVRDVIKQAQNEKSFFKRKTILFIDEIHRFNKSQQDTFLPHVECGTITLIGATTENPSFQVNAALLSRCRVIVLEKLPVEAMVTILMRAINSLGIHVLDSSRPTDPLSHSSNSSSEPAMFIEDKAVDTLAYLSDGDARAGLNGLQLAVLARLSSRKMFCKKSGQSYSPSRVLITENDVKEGLQRSHILYDRAGEEHYNCISALHKSMRGSDQNASLYWLARMLEGGEDPLYVARRLVRFASEDIGLADPSALTQAVAAYQGCHFIGMPECEVLLAQCVVYFARAPKSIEVYSAYNNVKACLRNHQGPLPPVPLHLRNAPTRLMKDLGYGKGYKYNPMYSEPVDQEYLPEELRGVDFFKQRRC

SEQ ID NO: 69866 - protein, 640 aa, Homo sapiens
MEVSGPEDDPFLSQLHQVQCPVCQQMMPAAHINSHLDRCLLLHPAGHAEPAAGSHRAGERAKGPSPPGAKRRRLSESSALKQPATPTAAESSEGEGEEGDDGGETESRESYDAPPTPSGARLIPDFPVARSSSPGRKGSGKRPAAAAAAGSASPRSWDEAEAQEEEEAVGDGDGDGDADADGEDDPGHWDADAAEAATAFGASGGGRPHPRALAAEEIRQMLQGKPLADTMRPDTLQDYFGQSKAVGQDTLLRSLLETNEIPSLILWGPPGCGKTTLAHIIASNSKKHSIRFVTLSATNAKTNDVRDVIKQAQNEKSFFKRKTILFIDEIHRFNKSQQVNAALLSRCRVIVLEKLPVEAMVTILMRAINSLGIHVLDSSRPTDPLSHSSNSSSEPAMFIEDKAVDTLAYLSDGDARAGLNGLQLAVLARLSSRKMFCKKSGQSYSPSRVLITENDVKEGLQRSHILYDRAGEEHYNCISALHKSMRGSDQNASLYWLARMLEGGEDPLYVARRLVRFASEDIGLADPSALTQAVAAYQGCHFIGMPECEVLLAQCVVYFARAPKSIEVYSAYNNVKACLRNHQGPLPPVPLHLRNAPTRLMKDLGYGKGYKYNPMYSEPVDQEYLPEELRGVDFFKQRRC

SEQ ID NO: 69867 - protein, 665 aa, Homo sapiens
MEVSGPEDDPFLSQLHQVQCPVCQQMMPAAHINSHLDRCLLLHPAGHAEPAAGSHRAGERAKGPSPPGAKRRRLSESSALKQPATPTAAESSEGEGEEGDDGGETESRESYDAPPTPSGARLIPDFPVARSSSPGRKGSGKRPAAAAAAGSASPRSWDEAEAQEEEEAVGDGDGDGDADADGEDDPGHWDADAAEAATAFGASGGGRPHPRALAAEEIRQMLQGKPLADTMRPDTLQDYFGQSKAVGQDTLLRSLLETNEIPSLILWGPPGCGKTTLAHIIASNSKKHSIRFVTLSATNAKTNDVRDVIKQAQNEKSFFKRKTILFIDEIHRFNKSQQDTFLPHVECGTITLIGATTENPSFQVNAALLSRCRVIVLEKLPVEAMVTILMRAINSLGIHVLDSSRPTDPLSHSSNSSSEPAMFIEDKAVDTLAYLSDGDARAGLNGLQLAVLARLSSRKMFCKKSGQSYSPSRVLITENDVKEGLQRSHILYDRAGEEHYNCISALHKSMRGSDQNASLYWLARMLEGGEDPLYVARRLVRFASEDIGLADPSALTQAVAAYQGCHFIGMPECEVLLAQCVVYFARAPKSIEVYSAYNNVKACLRNHQGPLPPVPLHLRNAPTRLMKDLGYGKGYKYNPMYSEPVDQEYLPEELRGVDFFKQRRC

SEQ ID NO: 69868 - protein, 1432 aa, Homo sapiens
MSEKKLETTAQQRKCPEWMNVQNKRCAVEERKACVRKSVFEDDLPFLEFTGSIVYSYDASDCSFLSEDISMSLSDGDVVGFDMEWPPLYNRGKLGKVALIQLCVSESKCYLFHVSSMSVFPQGLKMLLENKAVKKAGVGIEGDQWKLLRDFDIKLKNFVELTDVANKKLKCTETWSLNSLVKHLLGKQLLKDKSIRCSNWSKFPLTEDQKLYAATDAYAGFIIYRNLEILDDTVQRFAINKEEEILLSDMNKQLTSISEEVMDLAKHLPHAFSKLENPRRVSILLKDISENLYSLRRMIIGSTNIETELRPSNNLNLLSFEDSTTGGVQQKQIREHEVLIHVEDETWDPTLDHLAKHDGEDVLGNKVERKEDGFEDGVEDNKLKENMERACLMSLDITEHELQILEQQSQEEYLSDIAYKSTEHLSPNDNENDTSYVIESDEDLEMEMLKHLSPNDNENDTSYVIESDEDLEMEMLKSLENLNSGTVEPTHSKCLKMERNLGLPTKEEEEDDENEANEGEEDDDKDFLWPAPNEEQVTCLKMYFGHSSFKPVQWKVIHSVLEERRDNVAVMATGYGKSLCFQYPPVYVGKIGLVISPLISLMEDQVLQLKMSNIPACFLGSAQSENVLTDIKLGKYRIVYVTPEYCSGNMGLLQQLEADIGITLIAVDEAHCISEWGHDFRDSFRKLGSLKTALPMVPIVALTATASSSIREDIVRCLNLRNPQITCTGFDRPNLYLEVRRKTGNILQDLQPFLVKTSSHWEFEGPTIIYCPSRKMTQQVTGELRKLNLSCGTYHAGMSFSTRKDIHHRFVRDEIQCVIATIAFGMGINKADIRQVIHYGAPKDMESYYQEIGRAGRDGLQSSCHVLWAPADINLNRHLLTEIRNEKFRLYKLKMMAKMEKYLHSSRCRRQIILSHFEDKQVQKASLGIMGTEKCCDNCRSRLDHCYSMDDSEDTSWDFGPQAFKLLSAVDILGEKFGIGLPILFLRGSNSQRLADQYRRHSLFGTGKDQTESWWKAFSRQLITEGFLVEVSRYNKFMKICALTKKGRNWLHKANTESQSLILQANEELCPKKLLLPSSKTVSSGTKEHCYNQVPVELSTEKKSNLEKLYSYKPCDKISSGSNISKKSIMVQSPEKAYSSSQPVISAQEQETQIVLYGKLVEARQKHANKMDVPPAILATNKILVDMAKMRPTTVENVKRIDGVSEGKAAMLAPLLEVIKHFCQTNSVQTDLFSSTKPQEEQKTSLVAKNKICTLSQSMAITYSLFQEKKMPLKSIAESRILPLMTIGMHLSQAVKAGCPLDLERAGLTPEVQKIIADVIRNPPVNSDMSKISLIRMLVPENIDTYLIHMAIEILKHGPDSGLQPSCDVNKRRCFPGSEEICSSSKRSKEEVGINTETSSAERKRRLPVWFAKGSDTSKKLMDKTKRGGLFS

SEQ ID NO: 69869 - protein, 245 aa, Homo sapiens
MAQEEGGSLPEVRARVRAAHGIPDLAQKLHFYDRWAPDYDQDVATLLYRAPRLAVDCLTQALPGPPHSALILDVACGTGLVAAELRAPGFLQLHGVDGSPGMLEQAQAPGLYQRLSLCTLGQEPLPSPEGTFDAVLIVGALSDGQVPCNAIPELHVTKPGGLVCLTTRTNSSNLQYKEALEATLDRLEQAGMWEGLVAWPVDRLWTAGSWLPPSWRWYPASLPRMASSPALSTCTESGRRPRLRK

SEQ ID NO: 69870 - protein, 265 aa, Homo sapiens
MEALPPVRSSLLGILLQVTRLSVLLVQNRDHLYNFLLLKINLFNHWVSGLAQEARGSCNWQAHLPLGAAACPLGQALWAGLALIQVPVWLVLQGPRLMWAGMWGSTKGLGLALLSAWEQLGLSVAIWTDLFLSCLHGLMLVALLLVVVTWRVCQKSHCFRLGRQLSKALQVNCVVRKLLVQLRRLYWWVETMTALTSWHLAYLITWTTCLASHLLQAAFEHTTQLAEAQEVEPQEVSGSSLLPSLSASSDSESGTVLPEQETPRE

SEQ ID NO: 69871 - protein, 151 aa, Homo sapiens
MTNEEPLPKKVRLSETDFKVMARDELILRWKQYEAYVQALEGKYTDLNSNDVTGLRESEEKLKQQQQESARRENILVMRLATKEQEMQECTTQIQYLKQVQQPSVAQLRSTMVDPAINLFFLKMKGELEQTKDKLEQAQNELSAWKFTPDR

SEQ ID NO: 69872 - protein, 396 aa, Homo sapiens
MTNEEPLPKKVRLSETDFKVMARDELILRWKQYEAYVQALEGKYTDLNSNDVTGLRESEEKLKQQQQESARRENILVMRLATKEQEMQECTTQIQYLKQVQQPSVAQLRSTMVDPAINLFFLKMKGELEQTKDKLEQAQNELSAWKFTPDSQTGKKLMAKCRMLIQENQELGRQLSQGRIAQLEAELALQKKYSEELKSSQDELNDFIIQLDEEVEGMQSTILVLQQQLKETRQQLAQYQQQQSQASAPSTSRTTASEPVEQSEATSKDCSRLTNGPSNGSSSRQRTSGSGFHREGNTTEDDFPSSPGNGNKSSNSSEERTGRGGSGYVNQLSAGYESVDSPTGSENSLTHQSNDTDSSHDPQEEKAVSGKGNRTVGSRHVQNGLDSSVNVQGSVL

SEQ ID NO: 69873 - protein, 360 aa, Homo sapiens
MNAPLGGIWLWLPLLLTWLTPEVNSSWWYMRATGGSSRVMCDNVPGLVSSQRQLCHRHPDVMRAISQGVAEWTAECQHQFRQHRWNCNTLDRDHSLFGRVLLRSSRESAFVYAISSAGVVFAITRACSQGEVKSCSCDPKKMGSAKDSKGIFDWGGCSDNIDYGIKFARAFVDAKERKGKDARALMNLHNNRAGRKAVKRFLKQECKCHGVSGSCTLRTCWLAMADFRKTGDYLWRKYNGAIQVVMNQDGTGFTVANERFKKPTKNDLVYFENSPDYCIRDREAGSLGTAGRVCNLTSRGMDSCEVMCCGRGYDTSHVTRMTKCGCKFHWCCAVRCQDCLEALDVHTCKAPKNADWTTAT

SEQ ID NO: 69874 - protein, 370 aa, Homo sapiens
MGLWALLPGWVSATLLLALAALPAALAANSSGRWWGIVNVASSTNLLTDSKSLQLVLEPSLQLLSRKQRRLIRQNPGILHSVSGGLQSAVRECKWQFRNRRWNCPTAPGPHLFGKIVNRGCRETAFIFAITSAGVTHSVARSCSEGSIESCTCDYRRRGPGGPDWHWGGCSDNIDFGRLFGREFVDSGEKGRDLRFLMNLHNNEAGRTTVFSEMRQECKCHGMSGSCTVRTCWMRLPTLRAVGDVLRDRFDGASRVLYGNRGSNRASRAELLRLEPEDPAHKPPSPHDLVYFEKSPNFCTYSGRLGTAGTAGRACNSSSPALDGCELLCCGRGHRTRTQRVTERCNCTFHWCCHVSCRNCTHTRVLHECL

SEQ ID NO: 69875 - protein, 195 aa, Homo sapiens
WHWGGCSDNIDFGRLFGREFVDSGEKGRDLRFLMNLHNNEAGRTTVFSEMRQECKCHGMSGSCTVRTCWMRLPTLRAVGDVLRDRFDGASRVLYGNRGSNRASRAELLRLEPDLVYFEKSPNFCTYSGRLGTAGTAGRACNSSSPALDGCELLCCGRGHRTRTQRVTERCNCTFHWCCHVSCRNCTHTRVLHECL

SEQ ID NO: 69876 - protein, 417 aa, Homo sapiens
MGSAHPRPWLRLRPQPQPRPALWVLLFFLLLLAAAMPRSAPNDILDLRLPPEPVLNANTVCLTLPGLSRRQMEVCVRHPDVAASAIQGIQIAIHECQHQFRDQRWNCSSLETRNKIPYESPIFSRGFRESAFAYAIAAAGVVHAVSNACALGKLKACGCDASRRGDEEAFRRKLHRLQLDALQRGKGLSHGVPEHPALPTASPGLQDSWEWGGCSPDMGFGERFSKDFLDSREPHRDIHARMRLHNNRVGRQAVMENMRRKCKCHGTSGSCQLKTCWQVTPEFRTVGALLRSRFHRATLIRPHNRNGGQLEPGPAGAPSPAPGAPGPRRRASPADLVYFEKSPDFCEREPRLDSAGTVGRLCNKSSAGSDGCGSMCCGRGHNILRQTRSERCHCRFHWCCFVVCEECRITEWVSVCK

SEQ ID NO: 69877 - protein, 389 aa, Homo sapiens
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGRLPHHSAILKRGFRESAFSFSMLAAGVMHAVATACSLGKLVSCGCGWKGSGEQDRLRAKLLQLQALSRGKSFPHSLPSPGPGSSPSPGPQDTWEWGGCNHDMDFGEKFSRDFLDSREAPRDIQARMRIHNNRVGRQVVTENLKRKCKCHGTSGSCQFKTCWRAAPEFRAVGAALRERLGRAIFIDTHNRNSGAFQPRLRPRRLSGELVYFEKSPDFCERDPTMGSPGTRGRACNKTSRLLDGCGSLCCGRGHNVLRQTRVERCHCRFHWCCYVLCDECKVTEWVNVCK

SEQ ID NO: 69878 - protein, 191 aa, Homo sapiens
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGRLPHHSAILKRGFRESAFSFSMLAAGVMHAVATACSLGKLVSCGCGWKGSGEQDRLRAKLLQLQALSRGKLPGTSRHECESTTTGWGARW

SEQ ID NO: 69879 - protein, 102 aa, Homo sapiens
MLEEPRPRPPPSGLAGLLFLALCSRALSNEILGLKLPGEPPLTANTVCLTLSGLSKRQLGLCLRNPDVTASALQGLHIAVHECQHQLRDQRWNCSALEGGGR

SEQ ID NO: 69880 - protein, 355 aa, Homo sapiens
MEPHLLGLLLGLLLGGTRVLAGYPIWWSLALGQQYTSLGSQPLLCGSIPGLVPKQLRFCRNYIEIMPSVAEGVKLGIQECQHQFRGRRWNCTTIDDSLAIFGPVLDKATRESAFVHAIASAGVAFAVTRSCAEGTSTICGCDSHHKGPPGEGWKWGGCSEDADFGVLVSREFADARENRPDARSAMNKHNNEAGRTTILDHMHLKCKCHGLSGSCEVKTCWWAQPDFRAIGDFLKDKYDSASEMVVEKHRESRGWVETLRAKYSLFKPPTERDLVYYENSPNFCEPNPETGSFGTRDRTCNVTSHGIDGCDLLCCGRGHNTRTEKRKEKCHCIFHWCCYVSCQECIRIYDVHTCK

SEQ ID NO: 69881 - protein, 352 aa, Homo sapiens
MAPLGYFLLLCSLKQALGSYPIWWSLAVGPQYSSLGSQPILCASIPGLVPKQLRFCRNYVEIMPSVAEGIKIGIQECQHQFRGRRWNCTTVHDSLAIFGPVLDKATRESAFVHAIASAGVAFAVTRSCAEGTAAICGCSSRHQGSPGKGWKWGGCSEDIEFGGMVSREFADARENRPDARSAMNRHNNEAGRQAIASHMHLKCKCHGLSGSCEVKTCWWSQPDFRAIGDFLKDKYDSASEMVVEKHRESRGWVETLRPRYTYFKVPTERDLVYYEASPNFCEPNPETGSFGTRDRTCNVSSHGIDGCDLLCCGRGHNARAERRREKCRCVFHWCCYVSCQECTRVYDVHTCK

SEQ ID NO: 69882 - protein, 385 aa, Homo sapiens
MAPLGYFLLLCSLKQALGSYPIWWSLAVGPQYSSLGSQPILCASIPGLVPKQLRFCRNYVEIMPSVAEGIKIGIQECQHQFRGRRWNCTTVHDSLAIFGPVLDKATRESAFVHAIASAGVAFAVTRSCAEGTAAICGCSSRHQGSPGKGWKWGGCSEDIEFGGMVSREFADARENRPDARSAMNRHNNEAGRQAIASHMHLKCKCHGLSGSCEVKTCWWSQPDFRAIGDFLKDKYDSASEMVVEKHRESRGWVETLRPRYTYFKVPTERDLVYYEASPNFCEPNPETGSFGTRDRTCNVSSHGIDGCDLLCCGRGHNARAERRREKCRCVFHWCCYVSCQECTRVYDVHTCKNPGSRAGNSAHQPPHPQPPVRFHPPLRRAGKVP

SEQ ID NO: 69883 - protein, 351 aa, Homo sapiens
MSPRSCLRSLRLLVFAVFSAAASNWLYLAKLSSVGSISEEETCEKLKGLIQRQVQMCKRNLEVMDSVRRGAQLAIEECQYQFRNRRWNCSTLDSLPVFGKVVTQGTREAAFVYAISSAGVAFAVTRACSSGELEKCGCDRTVHGVSPQGFQWSGCSDNIAYGVAFSQSFVDVRERSKGASSSRALMNLHNNEAGRKAILTHMRVECKCHGVSGSCEVKTCWRAVPPFRQVGHALKEKFDGATEVEPRRVGSSRALVPRNAQFKPHTDEDLVYLEPSPDFCEQDMRSGVLGTRGRTCNKTSKAIDGCELLCCGRGFHTAQVELAERCSCKFHWCCFVKCRQCQRLVELHTCR

SEQ ID NO: 69884 - protein, 175 aa, Homo sapiens
MSPRSCLRSLRLLVFAVFSAAASNWLYLAKLSSVGSISEEETCEKLKGLIQRQVQMCKRNLEVMDSVRRGAQLAIEECQYQFRNRRWNCSTLDSLPVFGKVVTQGGKAWHGGDSGCHLLTESRSGERTQRRKEGGSLGQCWPEAIVGTQDPMRSPPYLWGRNQGGTHTGSASEGH

SEQ ID NO: 69885 - protein, 150 aa, Homo sapiens
  MOD_RES (1)..(1): Any amino acid
XYLAKLSSVGSISEEETCEKLKGLIQRQVQMCKRNLEVMDSVRRGAQLAIEECQYQFRNRRWNCSTLDSLPVFGKVVTQGGKAWHGGDSGCHLLTESRSGERTQRRKEGGSLGQCWPEAIVGTQDPMRSPPYLWGRNQGGTHTGSASEGH

SEQ ID NO: 69886 - protein, 52 aa, Homo sapiens
MCKRNLEVMDSVRRGAQLAIEECQYQFRNRRWNCSTLDSLPVFGKVVTQGGK

SEQ ID NO: 69887 - protein, 296 aa, Homo sapiens
MCKRNLEVMDSVRRGAQLAIEECQYQFRNRRWNCSTLDSLPVFGKVVTQGTREAAFVYAISSAGVAFAVTRACSSGELEKCGCDRTVHGVSPQGFQWSGCSDNIAYGVAFSQSFVDVRERSKGASSSRALMNLHNNEAGRKAILTHMRVECKCHGVSGSCEVKTCWRAVPPFRQVGHALKEKFDGATEVEPRRVGSSRALVPRNAQFKPHTDEDLVYLEPSPDFCEQDMRSGVLGTRGRTCNKTSKAIDGCELLCCGRGFHTAQVELAERCSCKFHWCCFVKCRQCQRLVELHTCR

SEQ ID NO: 69888 - protein, 365 aa, Homo sapiens
MLPPLPSRLGLLLLLLLCPAHVGGLWWAVGSPLVMDPTSICRKARRLAGRQAELCQAEPEVVAELARGARLGVRECQFQFRFRRWNCSSHSKAFGRILQQDIRETAFVFAITAAGASHAVTQACSMGELLQCGCQAPRGRAPPRPSGLPGTPGPPGPAGSPEGSAAWEWGGCGDDVDFGDEKSRLFMDARHKRGRGDIRALVQLHNNEAGRLAVRSHTRTECKCHGLSGSCALRTCWQKLPPFREVGARLLERFHGASRVMGTNDGKALLPAVRTLKPPGRADLLYAADSPDFCAPNRRTGSPGTRGRACNSSAPDLSGCDLLCCGRGHRQESVQLEENCLCRFHWCCVVQCHRCRVRKELSLCL

SEQ ID NO: 69889 - protein, 349 aa, Homo sapiens
MNRKARRCLGHLFLSLGMVYLRIGGFSSVVALGASIICNKIPGLAPRQRAICQSRPDAIIVIGEGSQMGLDECQFQFRNGRWNCSALGERTVFGKELKVGSREAAFTYAIIAAGVAHAITAACTQGNLSDCGCDKEKQGQYHRDEGWKWGGCSADIRYGIGFAKVFVDAREIKQNARTLMNLHNNEAGRKILEENMKLECKCHGVSGSCTTKTCWTTLPQFRELGYVLKDKYNEAVHVEPVRASRNKRPTFLKIKKPLSYRKPMDTDLVYIEKSPNYCEEDPVTGSVGTQGRACNKTAPQASGCDLMCCGRGYNTHQYARVWQCNCKFHWCCYVKCNTCSERTEMYTCK

SEQ ID NO: 69890 - protein, 349 aa, Homo sapiens
MHRNFRKWIFYVFLCFGVLYVKLGALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKVLEDRMQLECKCHGVSGSCTTKTCWTTLPKFREVGHLLKEKYNAAVQVEVVRASRLRQPTFLRIKQLRSYQKPMETDLVYIEKSPNYCEEDAATGSVGTQGRLCNRTSPGADGCDTMCCGRGYNTHQYTKVWQCNCKFHWCCFVKCNTCSERTEVFTCK

SEQ ID NO: 69891 - protein, 353 aa, Homo sapiens
MLLLSPRSALVSVYCPQIFLLLSSGSYLALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKVLEDRMQLECKCHGVSGSCTTKTCWTTLPKFREVGHLLKEKYNAAVQVEVVRASRLRQPTFLRIKQLRSYQKPMETDLVYIEKSPNYCEEDAATGSVGTQGRLCNRTSPGADGCDTMCCGRGYNTHQYTKVWQCNCKFHWCCFVKCNTCSERTEVFTCK

SEQ ID NO: 69892 - protein, 205 aa, Homo sapiens
MHRNFRKWIFYVFLCFGVLYVKLGALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKGLLGQPRVTSSPLFP

SEQ ID NO: 69893 - protein, 333 aa, Homo sapiens
MSAPPFYRALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKVLEDRMQLECKCHGVSGSCTTKTCWTTLPKFREVGHLLKEKYNAAVQVEVVRASRLRQPTFLRIKQLRSYQKPMETDLVYIEKSPNYCEEDAATGSVGTQGRLCNRTSPGADGCDTMCCGRGYNTHQYTKVWQCNCKFHWCCFVKCNTCSERTEVFTCK

SEQ ID NO: 69894 - protein, 57 aa, Homo sapiens
MGINECQYQFRFGRWNCSALGEKTVFGQELRVGSREAAFTYAITAAGVAHAVTAACS

SEQ ID NO: 69895 - protein, 351 aa, Homo sapiens
MFLSKPSVYICLFTCVLQLSHSWSVNNFLMTGPKAYLIYSSSVAAGAQSGIEECKYQFAWDRWNCPERALQLSSHGGLRSANRETAFVHAISSAGVMYTLTRNCSLGDFDNCGCDDSRNGQLGGQGWLWGGCSDNVGFGEAISKQFVDALETGQDARAAMNLHNNEAGRKAVKGTMKRTCKCHGVSGSCTTQTCWLQLPEFREVGAHLKEKYHAALKVDLLQGAGNSAAGRGAIADTFRSISTRELVHLEDSPDYCLENKTLGLLGTEGRECLRRGRALGRWERRSCRRLCGDCGLAVEERRAETVSSCNCKFHWCCAVRCEQCRRRVTKYFCSRAERPRGGAAHKPGRKP

SEQ ID NO: 69896 - protein, 402 aa, Homo sapiens
MDLDRASLDLMIRLLELEQDASSAKLLNEKDMNKIKEKIRRLCETVHNKHLDLENITTGHLAMETLLSLTSKRAGDWFKEELRLLGGLDHIVDKVKECVDHLSRDEDEEKLVASLWGAERCLRVLESVTVHNPENQSYLIAYKDSQLIVSSAKALQHCEELIQQYNRAEDSICLADSKPLPHQNVTNHVGKAVEDCMRAIIGVLLNLTNDNEWGSTKTGEQDGLIGTALNCVLQVPKYLPQEQRFDIRVLLFLERERAAQLAESKTDELIKDAPTTQHDKSGEWQETSGEIQWVSTEKTDGTEEKHKKEEEDEELDLNKALQHAGKHMEDCIVASYTALLLGCLCQESPINVTTVREYLPEGDFSIMTEMLKKFLSFMNLTCAVGTTGQKSISRVIEYLEHC

SEQ ID NO: 69897 - protein, 1190 aa, Homo sapiens
MTSRFGKTYSRKGGNGSSKFDEVFSNKRTTLSTKWGETTFMAKLGQKRPNFKPDIQEIPKKPKVEEESTGDPFGFDSDDESLPVSSKNLAQVKCSSYSESSEAAQLEEVTSVLEANSKISHVVVEDTVVSDKCFPLEDTLLGKEKSTNRIVEDDASISSCNKLITSDKVENFHEEHEKNSHHIHKNADDSTKKPNAETTVASEIKETNDTWNSQFGKRPESPSEISPIKGSVRTGLFEWDNDFEDIRSEDCILSLDSDPLLEMKDDDFKNRLENLNEAIEEDIVQSVLRPTNCRTYCRANKTKSSQGASNFDKLMDGTSQALAKANSESSKDGLNQAKKGGVSCGTSFRGTVGRTRDYTVLHPSCLSVCNVTIQDTMERSMDEFTASTPADLGEAGRLRKKADIATSKTTTRFRPSNTKSKKDVKLEFFGFEDHETGGDEGGSGSSNYKIKYFGFDDLSESEDDEDDDCQVERKTSKKRTKTAPSPSLQPPPESNDNSQDSQSGTNNAENLDFTEDLPGVPESVKKPINKQGDKSKENTRKIFSGPKRSPTKAVYNARHWNHPDSEELPGPPVVKPQSVTVRLSSKEPNQKDDGVFKAPAPPSKVIKTVTIPTQPYQDIVTALKCRREDKELYTVVQHVKHFNDVVEFGENQEFTDDIEYLLSGLKSTQPLNTRCLSVISLATKCAMPSFRMHLRAHGMVAMVFKTLDDSQHHQNLSLCTAALMYILSRDRLNMDLDRASLDLMIRLLELEQDASSAKLLNEKDMNKIKEKIRRLCETVHNKHLDLENITTGHLAMETLLSLTSKRAGDWFKEELRLLGGLDHIVDKVKECVDHLSRDEDEEKLVASLWGAERCLRVLESVTVHNPENQSYLIAYKDSQLIVSSAKALQHCEELIQQYNRAEDSICLADSKPLPHQNVTNHVGKAVEDCMRAIIGVLLNLTNDNEWGSTKTGEQDGLIGTALNCVLQVPKYLPQEQRFDIRVLGLGLLINLVEYSARNRHCLVNMETSCSFDSSICSGEGDDSLRIGGQVHAVQALVQLFLERERAAQLAESKTDELIKDAPTTQHDKSGEWQETSGEIQWVSTEKTDGTEEKHKKEEEDEELDLNKALQHAGKHMEDCIVASYTALLLGCLCQESPINVTTVREYLPEGDFSIMTEMLKKFLSFMNLTCAVGTTGQKSISRVIEYLEHC

SEQ ID NO: 69898 - protein, 1275 aa, Homo sapiens
MVQGPVQTPALTIHRRKRRRSCPPNRASYLPKAESLASLGSHLPALLSRARVPRPPAGRRERERRRRPVAKAPARLRGEYETGVKMTSRFGKTYSRKGGNGSSKFDEVFSNKRTTLSTKWGETTFMAKLGQKRPNFKPDIQEIPKKPKVEEESTGDPFGFDSDDESLPVSSKNLAQVKCSSYSESSEAAQLEEVTSVLEANSKISHVVVEDTVVSDKCFPLEDTLLGKEKSTNRIVEDDASISSCNKLITSDKVENFHEEHEKNSHHIHKNADDSTKKPNAETTVASEIKETNDTWNSQFGKRPESPSEISPIKGSVRTGLFEWDNDFEDIRSEDCILSLDSDPLLEMKDDDFKNRLENLNEAIEEDIVQSVLRPTNCRTYCRANKTKSSQGASNFDKLMDGTSQALAKANSESSKDGLNQAKKGGVSCGTSFRGTVGRTRDYTVLHPSCLSVCNVTIQDTMERSMDEFTASTPADLGEAGRLRKKADIATSKTTTRFRPSNTKSKKDVKLEFFGFEDHETGGDEGGSGSSNYKIKYFGFDDLSESEDDEDDDCQVERKTSKKRTKTAPSPSLQPPPESNDNSQDSQSGTNNAENLDFTEDLPGVPESVKKPINKQGDKSKENTRKIFSGPKRSPTKAVYNARHWNHPDSEELPGPPVVKPQSVTVRLSSKEPNQKDDGVFKAPAPPSKVIKTVTIPTQPYQDIVTALKCRREDKELYTVVQHVKHFNDVVEFGENQEFTDDIEYLLSGLKSTQPLNTRCLSVISLATKCAMPSFRMHLRAHGMVAMVFKTLDDSQHHQNLSLCTAALMYILSRDRLNMDLDRASLDLMIRLLELEQDASSAKLLNEKDMNKIKEKIRRLCETVHNKHLDLENITTGHLAMETLLSLTSKRAGDWFKEELRLLGGLDHIVDKVKECVDHLSRDEDEEKLVASLWGAERCLRVLESVTVHNPENQSYLIAYKDSQLIVSSAKALQHCEELIQQYNRAEDSICLADSKPLPHQNVTNHVGKAVEDCMRAIIGVLLNLTNDNEWGSTKTGEQDGLIGTALNCVLQVPKYLPQEQRFDIRVLGLGLLINLVEYSARNRHCLVNMETSCSFDSSICSGEGDDSLRIGGQVHAVQALVQLFLERERAAQLAESKTDELIKDAPTTQHDKSGEWQETSGEIQWVSTEKTDGTEEKHKKEEEDEELDLNKALQHAGKHMEDCIVASYTALLLGCLCQESPINVTTVREYLPEGDFSIMTEMLKKFLSFMNLTCAVGTTGQKSISRVIEYLEHC

SEQ ID NO: 69899 - protein, 402 aa, Homo sapiens; identical to SEQ ID NO: 69896

SEQ ID NO: 69900 - protein, 1275 aa, Homo sapiens; identical to SEQ ID NO: 69898

SEQ ID NO: 69901 - protein, 502 aa, Homo sapiens
MSGGPMGGRPGGRGAPAVQQNIPSTLLQDHENQRLFEMLGRKCLTLATAVVQLYLALPPGAEHWTKEHCGAVCFVKDNPQKSYFIRLYGLQAGRLLWEQELYSQLVYSTPTPFFHTFAGDDCQAGLNFADEDEAQAFRALVQEKIQKRNQRQSGDRRQLPPPPTPANEERRGGLPPLPLHPGGDQGGPPVGPLSLGLATVDIQNPDITSSRYRGLPAPGPSPADKKRSGKKKISKADIGAPSGFKHVSHVGWDPQNGFDVNNLDPDLRSLFSRAGISEAQLTDAETSKLIYDFIEDQGGLEAVRQEMRRQEPLPPPPPPSRGGNQLPRPPIVGGNKGRSGPLPPVPLGIAPPPPTPRGPPPPGRGGPPPPPPPATGRSGPLPPPPPGAGGPPMPPPPPPPPPPPSSGNGPAPPPLPPALVPAGGLAPGGGRGALLDQIRQGIQLNKTPGAPESSALQPPPQSSEGLVGALMHVMQKRSRAIHSSDEGEDQAGDEDEDDEWDD

SEQ ID NO: 69902 - protein, 217 aa, Homo sapiens
MSGGPMGGRPGGRGAPAVQQNIPSTLLQDHENQRLFEMLGRKCLTLATAVVQLYLALPPGAEHWTKEHCGAVCFVKDNPQKSYFIRLYGLQAGRLLWEQELYSQLVYSTPTPFFHTFAGDDCQAGLNFADEDEAQAFRALVQEKIQKRNQRQSGDRRQLPPPPTPANEERRGGLPPLPLHPGGDQGGPPVGPLSLGLATVDIQNPDITSSRYRGLPA

SEQ ID NO: 69903 - protein, 1555 aa, Homo sapiens
MAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVQQGIQQTAPPQQTVQYSLSQTSTSSEATTAQPVSQPQAPQVLPQVSAGKQSTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 69904 - protein, 2382 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVAQGQSQGQPSSSSLTGVSSSQPIQHPQQQQGIQQTAPPQQTVQYSLSQTSTSSEATTAQPVSQPQAPQVLPQVSAGKQLPVSQPVPTIQGEPQIPVATQPSVVPVHSGAHFLPVGQPLPTPLLPQYPVSQIPISTPHVSTAQTGFSSLPITMAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 69905 - protein, 1975 aa, Homo sapiens
MDIKKKDFCSVFVIINSHCCCCPQKDCINEGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVAQGQSQGQPSSSSLTGVSSSQPIQHPQQQQGIQQTAPPQQTVQYSLSQTSTSSEATTAQPVSQPQAPQVLPQVSAGKQLPVSQPVPTIQGEPQIPVATQPSVVPVHSGAHFLPVGQPLPTPLLPQYPVSQIPISTPHVSTAQTGFSSLPITMAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 69906 - protein, 393 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGMFQVYLGA

SEQ ID NO: 69907 - protein, 2880 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVPRRGRSMSVCVPIFLLLPLCPASLPVLFHPTASTVCTSFSFPPPDCPEETFAEKLSKALESVLPMHSASQRKHRRSSLPSLFVSTPQSMAHPCGGTPTYPESQIFFPTIHERPVSFSPPPTCPPKVAISQRRKSTSFLEAQTHHFQPLLRTVGQSLLPPGGSPTNWTPEAVVMLGTTASRVTGESCEIQVHPMFEPSQVYSDYRPGLVLPEEAHYFIPQEAVYVAGVHYQARVAEQYEGIPYNSSVLSSPMKQIPEQKPVQGGPTSSSVFEFPSGQAFLVGHLQNLRLDSGLGPGSPLSSISAPISTDATRLKFHPVFVPHSAPAVLTHNNESRSNCVFEFHVHTPSSSSGEGGGILPQRVYRNRQVAVDLNQEELPPQSVGLHGYLQPVTEEKHNYHAPELTVSVVEPIGQNWPIGSPEYSSDSSQITSSDPSDFQSPPPTGGAAAPFGSDVSMPFIHLPQTVLQESPLFFCFPQGTTSQQVLTASFSSGGSALHPQAQGQSQGQPSSSSLTGVSSSQPIQHPQQQQGIQQTAPPQQTVQYSLSQTSTSSEATTAQPVSQPQAPQVLPQVSAGKQLPVSQPVPTIQGEPQIPVATQPSVVPVHSGAHFLPVGQPLPTPLLPQYPVSQIPISTPHVSTAQTGFSSLPITMAAGITQPLLTLASSATTAAIPGVSTVVPSQLPTLLQPVTQLPSQVHPQLLQPAVQSMGIPANLGQAAEVPLSSGDVLYQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 69908 - protein, 2134 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVAQGQSQGQPSSSSLTGVSSSQPIQHPQQQGIQQTAPPQQTVQYSLSQTSTSSEATTAQPVSQPQAPQVLPQVSAGKQSTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 69909 - protein, 324 aa, Homo sapiens [sequence omitted]

SEQ ID NO: 69910 - protein, 2642 aa, Homo sapiens
MSGGAAEKQSSTPGSLFLSPPAPAPKNGSSSDSSVGEKLGAAAADAVTGRTEEYRRRRHTMDKDSRGAAATTTTTEHRFFRRSVICDSNATALELPGLPLSLPQPSIPAAVPQSAPPEPHREETVTATATSQVAQQPPAAAAPGEQAVAGPAPSTVPSSTSKDRPVSQPSLVGSKEEPPPARSGSGGGSAKEPQEERSQQQDDIEELETKAVGMSNDGRFLKFDIEIGRGSFKTVYKGLDTETTVEVAWCELQDRKLTKSERQRFKEEAEMLKGLQHPNIVRFYDSWESTVKGKKCIVLVTELMTSGTLKTYLKRFKVMKIKVLRSWCRQILKGLQFLHTRTPPIIHRDLKCDNIFITGPTGSVKIGDLGLATLKRASFAKSVIGTPEFMAPEMYEEKYDESVDVYAFGMCMLEMATSEYPYSECQNAAQIYRRVTSGVKPASFDKVAIPEVKEIIEGCIRQNKDERYSIKDLLNHAFFQEETGVRVELAEEDDGEKIAIKLWLRIEDIKKLKGKYKDNEAIEFSFDLERDVPEDVAQEMVESGYVCEGDHKTMAKAIKDRVSLIKRKREQRQLVREEQEKKKQEESSLKQQVEQSSASQTGIKQLPSASTGIPTASTTSASVSTQVEPEEPEADQHQQLQYQQPSISVLSDGTVDSGQGSSVFTESRVSSQQTVSYGSQHEQAHSTGTVPGHIPSTVQAQSQPHGVYPPSSVPQSMAHPCGGTPTYPESQIFFPTIHERPVSFSPPPTCPPKVAISQRRKSTSFLEAQTHHFQPLLRTVGQSLLPPGGSPTNWTPEAVVMLGTTASRVTGESCEIQVHPMFEPSQVYSDYRPGLVLPEEAHYFIPQEAVYVAGVHYQARVAEQYEGIPYNSSVLSSPMKQIPEQKPVQGGPTSSSVFEFPSGQAFLVGHLQNLRLDSGLGPGSPLSSISAPISTDATRLKFHPVFVPHSAPAVLTHNNESRSNCVFEFHVHTPSSSSGEGGGILPQRVYRNRQVAVDLNQEELPPQSVGLHGYLQPVTEEKHNYHAPELTVSVVEPIGQNWPIGSPEYSSDSSQITSSDPSDFQSPPPTGGAAAPFGSDVSMPFIHLPQTVLQESPLFFCFPQGTTSQQVLTASFSSGGSALHPQAQGQSQGQPSSSSLTGVSSSQPIQHPQQQQGIQQTAPPQQTVQYSLSQTSTSSEATTAQPVSQPQAPQVLPQVSAGKQGFPPRLPPQYPGDSNIAPSSNVASVCIHSTVLSPPMPTEVLATPGYFPTVVQPYVESNLLVPMGGVGGQVQVSQPGGSLAQAPTTSSQQAVLESTQGVSQVAPAEPVAVAQTQATQPTTLASSVDSAHSDVASGMSDGNENVPSSSGRHEGRTTKRHYRKSVRSRSRHEKTSRPKLRILNVSNKGDRVVECQLETHNRKMVTFKFDLDGDNPEEIATIMVNNDFILAIERESFVDQVREIIEKADEMLSEDVSVEPEGDQGLESLQGKDDYGFSGSQKLEGEFKQPIPASSMPQQIGIPTSSLTQVVHSAGRRFIVSPVPESRLRESKVFPSEITDTVAASTAQSPGMNLSHSASSLSLQQAFSELRRAQMTEGPNTAPPNFSHTGPTFPVVPPFLSSIAGVPTTAAATAPVPATSSPPNDISTSVIQSEVTVPTEEGIAGVATSTGVVTSGGLPIPPVSESPVLSSVVSSITIPAVVSISTTSPSLQVPTSTSEIVVSSTALYPSVTVSATSASAGGSTATPGPKPPAVVSQQAAGSTTVGATLTSVSTTTSFPSTASQLCIQLSSSTSTPTLAETVVVSAHSLDKTSHSSTTGLAFSLSAPSSSSSPGAGVSSYISQPGGLHPLVIPSVIASTPILPQAAGPTSTPLLPQVPSIPPLVQPVANVPAVQQTLIHSQPQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPVSTTTSGVKPGTAPSKPPLTKAPVLPVGTELPAGTLPSEQLPPFPGPSLTQSQQPLEDLDAQLRRTLSPEMITVTSAVGPVSMAAPTAITEAGTQPQKGVSQVKEGPVLATSSGAGVFKMGRFQVSVAADGAQKEGKNKSEDAKSVHFESSTSESSVLSSSSPESTLVKPEPNGITIPGISSDVPESAHKTTASEAKSDTGQPTKVGRFQVTTTANKVGRFSVSKTEDKITDTKKEGPVASPPFMDLEQAVLPAVIPKKEKPELSEPSHLNGPSSDPEAAFLSRDVDDGSGSPHSPHQLSSKSLPSQNLSQSLSNSFNSSYMSSDNESDIEDEDLKLELRRLRDKHLKEIQDLQSRQKHEIESLYTKLGKVPPAVIIPPAAPLSGRRRRPTKSKGSKSSRSSSLGNKSPQLSGNLSGQSAASVLHPQQTLHPPGNIPESGQNQLLQPLKPSPSSDNLYSAFTSDGAISVPSLSAPGQGTSSTNTVGATVNSQAAQAQPPAMTSSRKGTFTDDLHKLVDNWARDAMNLSGRRGSKGHMNYEGPGMARKFSAPGQLCISMTSNLGGSAPISAASATSLGHFTKSMCPPQQYGFPATPFGAQWSGTGGPAPQPLGQFQPVGTASLQNFNISNLQKSISNPPGSNLRTT

SEQ ID NO: 69911 - protein, 2297 aa, Homo sapiens
MDGDGGRRDVPGTLMEPGRGAGPAGMAEPRAKAARPGPQRFLRRSVVESDQEEPPGLEAAEAPGPQPPQPLQRRVLLLCKTRRLIAERARGRPAAPAPAALVAQPGAPGAPADAGPEPVGTQEPGPDPIAAAVETAPAPDGGPREEAAATVRKEDEGAAEAKPEPGRTRRDEPEEEEDDEDDLKAVATSLDGRFLKFDIELGRGSFKTVYKGLDTETWVEVAWCELQDRKLTKLERQRFKEEAEMLKGLQHPNIVRFYDFWESSAKGKRCIVLVTELMTSGTLKTYLKRFKVMKPKVLRSWCRQILKGLLFLHTRTPPIIHRDLKCDNIFITGPTGSVKIGDLGLATLKRASFAKSVIGTPEFMAPEMYEEHYDESVDVYAFGMCMLEMATSEYPYSECQNAAQIYRKVTCGIKPASFEKVHDPEIKEIIGECICKNKEERYEIKDLLSHAFFAEDTGVRVELAEEDHGRKSTIALRLWVEDPKKLKGKPKDNGAIEFTFDLEKETPDEVAQEMIESGFFHESDVKIVAKSIRDRVALIQWRRERIWPALQPKEQQDVGSPDKARGPPVPLQVQVTYHAQAGQPGPPEPEEPEADQHLLPPTLPTSATSLASDSTFDSGQGSTVYSDSQSSQQSVMLGSLADAAPSPAQCVCSPPVSEGPVLPQSLPSLGAYQQPTAAPGLPVGSVPAPACPPSLQQHFPDPAMSFAPVLPPPSTPMPTGPGQPAPPGQQPPPLAQPTPLPQVLAPQPVVPLQPVPPHLPPYLAPASQVGAPAQLKPLQMPQAPLQPLAQVPPQMPPIPVVPPITPLAGIDGLPPALPDLPTATVPPVPPPQYFSPAVILPSLAAPLPPASPALPLQAVKLPHPPGAPLAMPCRTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQGPCRGLTLPCLPWRRAACGAVFLSLFSAESAQSKQPPDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTAESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGWTVYHPTSERVTYKSSSKPRARFLSGPVSVSIWSALKRLCLGKEHSSRSSTSSLAPGPEPGPQPALHVQAQVNNSNNKKGTFTDDLHKLVDEWTSKTVGAAQLKPTLNQLKQTQKLQDMEAQAGWAAPGEARAMTAPRAGVGMPRLPPAPGPLSTTVIPGAAPTLSVPTPDGALGTARRNQVWFGLRVPPTACCGHSTQPRGGQRVGSKTASFAASDPVRS

SEQ ID NO: 69912 - protein, 1866 aa, Homo sapiens
MATSEYPYSECQNAAQIYRKVTCGIKPASFEKVHDPEIKEIIGECICKNKEERYEIKDLLSHAFFAEDTGVRVELAEEDHGRKSTIALRLWVEDPKKLKGKPKDNGAIEFTFDLEKETPDEVAQEMIESGFFHESDVKIVAKSIRDRVALIQWRRERIWPALQPKEQQDVGSPDKARGPPVPLQVQVTYHAQAGQPGPPEPEEPEADQHLLPPTLPTSATSLASDSTFDSGQGSTVYSDSQSSQQSVMLGSLADAAPSPAQCVCSPPVSEGPVLPQSLPSLGAYQQPTAAPGLPVGSVPAPACPPSLQQHFPDPAMSFAPVLPPPSTPMPTGPGQPAPPGQQPPPLAQPTPLPQVLAPQPVVPLQPVPPHLPPYLAPASQVGAPAQLKPLQMPQAPLQPLAQVPPQMPPIPVVPPITPLAGIDGLPPALPDLPTATVPPVPPPQYFSPAVILPSLAAPLPPASPALPLQAVKLPHPPGAPLAMPCRTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQGPCRGLTLPCLPWRRAACGAVFLSLFSAESAQSKQPPDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTAESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGWTVYHPTSERVTYKSSSKPRARFLSGPVSVSIWSALKRLCLGKEHSSRSSTSSLAPGPEPGPQPALHVQAQVNNSNNKKGTFTDDLHKLVDEWTSKTVGAAQLKPTLNQLKQTQKLQDMEAQAGWAAPGEARAMTAPRAGVGMPRLPPAPGPLSTTVIPGAAPTLSVPTPDPESEKPD

SEQ ID NO: 69913 - protein, 363 aa, Homo sapiens
MEQGTSSSMTESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATSCRGLLGPSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPKPVWGSLQTARA

SEQ ID NO: 69914 - protein, 779 aa, Homo sapiens
MEPGRGAGPAGMAEPRAKAARPGPQRFLRRSVVESDQEEPPGLEAAEAPGPQPPQPLQRRVLLLCKTRRLIAERARGRPAAPAPAALVAQPGAPGAPADAGPEPVGTQEPGPDPIAAAVETAPAPDGGPREEAAATVRKEDEGAAEAKPEPGRTRRDEPEEEEDDEDDLKAVATSLDGRFLKFDIELGRGSFKTVYKGLDTETWVEVAWCELQDRKLTKLERQRFKEEAEMLKGLQHPNIVRFYDFWESSAKGKRCIVLVTELMTSGTLKTYLKRFKVMKPKVLRSWCRQILKGLLFLHTRTPPIIHRDLKCDNIFITGPTGSVKIGDLGLATLKRASFAKSVIGTPEFMAPEMYEEHYDESVDVYAFGMCMLEMATSEYPYSECQNAAQIYRKVTCGIKPASFEKVHDPEIKEIIGECICKNKEERYEIKDLLSHAFFAEDTGVRVELAEEDHGRKSTIALRLWVEDPKKLKGKPKDNGAIEFTFDLEKETPDEVAQEMIESGFFHESDVKIVAKSIRDRVALIQWRRERIWPALQPKEQQDVGSPDKARGPPVPLQVQVTYHAQAGQPGPPEPEEPEADQHLLPPTLPTSATSLASDSTFDSGQGSTVYSDSQSSQQSVMLGSLADAAPSPAQCVCSPPVSEGPVLPQSLPSLGAYQQPTAAPPPLAQPTPLPQVLAPQPVVPLQPVPPHLPPYLAPASQVGAPAQLKPLQMPQAPLQPLAQVPPQMPPIPVVPPITPLAGIDGLPPALPDLPTATVPPVPPPQYFSPAVILPSLAA

SEQ ID NO: 69915 - protein, 2217 aa, Homo sapiens
MDGDGGRRDVPGTLMEPGRGAGPAGMAEPRAKAARPGPQRFLRRSVVESDQEEPPGLEAAEAPGPQPPQPLQRRVLLLCKTRRLIAERARGRPAAPAPAALVAQPGAPGAPADAGPEPVGTQEPGPDPIAAAVETAPAPDGGPREEAAATVRKEDEGAAEAKPEPGRTRRDEPEEEEDDEDDLKAVATSLDGRFLKFDIELGRGSFKTVYKGLDTETWVEVAWCELQDRKLTKLERQRFKEEAEMLKGLQHPNIVRFYDFWESSAKGKRCIVLVTELMTSGTLKTYLKRFKVMKPKVLRSWCRQILKGLLFLHTRTPPIIHRDLKCDNIFITGPTGSVKIGDLGLATLKRASFAKSVIGTPEFMAPEMYEEHYDESVDVYAFGMCMLEMATSEYPYSECQNAAQIYRKVTCGIKPASFEKVHDPEIKEIIGECICKNKEERYEIKDLLSHAFFAEDTGVRVELAEEDHGRKSTIALRLWVEDPKKLKGKPKDNGAIEFTFDLEKETPDEVAQEMIESGFFHESDVKIVAKSIRDRVALIQWRRERIWPALQPKEQQDVGSPDKARGPPVPLQVQVTYHAQAGQPGPPEPEEPEADQHLLPPTLPTSATSLASDSTFDSGQGSTVYSDSQSSQQSVMLGSLADAAPSPAQCVCSPPVSEGPVLPQSLPSLGAYQQPTAAPGLPVGSVPAPACPPSLQQHFPDPAMSFAPVLPPPSTPMPTGPGQPAPPGQQPPPLAQPTPLPQVLAPQPVVPLQPVPPHLPPYLAPASQVGAPAQLKPLQMPQAPLQPLAQVPPQMPPIPVVPPITPLAGIDGLPPALPDLPTATVPPVPPPQYFSPAVILPSLAAPLPPASPALPLQAVKLPHPPGAPLAMPCRTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTAESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGWTVYHPTSERVTYKSSSKPRARFLSGPVSVSIWSALKRLCLGKEHSSRSSTSSLAPGPEPGPQPALHVQAQVNNSNNKKGTFTDDLHKLVDEWTSKTVGAAQLKPTLNQLKQTQKLQDMEAQAGWAAPGEARAMTAPRAGVGMPRLPPAPGPLSTTVIPGAAPTLSVPTPDPESEKPD

SEQ ID NO: 69916 - protein, 1836 aa, Homo sapiens
MATSEYPYSECQNAAQIYRKVTCGIKPASFEKVHDPEIKEIIGECICKNKEERYEIKDLLSHAFFAEDTGVRVELAEEDHGRKSTIALRLWVEDPKKLKGKPKDNGAIEFTFDLEKETPDEVAQEMIESGFFHESDVKIVAKSIRDRVALIQWRRERIWPALQPKEQQDVGSPDKARGPPVPLQVQVTYHAQAGQPGPPEPEEPEADQHLLPPTLPTSATSLASDSTFDSGQGSTVYSDSQSSQQSVMLGSLADAAPSPAQCVCSPPVSEGPVLPQSLPSLGAYQQPTAAPGLPVGSVPAPACPPSLQQHFPDPAMSFAPVLPPPSTPMPTGPGQPAPPGQQPPPLAQPTPLPQVLAPQPVVPLQPVPPHLPPYLAPASQVGAPAQLKPLQMPQAPLQPLAQVPPQMPPIPVVPPITPLAGIDGLPPALPDLPTATVPPVPPPQYFSPAVILPSLAAPLPPASPALPLQAVKLPHPPGAPLAMPCRTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTAESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGWTVYHPTSERVTYKSSSKPRARFLSGPVSVSIWSALKRLCLGKEHSSRSSTSSLAPGPEPGPQPALHVQAQVNNSNNKKGTFTDDLHKLVDEWTSKTVGAAQLKPTLNQLKQTQKLQDMEAQAGWAAPGEARAMTAPRAGVGMPRLPPAPGPLSTTVIPGAAPTLSVPTPGSCGPRAVSTPTSYT

SEQ ID NO: 69917 - protein, 1800 aa, Homo sapiens
MATDSGDPASTEDSEKPDGISFENRVPQVAATLTVEARLKEKNSTFSASGETVERKRFFRKSVEMTEDDKVAESSPKDERIKAAMNIPRVDKLPSNVLRGGQEVKYEQCSKSTSEISKDCFKEKNEKEMEEEAEMKAVATSPSGRFLKFDIELGRGAFKTVYKGLDTETWVEVAWCELQDRKLTKAEQQRFKEEAEMLKGLQHPNIVRFYDSWESILKGKKCIVLVTELMTSGTLKTYLKRFKVMKPKVLRSWCRQILKGLQFLHTRTPPIIHRDLKCDNIFITGPTGSVKIGDLGLATLMRTSFAKSVIGTPEFMAPEMYEEHYDESVDVYAFGMCMLEMATSEYPYSECQNAAQIYRKVTSGIKPASFNKVTDPEVKEIIEGCIRQNKSERLSIRDLLNHAFFAEDTGLRVELAEEDDCSNSSLALRLWVEDPKKLKGKHKDNEAIEFSFNLETDTPEEVAYEMVKSGFFHESDSKAVAKSIRDRVTPIKKTREKKPAGCLEERRDSQCKSMGNVFPQPQNTTLPLAPAQQTGAECEETEVDQHVRQQLLQRKPQQHCSSVTGDNLSEAGAASVIHSDTSSQPSVAYSSNQTMGSQMVSNIPQAEVNVPGQIYSSQQLVGHYQQVSGLQKHSKLTQPQILPLVQGQSTVLPVHVLGPTVVSQPQVSPLTVQKVPQIKPVSQPVGAEQQAALLKPDLVRSLNQDVATTKENVSSPDNPSGNGKQDRIKQRRASCPRPEKGTKFQLTVLQVSTSGDNMVECQLETHNNKMVTFKFDVDGDAPEDIADYMVEDNFVLESEKEKFVEELRAIVGQAQEILHVHFATERATGVDSITVDSNSSQTGSSEQVQINSTSTQTSNESAPQSSPVGRWRFCINQTIRNRETQSPPSLQHSMSAVPGRHPLPSPKNTSNKEISRDTLLTIENNPCHRALFTSKSEHKDVVDGKISECASVETKQPAILYQVEDNRQIMAPVTNSSSYSTTSVRAVPAECEGLTKQASIFIPVYPCHQTASQADALMSHPGESTQTSGNSLTTLAFDQKPQTLSVQQPAMDAEFISQEGETTVNTEASSPKTVIPTQTPGLEPTTLQPTTVLESDGERPPKLEFADNRIKTLDEKLRNLLYQEHSISSIYPESQKDTQSIDSPFSSSAEDTLSCPVTEVIAISHCGIKDSPVQSPNFQQTGSKLLSNVAASQPANISVFKRDLNVITSVPSELCLHEMSSDASLPGDPEAYPAAVSSGGAIHLQTGGGYFGLSFTCPSLKNPISKKSWTRKLKSWAYRLRQSTSFFKRSKVRQVETEEMRSAIAPDPIPLTRESTADTRALNRCKAMSGSFQRGRFQVITIPQQQSAKMTSFGIEHISVFSETNHSSEEAFIKTAKSQLVEIEPATQNPKTSFSYEKLQALQETCKENKGVPKQGDNFLSFSAACETDVSSVTPEKEFEETSATGSSMQSGSELLLKEREILTAGKQPSSDSEFSASLAGSGKSVAKTGPESNQCLPHHEEQAYAQTQSSLFYSPSSPMSSDDESEIEDEDLKVELQRLREKHIQEVVNLQTQQNKELQELYERLRSIKDSKTQSTEIPLPPASPRRPRSFKSKLRSRPQSLTHVDNGIVATGKSCLINELENPLCVESNAASCQQSPASKKGMFTDDLHKLVDDWTKEAVGNSLIKPSLNQLKQSQHKLETENWNKVSENTPSTMGYTSTWISSLSQIRGAVPTSLPQGLSLPSFPGPLSSYGMPHVCQYNAVAGAGYPVQWVGISGTTQQSVVIPAQSGGPFQPGMNMQAFPTSSVQNPATIPPGPK

SEQ ID NO: 69918 - protein, 1800 aa, Homo sapiens; identical to SEQ ID NO: 69917

SEQ ID NO: 69919 - protein, 1743 aa, Homo sapiens
MATDSGDPASTEDSEKPDGISFENRVPQVAATLTVEARLKEKNSTFSASGETVERKRFFRKSVEMTEDDKVAESSPKDERIKAAMNIPRVDKLPSNVLRGGQEVKYEQCSKSTSEISKDCFKEKNEKEMEEEAEMKAVATSPSGRFLKFDIELGRGAFKTVYKGLDTETWVEVAWCELQDRKLTKAEQQRFKEEAEMLKGLQHPNIVRFYDSWESILKGKKCIVLVTELMTSGTLKTYLKRFKVMKPKVLRSWCRQILKGLQFLHTRTPPIIHRDLKCDNIFITGPTGSVKIGDLGLATLMRTSFAKSVIGTPEFMAPEMYEEHYDESVDVYAFGMCMLEMATSEYPYSECQNAAQIYRKVTSGIKPASFNKVTDPEVKEIIEGCIRQNKSERLSIRDLLNHAFFAEDTGLRVELAEEDDCSNSSLALRLWVEDPKKLKGKHKDNEAIEFSFNLETDTPEEVAYEMVKSGFFHESDSKAVAKSIRDRVTPIKKTREKKPAGCLEERRDSQCKSMGNVFPQPQNTTLPLAPAQQTGAECEETEVDQHVRQQLLQRKPQQHCSSVTGDNLSEAGAASVIHSDTSSQPSVAYSSNQTMGSQMVSNIPQAEVNVPGQIYSSQQLVGHYQQVSGLQKHSKLTQPQILPLVQGQSTVLPVHVLGPTVVSQPQVSPLTVQKVPQIKPVSQPVGAEQQAALLKPDLVRSLNQDVATTKENVSSPDNPSGNGKQDRIKQRRASCPRPEKGTKFQLTVLQVSTSGDNMVECQLETHNNKMVTFKFDVDGDAPEDIADYMVEDNFVLESEKEKFVEELRAIVGQAQEILHVHFATERATGVDSITVDSNSSQTGSSEQVQINSTSTQTSNESAPQSSPVGRWRFCINQTIRNRETQSPPSLQHSMSAVPGRHPLPSPKNTSNKEISRDTLLTIENNPCHRALFTSKSEHKDVVDGKISECASVETKQPAILYQVEDNRQIMAPVTNSSSYSTTSVRAVPAECEGLTKQASIFIPVYPCHQTASQADALMSHPGESTQTSGNSLTTLAFDQKPQTLSVQQPAMDAEFISQEGETTVNTEASSPKTVIPTQTPGLEPTTLQPTTVLESDGERPPKLEFADNRIKTLDEKLRNLLYQEHSISSIYPESQKDTQSIDSPFSSSAEDTLSCPVTEVIAISHCGIKDSPVQSPNFQQTGSKLLSNVAASQPANISVFKRDLNVITSVPSELCLHEMSSDASLPGDPEAYPAAVSSGGAIHLQTGVETEEMRSAIAPDPIPLTRESTADTRALNRCKAMSGSFQRGRFQVITIPQQQSAKMTSFGIEHISVFSETNHSSEEAFIKTAKSQLVEIEPATQNPKTSFSYEKLQALQETCKENKGVPKQGDNFLSFSAACETDVSSVTPEKEFEETSATGSSMQSGSELLLKEREILTAGKQPSSDSEFSASLAGSGKSVAKTGPESNQCLPHHEEQAYAQTQSSLFYSPSSPMSSDDESEIEDEDLKVELQRLREKHIQEVVNLQTQQNKELQELYERLRSIKDSKTQSTEIPLPPASPRRPRSFKSKLRSRPQSLTHVDNGIVATDPLCVESNAASCQQSPASKKGMFTDDLHKLVDDWTKEAVGNSLIKPSLNQLKQSQHKLETENWNKVSENTPSTMGYTSTWISSLSQIRGAVPTSLPQGLSLPSFPGPLSSYGMPHVCQYNAVAGAGYPVQWVGISGTTQQSVVIPAQSGGPFQPGMNMQAFPTSSVQNPATIPPGPK

SEQ ID NO: 69920 - protein, 165 aa, Homo sapiens
MATDSGDPASTEDSEKPDGISFENRVPQVAATLTVEARLKEKNSTFSASGETVERKRFFRKSVEMTEDDKVAESSPKDERIKAAMNIPRVDKLPSNVLRGGQEVKYEQCSKSTSEISKDCFKEKNEKEMEEEAEMKAVATSPSGRFLKFDIELGRGAFKTVYKGL

SEQ ID NO: 69921 - protein, 1243 aa, Homo sapiens
MLASPATETTVLMSQTEADLALRPPPPLGTAGQPRLGPPPRRARRFSGKAEPRPRSSRLSRRSSVDLGLLSSWSLPASPAPDPPDPPDSAGPGPARSPPPSSKEPPEGTWTEGAPVKAAEDSARPELPDSAVGPGSREPLRVPEAVALERRREQEEKEDMETQAVATSPDGRYLKFDIEIGRGSFKTVYRGLDTDTTVEVAWCELQTRKLSRAERQRFSEEVEMLKGLQHPNIVRFYDSWKSVLRGQVCIVLVTELMTSGTLKTYLRRFREMKPRVLQRWSRQILRGLHFLHSRVPPILHRDLKCDNVFITGPTGSVKIGDLGLATLKRASFAKSVIGTPEFMAPEMYEEKYDEAVDVYAFGMCMLEMATSEYPYSECQNAAQIYRKVTSGRKPNSFHKVKIPEVKEIIEGCIRTDKNERFTIQDLLAHAFFREERGVHVELAEEDDGEKPGLKLWLRMEDARRGGRPRDNQAIEFLFQLGRDAAEEVAQEMVALGLVCEADYQPVARAVRERVAAIQRKREKLRKARELEALPPEPGPPPATVPMAPGPPSVFPPEPEEPEADQHQPFLFRHASYSSTTSDCETDGYLSSSGFLDASDPALQPPGGVPSSLAESHLCLPSAFALSIPRSGPGSDFSPGDSYASDAASGLSDVGEGMGQMRRPPGRNLRRRPRSRLRVTSVSDQNDRVVECQLQTHNSKMVTFRFDLDGDSPEEIAAAMVYNEFILPSERDGFLRRIREIIQRVETLLKRDTGPMEAAEDTLSPQEEPAPLPALPVPLPDPSNEELQSSTSLEHRSWTAFSTSSSSPGTPLSPGNPFSPGTPISPGPIFPITSPPCHPSPSPFSPISSQVSSNPSPHPTSSPLPFSSSTPEFPVPLSQCPWSSLPTTSPPTFSPTCSQVTLSSPFFPPCPSTSSFPSTTAAPLLSLASAFSLAVMTVAQSLLSPSPGLLSQSPPAPPSPLPSLPLPPPVAPGGQESPSPHTAEVESEASPPPARPLPGEARLAPISEEGKPQLVGRFQVTSSKEPAEPLPLQPTSPTLSGSPKPSTPQLTSESSDTEDSAGGGPETREALAESDRAAEGLGAGVEEEGDDGKEPQVGGSPQPLSHPSPVWMNYSYSSLCLSSEESESSGEDEEFWAELQSLRQKHLSEVETLQTLQKKEIEDLYSRLGKQPPPGIVAPAAMLSSRQRRLSKGSFPTSRRNSLQRSEPPGPGIMRRNSLSGSSTGSQEQRASKGVTFAGDVGRM

SEQ ID NO: 69922 - protein, 663 aa, Homo sapiens
MRRRQQGAAGGNFPVGGSFPEDVSPHQDSGYAPSPRYLRRFREMKPRVLQRWSRQILRGLHFLHSRVPPILHRDLKCDNVFITGPTGSVKIGDLGLATLKRASFAKSVIGTPEFMAPEMYEEKYDEAVDVYAFGMCMLEMATSEYPYSECQNAAQIYRKVTSGRKPNSFHKVKIPEVKEIIEGCIRTDKNERFTIQDLLAHAFFREERGVHVELAEEDDGEKPGLKLWLRMEDARRGGRPRDNQAIEFLFQLGRDAAEEVAQEMVALGLVCEADYQPVARAVRERVAAIQRKREKLRKARELEALPPEPGPPPATVPMAPGPPSVFPPEPEEPEADQHQPFLFRHASYSSTTSDCETDGYLSSSGFLDASDPALQPPGGVPSSLAESHLCLPSAFALSIPRSGPGSDFSPGDSYASDAASGLSDVGEGMGQMRRPPGRNLRRRPRSRLRVTSVSDQNDRVVECQLQTHNSKMVTFRFDLDGDSPEEIAAAMVYNEFILPSERDGFLRRIREIIQRVETLLKRDTGPMEAAEDTLSPQEEPAPLPALPVPLPDPSNEELQSSTSLEHRSWTAFSTSSSSPGTPLSPGNPFSPGTPISPGPIALQRESRSFSLQRAQIQRTVLEAGQRPGKLWLRATVQLRVWGLELRRKEMMGRNPKLGAAPNP

SEQ ID NO: 69923 - protein, 156 aa, Homo sapiens
MGQMRRPPGRNLRRRPRSRLRVTSVSDQNDRVVECQLQTHNSKMVTFRFDLDGDSPEEIAAAMVYNEFILPSERDGFLRRIREIIQRVETLLKRDTGPMEAAEDTLSPQVRPLGGHFQGKWTLCSRVYYSLPSAVPLDLTPLHLWDPKTVALFFFF

SEQ ID NO: 69924 - protein, 280 aa, Homo sapiens
MRWFLPWTLAAVTAAAASTVLATALSPAPTTMDFTPAPLEDTSSRPQFCKWPCECPPSPPRCPLGVSLITDGCECCKMCAQQLGDNCTEAAICDPHRGLYCDYSGDRPRYAIGVCAHAVGEVEAWHRNCIAYTSPWSPCSTSCGLGVSTRISNVNAQCWPEQESRLCNLRPCDVDIHTLIKAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 69925 - protein, 367 aa, Homo sapiens
MRWFLPWTLAAVTAAAASTVLATALSPAPTTMDFTPAPLEDTSSRPQFCKWPCECPPSPPRCPLGVSLITDGCECCKMCAQQLGDNCTEAAICDPHRGLYCDYSGDRPRYAIGVCAQVVGVGCVLDGVRYNNGQSFQPNCKYNCTCIDGAVGCTPLCLRVRPPRLWCPHPRRVSIPGHCCEQWVCEDDAKRPRKTAPRDTGAFDAVGEVEAWHRNCIAYTSPWSPCSTSCGLGVSTRISNVNAQCWPEQESRLCNLRPCDVDIHTLIKAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 69926 - protein, 195 aa, Homo sapiens
MPVPLTSRHEVVPALDAGSSDSSSRQHRPGHDAVGEVEAWHRNCIAYTSPWSPCSTSCGLGVSTRISNVNAQCWPEQESRLCNLRPCDVDIHTLIKAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 69927 - protein, 155 aa, Homo sapiens
MRWFLPWTLAAVTAAAASTVLATALSPAPTTMDFTPAPLEDTSSRPQFCKWPCECPPSPPRCPLGVSLITDGCECCKMCAQQLGDNCTEAAICDPHRGLYCDYSGDRPRYAIGVCARREEVSGCVPARGIHELHTCGLHQHTLLSTQVLWSLHGQ

SEQ ID NO: 69928 - protein, 122 aa, Homo sapiens
MRWFLPWTLAAVTAAAASTVLATAGKKCLAVYQPEASMNFTLAGCISTRSYQPKYCGVCMDNRCCIPYKSKTIDVSFQCPDGLGFSRQVLWINACFCNLSCRNPNDIFADLESYPDFSEIAN

SEQ ID NO: 69929 - protein, 250 aa, Homo sapiens
MRGTPKTHLLAFSLLCLLSKVRTQLCPTPCTCPWPPPRCPLGVPLVLDGCGCCRVCARRLGEPCDQLHVCDASQGLVCQPGAGPGGRGALCLLAEDDSSCEVNGRLYREGETFQPHCSIRCRCEDGGFTCVPLCSEDVRLPSWDCPHPRRVEVLGKCCPEWVCGQGGGLGTQPLPAQGPQFSGLVSSLPPGVPCPEWSTAWGPCSTTCGLGMATRVSNQNRFCRLETQRRLCLSRPCPPSRGRSPQNSAF

SEQ ID NO: 69930 - protein, 218 aa, Homo sapiens
MRGTPKTHLLAFSLLCLLSKVRTQLCPTPCTCPWPPPRCPLGVPLVLDGCGCCRVCARRLGEPCDQLHVCDASQGLVCQPGAGPGGRGALCLCKQDPSFLALSLPCPLVSPAQNGARPGDPARPPVGWAWPPGCPTRTASADWRPSAACACPGPAHPPGVAVHKTVPSRAGLGMGTRCPPSPAGGPVPGPWADGRWSVPRPLAAGNTLAWVHHAEHQY

SEQ ID NO: 69931 - protein, 250 aa, Homo sapiens; identical to SEQ ID NO: 69929

SEQ ID NO: 69932 - protein, 354 aa, Homo sapiens
MQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPAYRNLPLIWKKKCLVQATKWTPCSRTCGMGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 69933 - protein, 372 aa, Homo sapiens
MNKRRLLYPSGWLHGPSDMQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPAYRNLPLIWKKKCLVQATKWTPCSRTCGMGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 69934 - protein, 331 aa, Homo sapiens
MKISRGRVCLESENKDAGVAGRKQFCHWPCKCPQQKPRCPPGVSLVRDGCGCCKICAKQPGEICNEADLCDPHKGLYCDYSVDRPRYETGVCACKSVGCEFNQVHYHNGQVFQPNPLFSCLCVSGAIGCTPLFIPKLAGSHCSGAKGGKKSDQSNCSLEPLLQQLSTSYKTMPAYRNLPLIWKKKCLVQATKWTPCSRTCGMGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 69935 - protein, 354 aa, Homo sapiens; identical to SEQ ID NO: 69932

SEQ ID NO: 69936 - protein, 230 aa, Homo sapiens
MQGLLFSTLLLAGLAQFCCRVQGTGPLDTTPEGRPGEVSDAPQRKQFCHWPCKCPQQKPRCPPGVSLVRDGCGCCKICAKQPGEICNEADLCDPHKGLYCDYSVDRPRYETGVCAYLVAVGCEFNQVHYHNGQVFQPNPLFSCLCVSGAIGCTPLFIPKLAGSHCSGAKGGKKSDQSNCSLEPLLQQLSTSYKTMPAYRNLPLIWKKNVLCKQQNGLPAPEHVGWEYLTG

SEQ ID NO: 69937 - protein, 130 aa, Homo sapiens
MGISNRVTNENSNCEMRKEKRLCYIQPCDSNILKTIKIPKGKTCQPTFQLSKAEKFVFSGCSSTQSYKPTFCGICLDKRCCIPNKSKMITIQFDCPNEGSFKWKMLWITSCVCQRNCREPGDIFSELKIL

SEQ ID NO: 69938 - protein, 541 aa, Homo sapiens
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGDLGVHSGEELQLTTTITHVDGPTEIYKLTRKEAQE

SEQ ID NO: 69939 - protein, 543 aa, Homo sapiens
MAGAIIENMSTKKLCIVGGILLVFQIIAFLVGGLIGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGMQLPCKSREDCALFVSELYQELFSASKYSFINDNAASGI

SEQ ID NO: 69940 - protein, 450 aa, Homo sapiens
MAGAIIENMSTKKLCIVGGILLVFQIIAFLVGGLIGENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGDLGVHSGEELQLTTTITHVDGPTEIYKLTRKEAQE

SEQ ID NO: 69941 - protein, 545 aa, Homo sapiens
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGMQLPCKSREDCALFVSELYQELFSASKYSFINDNAASGI

SEQ ID NO: 69942 - protein, 713 aa, Homo sapiens
MAGSFCWRMLGLVSKVGNRARCFSSMAASEEELLDFSGSELQFNSCSLHLSLHPFFNFLLGIHSCFVCKESKTDVKRCVVTQCGKFYHEACVKKYPLTVFESRGFRCPLHSCVSCHASNPSNPRPSKGKMMRCVRCPVAYHSGDACLAAGCSVIASNSIICTAHFTARKGKRHHAHVNVSWCFVCSKGGSLLCCESCPAAFHPDCLNIEMPDGSWFCNDCRAGKKLHFQDIIWVKLGNYRWWPAEVCHPKNVPPNIQKMKHEIGEFPVFFFGSKDYYWTHQARVFPYMEGDRGSRYQGVRGIGRVFKNALQEAEARFREIKLQREARETQESERKPPPYKHIKVNKPYGKVQIYTADISEIPKCNCKPTDENPCGFDSECLNRMLMFECHPQVCPAGEFCQNQCFTKRQYPETKIIKTDGKGWGLVAKRDIRKGEFVNEYVGELIDEEECMARIKHAHENDITHFYMLTIDKDRIIDAGPKGNYSRFMNHSCQPNCETLKWTVNGDTRVGLFAVCDIPAGTELTFNYNLDCLGNEKTVCRCGASNCSGFLGDRPKTSTTLSSEEKGKKTKKKTRRRRAKGEGKRQSEDECFRCGDGGQLVLCDRKFCTKAYHLSCLGLGKRPFGKWECPWHHCDVCGKPSTSFCHLCPNSFCKEHQDGTAFSCTPDGRSYCCEHDLGAASVRSTKTEKPPPEPGKPKGKRRRRRGWRRVTEGK

SEQ ID NO: 69943 - protein, 1365 aa, Homo sapiens
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVREECIPMKRRRRAKLCSSAETLESHPDIGKSTPQKTAEADPRRGVGSPPGRKKTTVSMPRSRKGDAASQFLVFCQKHRDEVVAEHPDASGEEIEELLRSQWSLLSEKQRARYNTKFALVAPVQAEEDSGNVNGKKRNHTKRIQDPTEDAEAEDTPRKRLRTDKHSLRKRDTITDKTARTSSYKAMEAASSLKSQAATKNLSDACKPLKKRNRASTAASSALGFSKSSSPSASLTENEVSDSPGDEPSESPYESADETQTEVSVSSKKSERGVTAKKEYVCQLCEKPGSLLLCEGPCCGAFHLACLGLSRRPEGRFTCSECASGIHSCFVCKESKTDVKRCVVTQCGKFYHEACVKKYPLTVFESRGFRCPLHSCVSCHASNPSNPRPSKGKMMRCVRCPVAYHSGDACLAAGCSVIASNSIICTAHFTARKGKRHHAHVNVSWCFVCSKGGSLLCCESCPAAFHPDCLNIEMPDGSWFCNDCRAGKKLHFQDIIWVKLGNYRWWPAEVCHPKNVPPNIQKMKHEIGEFPVFFFGSKDYYWTHQARVFPYMEGDRGSRYQGVRGIGRVFKNALQEAEARFREIKLQREARETQESERKPPPYKHIKVNKPYGKVQIYTADISEIPKCNCKPTDENPCGFDSECLNRMLMFECHPQVCPAGEFCQNQCFTKRQYPETKIIKTDGKGWGLVAKRDIRKGEFVNEYVGELIDEEECMARIKHAHENDITHFYMLTIDKDRIIDAGPKGNYSRFMNHSCQPNCETLKWTVNGDTRVGLFAVCDIPAGTELTFNYNLDCLGNEKTVCRCGASNCSGFLGDRPKTSTTLSSEEKGKKTKKKTRRRRAKGEGKRQSEDECFRCGDGGQLVLCDRKFCTKAYHLSCLGLGKRPFGKWECPWHHCDVCGKPSTSFCHLCPNSFCKEHQDGTAFSCTPDGRSYCCEHDLGAASVRSTKTEKPPPEPGKPKGKRRRRRGWRRVTEGK

SEQ ID NO: 69944 - protein, 1365 aa, Homo sapiens; identical to SEQ ID NO: 69943

SEQ ID NO: 69945 - protein, 1365 aa, Homo sapiens; identical to SEQ ID NO: 69943

SEQ ID NO: 69946 - protein, 647 aa, Homo sapiens
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVREECIPMKRRRRAKLCSSAETLESHPDIGKSTPQKTAEADPRRGVGSPPGRKKTTVSMPRSRKGDAASQFLVFCQKHRDEVVAEHPDASGEEIEELLRSQWSLLSEKQRARYNTKFALVAPVQAEEDSGNVNGKKRNHTKRIQDPTEDAEAEDTPRKRLRTDKHSLRKRDTITDKTARTSSYKAMEAASSLKSQAATKNLSDACKPLKKRNRASTAASSALGFSKSSSPSASLTENELLWEPTPVKLDLNPAALYCT

SEQ ID NO: 69947 - protein, 629 aa, Homo sapiens
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVREECIPMKRRRRAKLCSSAETLESHPDIGKSTPQKTAEADPRRGVGSPPGRKKTTVSMPRSRKGDAASQFLVFCQKHRDEVVAEHPDASGEEIEELLRSQWSLLSEKQRARYNTKFALVAPVQAEEDSGNVNGKKRNHTKRIQDPTEDAEAEDTPRKRLRTDKHSLRKRDTITDKTARTSSYKAMEAASSLKSQAATKNLSDACKPLKKRNRASTAASSALGFSKSSSPSASLTENEVK

SEQ ID NO: 69948 - protein, 273 aa, Homo sapiens
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGIFKSKKFEHLKTSQIVLKD

SEQ ID NO: 69949 - protein, 647 aa, Homo sapiens; identical to SEQ ID NO: 69946

SEQ ID NO: 69950 - protein, 37 aa, Homo sapiens
MEFSIKQSPLSVQSVVKCIKMKQAPEILGSANGKTPS

SEQ ID NO: 69951 - protein, 1365 aa, Homo sapiens; identical to SEQ ID NO: 69943

SEQ ID NO: 69952 - protein, 392 aa, Homo sapiens
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVRE

SEQ ID NO: 69953 - protein, 629 aa, Homo sapiens; identical to SEQ ID NO: 69947

SEQ ID NO: 69954 - protein, 199 aa, Homo sapiens
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKK

SEQ ID NO: 69955 - protein, 645 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGSADRGVQGSVRFSDSSVSAAIEETVD

SEQ ID NO: 69956 - protein, 1437 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGASEISDSCKPLKKRSRASTDVEMTSSAYRDTSDSDSRGLSDLQVGFGKQVDSPSATADADVSDVQSMDSSLSRRGTGMSKKDTVCQICESSGDSLIPCEGECCKHFHLECLGLASLPDSKFICMECKTGQHPCFSCKVSGKDVKRCSVGACGKFYHEACVRKFPTAIFESKGFRCPQHCCSACSMEKDIHKASKGRMMRCLRCPVAYHSGDACIAAGSMLVSSYILICSNHSKRSSNSSAVNVGFCFVCARGLIVQDHSDPMFSSYAYKSHYLLNESNRAELMKLPMIPSSSASKKKCEKGGRLLCCESCPASFHPECLSIEMPEGCWNCNDCKAGKKLHYKQIVWVKLGNYRWWPAEICNPRSVPLNIQGLKHDLGDFPVFFFGSHDYYWVHQGRVFPYVEGDKSFAEGQTSINKTFKKALEEAAKRFQELKAQRESKEALEIEKNSRKPPPYKHIKANKVIGKVQIQVADLSEIPRCNCKPADENPCGLESECLNRMLQYECHPQVCPAGDRCQNQCFTKRLYPDAEIIKTERRGWGLRTKRSIKKGEFVNEYVGELIDEEECRLRIKRAHENSVTNFYMLTVTKDRIIDAGPKGNYSRFMNHSCNPNCETQKWTVNGDVRVGLFALCDIPAGMELTFNYNLDCLGNGRTECHCGADNCSGFLGVRPKSACASTNEEKAKNAKLKQKRRKIKTEPKQMHEDYCFQCGDGGELVMCDKKDCPKAYHLLCLNLTQPPYGKWECPWHQCDECSSAAVSFCEFCPHSFCKDHEKGALVPSALEGRLCCSEHDPMAPVSPEYWSKIKCKWESQDHGEEVKE

SEQ ID NO: 69957 - protein, 1388 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGASEISDSCKPLKKRSRASTDVEMTSSAYRDTSDSDSRGLSDLQVGFGKQVDSPSATADADVSDVQSMDSSLSRRGTGMSKKDTVCQICESSGDSLIPCEGECCKHFHLECLGLASLPDSKFICMECKTGQHPCFSCKVSGKDVKRCSVGACGKFYHEACVRKFPTAIFESKGFRCPQHCCSACSMEKDIHKASKGRMMRCLRCPVAYHSGDACIAAGSMLVSSYILICSNHSKRSSNSSAVNVGFCFVCARGGRLLCCESCPASFHPECLSIEMPEGCWNCNDCKAGKKLHYKQIVWVKLGNYRWWPAEICNPRSVPLNIQGLKHDLGDFPVFFFGSHDYYWVHQGRVFPYVEGDKSFAEGQTSINKTFKKALEEAAKRFQELKAQRESKEALEIEKNSRKPPPYKHIKANKVIGKVQIQVADLSEIPRCNCKPADENPCGLESECLNRMLQYECHPQVCPAGDRCQNQCFTKRLYPDAEIIKTERRGWGLRTKRSIKKGEFVNEYVGELIDEEECRLRIKRAHENSVTNFYMLTVTKDRIIDAGPKGNYSRFMNHSCNPNCETQKWTVNGDVRVGLFALCDIPAGMELTFNYNLDCLGNGRTECHCGADNCSGFLGVRPKSACASTNEEKAKNAKLKQKRRKIKTEPKQMHEDYCFQCGDGGELVMCDKKDCPKAYHLLCLNLTQPPYGKWECPWHQCDECSSAAVSFCEFCPHSFCKDHEKGALVPSALEGRLCCSEHDPMAPVSPEYWSKIKCKWESQDHGEEVKE

SEQ ID NO: 69958 - protein, 1374 aa, Homo sapiens
MDFSFSFMQGIMGNTIQQPPQLIDSANIRQEDAFDNNSDIAEDGGQTPYEATLQQGFQYPATTEDLPPLPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGASEISDSCKPLKKRSRASTDVEMTSSAYRDTSDSDSRGLSDLQVGFGKQVDSPSATADADVSDVQSMDSSLSRRGTGMSKKDTVCQICESSGDSLIPCEGECCKHFHLECLGLASLPDSKFICMECKTGQHPCFSCKVSGKDVKRCSVGACGKFYHEACVRKFPTAIFESKGFRCPQHCCSACSMEKDIHKASKGRMMRCLRCPVAYHSGDACIAAGSMLVSSYILICSNHSKRSSNSSAVNVGFCFVCARGLIVQDHSDPMFSSYAYKSHYLLNESNRAELMKLPMIPSSSASKKKCEKGGRLLCCESCPASFHPECLSIEMPEGCWNCNDCKAGKKLHYKQIVWVKLGNYRWWPAEICNPRSVPLNIQGLKHDLGDFPVFFFGSHDYYWVHQGRVFPYVEGDKSFAEGQTSINKTFKKALEEAAKRFQELKAQRESKEALEIEKNSRKPPPYKHIKANKVIGKVQIQVADLSEIPRCNCKPADENPCGLESECLNRMLQYECHPQVCPAGDRCQNQCFTKRLYPDAEIIKTERRGWGLRTKRSIKKGEFVNEYVGELIDEEECRLRIKRAHENSVTNFYMLTVTKDRIIDAGPKGNYSRFMNHSCNPNCETQKWTVNGDVRVGLFALCDIPAGMELTFNYNLDCLGNGRTECHCGADNCSGFLGVRPKSACASTNEEKAKNAKLKQKRRKIKTEPKQMHEDYCFQCGDGGELVMCDKKDCPKAYHLLCLNLTQPPYGKWECPWHQCDECSSAAVSFCEFCPHSFCKDHEKGALVPSALEGRLCCSEHDPMAPVSPEYWSKIKCKWESQDHGEEVKE

SEQ ID NO: 69959 - protein, 1426 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGASEISDSCKPLKKRSRASTDVEMTSSAYRDTSDSDSRGLSDLQVGFGKQVDSPSATADADVSDVQSMDSSLSRRGTGMSKKDTVCQICESSGDSLIPCEGECCKHFHLECLGLASLPDSKFICMECKTGQHPCFSCKVSGKDVKRCSVGACGKFYHEACVRKFPTAIFESKGFRCPQHCCSACSMEKDIHKASKGRMMRCLRCPVAYHSGDACIAAGSMLVSSYILICSNHSKRSSNSSAVNVGFCFVCARGLIVQDHSDPMFSSYAYKSHYLLNESNRAELMKLPMIPSSSASKKKCEKGGRLLCCESCPASFHPECLSIEMPEGCWNCNDCKAGKKLHYKQIVWVKLGNYRWWPAEICNPRSVPLNIQGLKHDLGDFPVFFFGSHDYYWVHQGRVFPYVEGDKSFAEGQTSINKTFKKALEEAAKRFQELKAQRESKEALEIEKNSRKPPPYKHIKANKVIGKVQIQVADLSEIPRCNCKPADENPCGLESECLNRMLQYECHPQVCPAGDRCQNQCFTKRLYPDAEIIKTERRGWGLRTKRSIKKGEFVNEYVGELIDEEECRLRIKRAHENSDRIIDAGPKGNYSRFMNHSCNPNCETQKWTVNGDVRVGLFALCDIPAGMELTFNYNLDCLGNGRTECHCGADNCSGFLGVRPKSACASTNEEKAKNAKLKQKRRKIKTEPKQMHEDYCFQCGDGGELVMCDKKDCPKAYHLLCLNLTQPPYGKWECPWHQCDECSSAAVSFCEFCPHSFCKDHEKGALVPSALEGRLCCSEHDPMAPVSPEYWSKIKCKWESQDHGEEVKE

SEQ ID NO: 69960 - protein, 282 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYP

SEQ ID NO: 69961 - protein, 25 aa, Homo sapiens
MDFSFSFMQGIMGNTIQQPPQLIDS

SEQ ID NO: 69962 - protein, 15 aa, Homo sapiens
MDFSFSFMQGIMGNT

SEQ ID NO: 69963 - protein, 539 aa, Homo sapiens
MPGQRRALSPKMASMRESDTGLWLHNKLGATDELWAPPSIASLLTAAVIDNIRLCFHGLSSAVKLKLLLGTLHLPRRTVDEMKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 69964 - protein, 528 aa, Homo sapiens
MASMRESDTGLWLHNKLGATDELWAPPSIASLLTAAVIDNIRLCFHGLSSAVKLKLLLGTLHLPRRTVDEMKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 69965 - protein, 393 aa, Homo sapiens
MLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 69966 - protein, 890 aa, Homo sapiens
MDSNTAPLGPSCPQPPPAPQPQARSRLNATASLEQERSERPRAPGPQAGPGPGVRDAAAPAEPQAQHTRSRERADGTGPTKGDMEIPFEEVLERAKAGDPKAQTEVGKHYLQLAGDTDEELNSCTAVDWLVLAAKQGRREAVKLLRRCLADRRGITSENEREVRQLSSETDLERAVRKAALVMYWKLNPKKKKQVAVAELLENVGQVNEHDGGAQPGPVPKSLQKQRRMLERLVSSESKNYIALDDFVEITKKYAKGVIPSSLFLQDDEDDDELAGKSPEDLPLRLKVVKYPLHAIMEIKEYLIDMASRAGMHWLSTIIPTHHINALIFFFIVSNLTIDFFAFFIPLVIFYLSFISMVICTLKVFQDSKAWENFRTLTDLLLRFEPNLDVEQAEVNFGWNHLEPYAHFLLSVFFVIFSFPIASKDCIPCSELAVITGFFTVTSYLSLSTHAEPYTRRALATEVTAGLLSLLPSMPLNWPYLKVLGQTFITVPVGHLVVLNVSVPCLLYVYLLYLFFRMAQLRNFKGTYCYLVPYLVCFMWCELSVVILLESTGLGLLRASIGYFLFLFALPILVAGLALVGVLQFARWFTSLELTKIAVTVAVCSVPLLLRWWTKASFSVVGMVKSLTRSSMVKLILVWLTAIVLFCWFYVYRSEGMKVYNSTLTWQQYGALCGPRAWKETNMARTQILCSHLEGHRVTWTGRFKYVRVTDIDNSAESAINMLPFFIGDWMRCLYGEAYPACSPGNTSTAEEELCRLKLLAKHPCHIKKFDRYKFEITVGMPFSSGADGSRSREEDDVTKDIVLRASSEFKSVLLSLRQGSLIEFSTILEGRLGSKWPVFELKAISCLNCMAQLSPTRRHVKIEHDWRSTVHGAVKFAFDFFFFPFLSAA

SEQ ID NO: 69967 - protein, 890 aa, Homo sapiens; identical to SEQ ID NO: 69966

SEQ ID NO: 69968 - protein, 268 aa, Homo sapiens
MVKSLTRSSMVKLILVWLTAIVLFCWFYVYRSEGMKVYNSTLTWQQYGALCGPRAWKETNMARTQILCSHLEGHRVTWTGRFKYVRVTDIDNSAESAINMLPFFIGDWMRCLYGEAYPACSPGNTSTAEEELCRLKLLAKHPCHIKKFDRYKFEITVGMPFSSGADGSRSREEDDVTKDIVLRASSEFKSVLLSLRQGSLIEFSTILEGRLGSKWPVFELKAISCLNCMAQLSPTRRHVKIEHDWRSTVHGAVKFAFDFFFFPFLSAA

SEQ ID NO: 69969 - protein, 1113 aa, Homo sapiens
MPRPELPLPEGWEEARDFDGKVYYIDHTNRTTSWIDPRDRYTKPLTFADCISDELPLGWEEAYDPQVGDYFIDHNTKTTQIEDPRVQWRREQEHMLKDYLVVAQEALSAQKEIYQVKQQRLELAQQEYQQLHAVWEHKLGSQVSLVSGSSSSSKYDPEILKAEIATAKSRVNKLKREMVHLQHELQFKERGFQTLKKIDKKMSDAQGSYKLDEAQAVLRETKAIKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRPSSVKSLRSERLIRTSLDLELDLQATRTWHSQLTQEISVLKELKEQLEQAKSHGEKELPQWLREDERFRLLLRMLEKRQMDRAEHKGELQTDKMMRAAAKDVHRLRGQSCKEPPEVQSFREKMAFFTRPRMNIPALSADDV

SEQ ID NO: 69970 - protein, 1119 aa, Homo sapiens
MPRPELPLPEGWEEARDFDGKVYYIDHTNRTTSWIDPRDRYTKPLTFADCISDELPLGWEEAYDPQVGDYFIDHNTKTTQIEDPRVQWRREQEHMLKDYLVVAQEALSAQKEIYQVKQQRLELAQQEYQQLHAVWEHKLGSQVSLVSGSSSSSKYDPEILKAEIATAKSRVNKLKREMVHLQHELQFKERGFQTLKKIDKKMSDAQGSYKLDEAQAVLRETKAIKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRPSPPPQPSSVKSLRSERLIRTSLDLELDLQATRTWHSQLTQEISVLKELKEQLEQAKSHGEKELPQWLREDERFRLLLRMLEKRQMDRAEHKGELQTDKMMRAAAKDVHRLRGQSCKEPPEVQSFREKMAFFTRPRMNIPALSADDV

SEQ ID NO: 69971 - protein, 269 aa, Homo sapiens
MARASSGNGSEEAWGALRAPQQQLRELCPGVNNQPYLCESGHCCGETGCCTYYYELWWFWLLWTVLILFSCCCAFRHRRAKLRLQQQQRQREINLLAYHGACHGAGPFPTGSLLDLRFLSTFKPPAYEDVVHRPGTPPPPYTVAPGRPLTASSEQTCCSSSSSCPAHFEGTNVEGVSSHQSAPPHQEGEPGAGVTPASTPPSCRYRRLTGDSGIELCPCPASGEGEPVKEVRVSATLPDLEDYSPCALPPESVPQIFPMGLSSSEGDIP

SEQ ID NO: 69972 - protein, 261 aa, Homo sapiens
MALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYPCPPGYPYPPPPPEFYPGPPMMDGAMGYVQPPPPPYPGPMEPPVSGPDVPSTPAAEAKAAEAAASAYYNPGNPHNVYMPTSQPPPPPYYPPEDKKTQ

SEQ ID NO: 69973 - protein, 239 aa, Homo sapiens
MSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQASRGEVPSGAYGYSYMPSGAYVYPPPVANGMYPCPPGYPYPPPPPEFYPGPPMMDGAMGYVQPPPPPYPGPMEPPVSGPDVPSTPAAEAKAAEAAASAYYNPGNPHNVYMPTSQPPPPPYYPPEDKKTQ

SEQ ID NO: 69974 - protein, 217 aa, Homo sapiens
MALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGASRGEVPSGAYGYSYMPSGAYVYPPPVANGMYPCPPGYPYPPPPPEFYPGPPMMDGAMGYVQPPPPPYPGPMEPPVSGPDVPSTPAGEGPWVLAALRDQPSPPRCRTESLRMARDC

SEQ ID NO: 69975 - protein, 209 aa, Homo sapiens
MALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAPMSPPLLQPKPRPQKQPPAPITTQAIASRRHLPTTHRKIEDPVGPPASLPPTLISLPYPSHRGCAGAWGGEGAPCSPSRSDHKQLPGTSIVGH

SEQ ID NO: 69976 - protein, 216 aa, Homo sapiens
MALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGGAIEFGQRMLQVASQEFYPGPPMMDGAMGYVQPPPPPYPGPMEPPVSGPDVPSTPAAEAKAAEAAASAYYNPGNPHNVYMPTSQPPPPPYYPPEDKKTQ

SEQ ID NO: 69977 - protein, 922 aa, Homo sapiens
MATASPRSDTSNNHSGRLQLQVTVSSAKLKRKKNWFGTAIYTEVVVDGEITKTAKSSSSSNPKWDEQLTVNVTPQTTLEFQVWSHRTLKADALLGKATIDLKQALLIHNRKLERVKEQLKLSLENKNGIAQTGELTVVLDGLVIEQENITNCSSSPTIEIQENGDALHENGEPSARTTARLAVEGTNGIDNHVPTSTLVQNSCCSYVVNGDNTPSSPSQVAARPKNTPAPKPLASEPADDTVNGESSSFAPTDNASVTGTPVVSEENALSPNCTSTTVEDPPVQEILTSSENNECIPSTSAELESEARSILEPDTSNSRSSSAFEAAKSRQPDGCMDPVRQQSGNANTETLPSGWEQRKDPHGRTYYVDHNTRTTTWERPQPLPPGWERRVDDRRRVYYVDHNTRTTTWQRPTMESVRNFEQWQSQRNQLQGAMQQFNQRYLYSASMLAAENDPYGPLPPGWEKRVDSTDRVYFVNHNTKTTQWEDPRTQGLQNEEPLPEGWEIRYTREGVRYFVDHNTRTTTFKDPRNGKSSVTKGGPQIAYERGFRWKLAHFRYLCQSNALPSHVKINVSRQTLFEDSFQQIMALKPYDLRRRLYVIFRGEEGLDYGGLAREWFFLLSHEVLNPMYCLFEYAGKNNYCLQINPASTINPDHLSYFCFIGRFIAMALFHGKFIDTGFSLPFYKRMLSKKLTIKDLESIDTEFYNSLIWIRDNNIEECGLEMYFSVDMEILGKVTSHDLKLGGSNILVTEENKDEYIGLMTEWRFSRGVQEQTKAFLDGFNEVVPLQWLQYFDEKELEVMLCGMQEVDLADWQRNTVYRHYTRNSKQIIWFWQFVKETDNEVRMRLLQFVTGTCRLPLGGFAELMGSNGPQKFCIEKVGKDTWLPRSHTCFNRLDLPPYKSYEQLKEKLLFAIEETEGFGQE

SEQ ID NO: 69978 - protein, 792 aa, Homo sapiens
MATASPRSDTSNNHSGRLQLQVTVSSAKLKRKKNWFGTAIYTEVVVDGEITKTAKSSSSSNPKWDEQLTVNVTPQTTLEFQVWSHRTLKADALLGKATIDLKQALLIHNRKFNGESSSFAPTDNASVTGTPVVSEENALSPNCTSTTVEDPPVQEILTSSENNECIPSTSAELESEARSILEPDTSNSRSSSAFEAAKSRQPDGCMDPVRQQSGNANTETLPSGWEQRKDPHGRTYYVDHNTRTTTWERPQPLPPGWERRVDDRRRVYYVDHNTRTTTWQRPTMESVRNFEQWQSQRNQLQGAMQQFNQRYLYSASMLAAENDPYGPLPPGWEKRVDSTDRVYFVNHNTKTTQWEDPRTQGLQNEEPLPEGWEIRYTREGVRYFVDHNTRTTTFKDPRNGKSSVTKGGPQIAYERGFRWKLAHFRYLCQSNALPSHVKINVSRQTLFEDSFQQIMALKPYDLRRRLYVIFRGEEGLDYGGLAREWFFLLSHEVLNPMYCLFEYAGKNNYCLQINPASTINPDHLSYFCFIGRFIAMALFHGKFIDTGFSLPFYKRMLSKKLTIKDLESIDTEFYNSLIWIRDNNIEECGLEMYFSVDMEILGKVTSHDLKLGGSNILVTEENKDEYIGLMTEWRFSRGVQEQTKAFLDGFNEVVPLQWLQYFDEKELEVMLCGMQEVDLADWQRNTVYRHYTRNSKQIIWFWQFVKETDNEVRMRLLQFVTGTCRLPLGGFAELMGSNGPQKFCIEKVGKDTWLPRSHTCFNRLDLPPYKSYEQLKEKLLFAIEETEGFGQE

SEQ ID NO: 69979 - protein, 704 aa, Homo sapiens
MATASPRSDTSNNHSGRLQLQVTVNGESSSFAPTDNASVTGTPVVSEENALSPNCTSTTVEDPPVQEILTSSENNECIPSTSAELESEARSILEPDTSNSRSSSAFEAAKSRQPDGCMDPVRQQSGNANTETLPSGWEQRKDPHGRTYYVDHNTRTTTWERPQPLPPGWERRVDDRRRVYYVDHNTRTTTWQRPTMESVRNFEQWQSQRNQLQGAMQQFNQRYLYSASMLAAENDPYGPLPPGWEKRVDSTDRVYFVNHNTKTTQWEDPRTQGLQNEEPLPEGWEIRYTREGVRYFVDHNTRTTTFKDPRNGKSSVTKGGPQIAYERGFRWKLAHFRYLCQSNALPSHVKINVSRQTLFEDSFQQIMALKPYDLRRRLYVIFRGEEGLDYGGLAREWFFLLSHEVLNPMYCLFEYAGKNNYCLQINPASTINPDHLSYFCFIGRFIAMALFHGKFIDTGFSLPFYKRMLSKKLTIKDLESIDTEFYNSLIWIRDNNIEECGLEMYFSVDMEILGKVTSHDLKLGGSNILVTEENKDEYIGLMTEWRFSRGVQEQTKAFLDGFNEVVPLQWLQYFDEKELEVMLCGMQEVDLADWQRNTVYRHYTRNSKQIIWFWQFVKETDNEVRMRLLQFVTGTCRLPLGGFAELMGSNGPQKFCIEKVGKDTWLPRSHTCFNRLDLPPYKSYEQLKEKLLFAIEETEGFGQE

SEQ ID NO: 69980 - protein, 111 aa, Homo sapiens
MATASPRSDTSNNHSGRLQLQVTVSSAKLKRKKNWFGTAIYTEVVVDGEITKTAKSSSSSNPKWDEQLTVNVTPQTTLEFQVWSHRTLKADALLGKATIDLKQALLIHNRK

SEQ ID NO: 69981 - protein, 922 aa, Homo sapiens; identical to SEQ ID NO: 69977

SEQ ID NO: 69982 - protein, 870 aa, Homo sapiens
MASASSSRAGVALPFEKSQLTLKVVSAKPKVHNRQPRINSYVEVAVDGLPSETKKTGKRIGSSELLWNEIIILNVTAQSHLDLKVWSCHTLRNELLGTASVNLSNVLKNNGGKMENMQLTLNLQTENKGSVVSGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPGWEKRTDPRGRFYYVDHNTRTTTWQRPTAEYVRNYEQWQSQRNQLQGAMQHFSQRFLYQSSSASTDHDPLGPLPPGWEKRQDNGRVYYVNHNTRTTQWEDPRTQGMIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIMLLTDWRFTRGVEEQTKAFLDGFNEVAPLEWLRYFDEKELELMLCGMQEIDMSDWQKSTIYRHYTKNSKQIQWFWQVVKEMDNEKRIRLLQFVTGTCRLPVGGFAELIGSNGPQKFCIDKVGKETWLPRSHTCFNRLDLPPYKSYEQLREKLLYAIEETEGFGQE

SEQ ID NO: 69983 - protein, 870 aa, Homo sapiens; identical to SEQ ID NO: 69982

SEQ ID NO: 69984 - protein, 870 aa, Homo sapiens; identical to SEQ ID NO: 69982

SEQ ID NO: 69985 - protein, 754 aa, Homo sapiens
MQLTLNLQTENKGSVVSGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPGWEKRTDPRGRFYYVDHNTRTTTWQRPTAEYVRNYEQWQSQRNQLQGAMQHFSQRFLYQSSSASTDHDPLGPLPPGWEKRQDNGRVYYVNHNTRTTQWEDPRTQGMIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIMLLTDWRFTRGVEEQTKAFLDGFNEVAPLEWLRYFDEKELELMLCGMQEIDMSDWQKSTIYRHYTKNSKQIQWFWQVVKEMDNEKRIRLLQFVTGTCRLPVGGFAELIGSNGPQKFCIDKVGKETWLPRSHTCFNRLDLPPYKSYEQLREKLLYAIEETEGFGQE

SEQ ID NO: 69986 - protein, 757 aa, Homo sapiens
MENMQLTLNLQTENKGSVVSGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPGWEKRTDPRGRFYYVDHNTRTTTWQRPTAEYVRNYEQWQSQRNQLQGAMQHFSQRFLYQSSSASTDHDPLGPLPPGWEKRQDNGRVYYVNHNTRTTQWEDPRTQGMIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIMLLTDWRFTRGVEEQTKAFLDGFNEVAPLEWLRYFDEKELELMLCGMQEIDMSDWQKSTIYRHYTKNSKQIQWFWQVVKEMDNEKRIRLLQFVTGTCRLPVGGFAELIGSNGPQKFCIDKVGKETWLPRSHTCFNRLDLPPYKSYEQLREKLLYAIEETEGFGQE

SEQ ID NO: 69987 - protein, 342 aa, Homo sapiens
MIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIMLLTDWRFTRGVEEQTKAFLDGFNEVAPLEWLRYFDEKELELMLCGMQEIDATGRRAPSTGTTPRTASRSSGSGRW

SEQ ID NO: 69988 - protein, 431 aa, Homo sapiens
MIQEPALPPGWEMKYTSEGVRYFVDHNTRTTTFKDPRPGFESGTKQGSPGAYDRSFRWKYHQFRFLCHSNALPSHVKISVSRQTLFEDSFQQIMNMKPYDLRRRLYIIMRGEEGLDYGGIAREWFFLLSHEVLNPMYCLFEYAGKNNYCLQINPASSINPDHLTYFRFIGRFIAMALYHGKFIDTGFTLPFYKRMLNKRPTLKDLESIDPEFYNSIVWIKENNLEECGLELYFIQDMEILGKVTTHELKEGGESIRVTEENKEEYIMLLTDWRFTRGVEEQTKAFLDGFNEVAPLEWLRYFDEKELELMLCGMQEIDMSDWQKSTIYRHYTKNSKQIQWFWQVVKEMDNEKRIRLLQFVTGTCRLPVGGFAELIGSNGPQKFCIDKVGKETWLPRSHTCFNRLDLPPYKSYEQLREKLLYAIEETEGFGQE

SEQ ID NO: 69989 - protein, 335 aa, Homo sapiens
MASASSSRAGVALPFEKSQLTLKVVSAKPKVHNRQPRINSYVEVAVDGLPSETKKTGKRIGSSELLWNEIIILNVTAQSHLDLKVWSCHTLRNELLGTASVNLSNVLKNNGGKMENMQLTLNLQTENKGSVVSGGELTIFLDGPTVDLGNVPNGSALTDGSQLPSRDSSGTAVAPENRHQPPSTNCFGGRSRTHRHSGASARTTPATGEQSPGARSRHRQPVKNSGHSGLANGTVNDEPTTATDPEEPSVVGVTSPPAAPLSVTPNPNTTSLPAPATPAEGEEPSTSGTQQLPAAAQAPDALPAGWEQRELPNGRVYYVDHNTKTTTWERPLPPG

SEQ ID NO: 69990 - protein, 69 aa, Homo sapiens
MESPKKKNQQLKVGILHLGSRQKKIRIQLRSQVLGREMRDMEGDLQELHQSNTGDKSGFGFRRQGEDNT

SEQ ID NO: 69991 - protein, 81 aa, Homo sapiens
MESPKKKNQQLKVGILHLGSRQKKIRIQLRSQCATWKVICKSCISQTPGINLDLGSGVKVKIIPKEEHCKMPEAGEEQPQV

SEQ ID NO: 69992 - protein, 146 aa, Homo sapiens
MLLWCPPQCACSLGVFPSAPSPVWGTRRSCEPATRVPEVWILSPLLRHGGHTQTQNHTASPRSPVMESPKKKNQQLKVGILHLGSRQKKIRIQLRSQCATWKVICKSCISQTPGINLDLGSGVKVKIIPKEEHCKMPEAGEEQPQV

SEQ ID NO: 69993 - protein, 69 aa, Homo sapiens; identical to SEQ ID NO: 69990

SEQ ID NO: 69994 - protein, 69 aa, Homo sapiens; identical to SEQ ID NO: 69990

SEQ ID NO: 69995 - protein, 81 aa, Homo sapiens; identical to SEQ ID NO: 69991

SEQ ID NO: 69996 - protein, 69 aa, Homo sapiens; identical to SEQ ID NO: 69990

SEQ ID NO: 69997 - protein, 146 aa, Homo sapiens; identical to SEQ ID NO: 69992

SEQ ID NO: 69998 - protein, 81 aa, Homo sapiens; identical to SEQ ID NO: 69991

SEQ ID NO: 69999 - protein, 69 aa, Homo sapiens; identical to SEQ ID NO: 69990

SEQ ID NO: 70000 - protein, 81 aa, Homo sapiens; identical to SEQ ID NO: 69991

SEQ ID NO: 70001 - protein, 146 aa, Homo sapiens; identical to SEQ ID NO: 69992

SEQ ID NO: 70002 - protein, 69 aa, Homo sapiens; identical to SEQ ID NO: 69990

SEQ ID NO: 70003 - protein, 69 aa, Homo sapiens; identical to SEQ ID NO: 69990

SEQ ID NO: 70004 - protein, 81 aa, Homo sapiens; identical to SEQ ID NO: 69991

SEQ ID NO: 70005 - protein, 146 aa, Homo sapiens; identical to SEQ ID NO: 69992

SEQ ID NO: 70006 - protein, 111 aa, Homo sapiens
MIWRGRSTYRPRPRRSVPPPELIGPMLEPGDEEPQQEEPPTESRDPAPGQEREEDQGAAETQVPDLEADLQELSQSKTGGECGNGPDDQGKILPKSEQFKMPEGGDRQPQV

SEQ ID NO: 70007 - protein, 111 aa, Homo sapiens; identical to SEQ ID NO: 70006

SEQ ID NO: 70008 - protein, 1333 aa, Homo sapiens
MTADKLVFFVNGRKVVEKNADPETTLLAYLRRKLGLSGTKLGCGEGGCGACTVMLSKYDRLQNKIVHFSANACLAPICSLHHVAVTTVEGIGSTKTRLHPVQERIAKSHGSQCGFCTPGIVMSMYTLLRNQPEPTMEEIENAFQGNLCRCTGYRPILQGFRTFARDGGCCGGDGNNPNCCMNQKKDHSVSLSPSLFKPEEFTPLDPTQEPIFPPELLRLKDTPRKQLRFEGERVTWIQASTLKELLDLKAQHPDAKLVVGNTEIGIEMKFKNMLFPMIVCPAWIPELNSVEHGPDGISFGAACPLSIVEKTLVDAVAKLPAQKTEVFRGVLEQLRWFAGKQVKSVASVGGNIITASPISDLNPVFMASGAKLTLVSRGTRRTVQMDHTFFPGYRKTLLSPEEILLSIEIPYSREGEYFSAFKQASRREDDIAKVTSGMRVLFKPGTTEVQELALCYGGMANRTISALKTTQRQLSKLWKEELLQDVCAGLAEELHLPPDAPGGMVDFRCTLTLSFFFKFYLTVLQKLGQENLEDKCGKLDPTFASATLLFQKDPPADVQLFQEVPKGQSEEDMVGRPLPHLAADMQASGEAVYCDDIPRYENELSLRLVTSTRAHAKIKSIDTSEAKKVPGFVCFISADDVPGSNITGICNDETVFAKDKVTCVGHIIGAVVADTPEHTQRAAQGVKITYEELPAIITIEDAIKNNSFYGPELKIEKGDLKKGFSEADNVVSGEIYIGGQEHFYLETHCTIAVPKGEAGEMELFVSTQNTMKTQSFVAKMLGVPANRIVVRVKRMGGGFGGKETRSTVVSTAVALAAYKTGRPVRCMLDRDEDMLITGGRHPFLARYKVGFMKTGTVVALEVDHFSNVGNTQDLSQSIMERALFHMDNCYKIPNIRGTGRLCKTNLPSNTAFRGFGGPQGMLIAECWMSEVAVTCGMPAEEVRRKNLYKEGDLTHFNQKLEGFTLPRCWEECLASSQYHARKSEVDKFNKENCWKKRGLCIIPTKFGISFTVPFLNQAGALLHVYTDGSVLLTHGGTEMGQGLHTKMVQVASRALKIPTSKIYISETSTNTVPNTSPTAASVSADLNGQAVYAACQTILKRLEPYKKKNPSGSWEDWVTAAYMDTVSLSATGFYRTPNLGYSFETNSGNPFHYFSYGVACSEVEIDCLTGDHKNLRTDIVMDVGSSLNPAIDIGQVEGAFVQGLGLFTLEELHYSPEGSLHTRGPSTYKIPAFGSIPIEFRVSLLRDCPNKKAIYASKAVGEPPLFLAASIFFAIKDAIRAARAQHTGNNVKELFRLDSPATPEKIRNACVDKFTTLCVTGVPENCKPWSVRV

SEQ ID NO: 70009 - protein, 631 aa, Homo sapiens
MKFAEHLSAHITPEWRKQYIQYEAFKDMLYSAQDQAPSVEVTDEDTVKRYFAKFEEKFFQTCEKELAKINTFYSEKLAEAQRRFATLQNELQSSLDAQKESTGVTTLRQRRKPVFHLSHEERVQHRNIKDLKLAFSEFYLSLILLQNYQNLNFTGFRKILKKHDKILETSRGADWRVAHVEVAPFYTCKKINQLISETEAVVTNELEDGDRQKAMKRLRVPPLGAAQPAPAWTTFRVGLFCGIFIVLNITLVLAAVFKLETDRSIWPLIRIYRGGFLLIEFLFLLGINTYGWRQAGVNHVLIFELNPRSNLSHQHLFEIAGFLGILWCLSLLACFFAPISVIPTYVYPLALYGFMVFFLINPTKTFYYKSRFWLLKLLFRVFTAPFHKVGFADFWLADQLNSLSVILMDLEYMICFYSLELKWDESKGLLPNNSEERGHSDTMVFFYLWIVFYIISSCYTLIWDLKMDWGLFDKNAGENTFLREEIVYPQKAYYYCAIIEDVILRFAWTIQISITSTTLLPHSGDIIATVFAPLEVFRRFVWNFFRLENEHLNNCGEFRAVRDISVAPLNADDQTLLEQMMDQDDGVRNRQKNRSWKYNQSISLRRPRLASQSKARDTKVLIEDTDDEANT

SEQ ID NO: 70010 - protein, 696 aa, Homo sapiens
MKFAEHLSAHITPEWRKQYIQYEAFKDMLYSAQDQAPSVEVTDEDTVKRYFAKFEEKFFQTCEKELAKINTFYSEKLAEAQRRFATLQNELQSSLDAQKESTGVTTLRQRRKPVFHLSHEERVQHRNIKDLKLAFSEFYLSLILLQNYQNLNFTGFRKILKKHDKILETSRGADWRVAHVEVAPFYTCKKINQLISETEAVVTNELEDGDRQKAMKRLRVPPLGAAQPAPAWTTFRVGLFCGIFIVLNITLVLAAVFKLETDRSIWPLIRIYRGGFLLIEFLFLLGINTYGWRQAGVNHVLIFELNPRSNLSHQHLFEIAGFLGILWCLSLLACFFAPISVIPTYVYPLALYGFMVFFLINPTKTFYYKSRFWLLKLLFRVFTAPFHKVGFADFWLADQLNSLSVILMDLEYMICFYSLELKWDESKGLLPNNSEESGICHKYTYGVRAIVQCIPAWLRFIQCLRRYRDTKRAFPHLVNAGKYSTTFFMVTFAALYSTHKERGHSDTMVFFYLWIVFYIISSCYTLIWDLKMDWGLFDKNAGENTFLREEIVYPQKAYYYCAIIEDVILRFAWTIQISITSTTLLPHSGDIIATVFAPLEVFRRFVWNFFRLENEHLNNCGEFRAVRDISVAPLNADDQTLLEQMMDQDDGVRNRQKNRSWKYNQSISLRRPRLASQSKARDTKVLIEDTDDEANT

SEQ ID NO: 70011 - protein, 180 aa, Homo sapiens
MESWWGLPCLAFLCFLMHARGQRDFDLADALDDPEPTKKPNSDIYPKPKPPYYPQPENPDSGGNIYPRPKPRPQPQPGNSGNSGGYFNDVDRDDGRYPPRPRPRPPAGGGGGGYSSYGNSDNTHGGDHHSTYGNPEGNMVAKIVSPIVSVVVVTLLGAAASYFKLNNRRNCFRTHEPENV

SEQ ID NO: 70012 - protein, 195 aa, Homo sapiens
MESWWGLPCLAFLCFLMHARGQRDFDLADALDDPEPTKKPNSDIYPKPKPPYYPQPENPDSGGNIYPRPKPRPQPQPGNSGNSGGYFNDVDRDDGRYPPRPRPRPPAGGGGGGYSSYGNSDNTHGRGGYRLNSRYGNTYGGDHHSTYGNPEGNMVAKIVSPIVSVVVVTLLGAAASYFKLNNRRNCFRTHEPENV

SEQ ID NO: 70013 - protein, 181 aa, Homo sapiens
MESWWGLPCLAFLCFLMHARGQRDFDLADALDDPEPTKKPNSDIYPKPKPPYYPQPENPDSGGNIYPRPKPRPQPQPGNSGNSGGSYFNDVDRDDGRYPPRPRPRPPAGGGGGGYSSYGNSDNTHGGDHHSTYGNPEGNMVAKIVSPIVSVVVVTLLGAAASYFKLNNRRNCFRTHEPENV

SEQ ID NO: 70014 - protein, 42 aa, Homo sapiens
MVAKIVSPIVSVVVVTLLGAAASYFKLNNRRNCFRTHEPENV

SEQ ID NO: 70015 - protein, 3549 aa, Homo sapiens
MFPMQKGSLNLLRQKWESCDYQRSECHPRDSHCTIFQPQESKLLAPEGEVVSAPQSLDPTSLPYSTGEEMWSSKPEEKDSVDKSNNTREYGRPEVLKEDSLSSRRRIERFSIALDELRSVFEAPKSGNKPAEYGGKEVEIERSLCSPAFKSHPGSQLEDSVKDSDKKGKETSFDKMSPESGHSRIFEATAGPNKPESGFAEDSAARGEGVSDLHEVVSLKERMARYQAAVSRGDCRSFSANMMEESEMCAVPGGLAKVKKQFEDEITSSRNTFAQYQYQHQNRSEQEAIHSSQVGTSRSSQEMARNEQEGSKVQKIDVHGTEMVSHLEKHTEEVNQASQFHQYVQETVIDTPEDEEIPKVSTKLLKEQFEKSAQEKILYSDKEMTTPAKQIKTESEYEETFKPSSVVSTSSTSCVSTSQRKETSTTRYSDHSVTSSTLAQINATSSGMTEEFPPPPPDVLQTSVDVTAFSQSPELPSPPRRLPVPKDVYSKQRNLYELNRLYKHIHPELRKNLEKDYISEVSEIVSSQMNSGSSVSADVQQARYVFENTNDSSQKDLNSEREYLEWDEILKGEVQSIRWIFENQPLDSINNGSPDEGDISRGIADQEIIAGGDVKYTTWMFETQPIDTLGAYSSDTVENAEKIPELARGDVCTARWMFETRPLDSMNKMHQSQEESAVTISKDITGGDVKTVRYMFETQHLDQLGQLHSVDEVHLLQLRSELKEIKGNVKRSIKCFETQPLYVIRDGSGQMLEIKTVHREDVEKGDVRTARWMFETQPLDTINKDITEIKVVRGISMEENVKGGVSKAKWLFETQPLEKIKESEEVIIEKEKIIGTDVSRKCWMFETQPLDILKEVPDADSLQREEIIGGDVQTTKHLFETLPIEALKDSPDIGKLQKITASEEEKGDVRHQKWIFETQPLEDIRKDKKEYTRTVKLEEVDRGDVKNYTHIFESNNLIKFDASHKIEVEGVTRGAVELNKSLFETTPLYAIQDPLGKYHQVKTVQQEEIVRGDVRSCRWLFETRPIDQFDESIHKFQIIRGISAQEIQTGNVKSAKWLFETQPLDSIKYFSDVEETESKTEQTRDIVKGDVKTCKWLFETQPMESLYEKVSLMTSSEEIHKGDVKTCTWLFETQPLDTIKDDSETAVKLQTVKQEEIQGGDVRTACFLFETENLDSIQGEEVKEIKPVEMDIQAGDVSSMRYKFENQSLDSISSSSEEVLKKIKTLKTEDIQKGNVLNCRWLFENQPIDKIKESQEGDECVKTVTDIQGGDVRKGCFIFETFSLDEIKEESDYISTKKTITEEVIQGDVKSYRMLFETQPLYAIQDREGSYHEVTTVKKEEVIHGDVRGTRWLFETKPLDSINKSETVYVIKSVTQEDIQKGDVSSVRYRFETQPLDQISEESHNIMPSIDHIQGGNVKTSRQFFESENFDKNNYIRTVSVNEIQKGNVKTSTWLFETHTMDELRGEGLEYENIKTVTQEDVQKGDVKQAVWLFENRTFDSIMEAHKGITKMTKEEIPPSDVKTTTWLFETTPLHEFNETRVEKIEIIGKSIKETLEDLYSQKVIQAPGIIIEADEIGDVRMAKYKLMNQASPEIQKEEIIRADLRNIMVNLLSKRDCTEREILISEEEKGNVNLTKTQLLNRSTEFHAEKEEIVKGDVQQAIKNLFSEERSVKKGILIQEDEKGDINMTIYCLLHENDGDTIEREEVIGGDVKRTIHNLLSSTSNNKISERAKIDASERGNVQFFTTCIEAGALDYLKQLHTESNETLTAKKQEGEKEIIGGDVEGTKLLLKKRQSLVERTVSETDIIPGDVHNTVKVFMTEPQSTFGKIPKEEIIKGDLTSTLNSLSQAVNQKTVTKTEEIIKGNMLATLKSLKESSHRWKESKQPDAIPGDIEKAIECLEKATNTKTEILKKELLKDDLETSLRSLKEAQRSFKEVHKEGVIKKDAKAVMAGSSGEQKTDIHQVAVQRNKNSLLQPKPGPFEPAAKWQGGADTLSQTMGKSCHGNLVEERTEVNLPKAPKGTVKIVIDREQNNDALEKSLRRLSNSHHKSNVLESGDKTGVWTDTTGEQHLRDEYMSRQLTSTVSVKNNLTTKESDRAVRELKKDDVFNSIQSAGKTVGKQQTYELRNDHQKMEGFHIKSPKKTKNIKILTDTQSSKPSPTQHPVSMPVGGTYDLSGDFQKQTLLKQETKYSNKDIKKKNINLQPMWQLLPVEQDTSNVTEMKVSEKSHNTFKATNKKRETDVHLKSQDFLMKTNTSTGLKMAMERSLNPINFNPENNVKESECPLPPPSPPPPPPSNASSEIEFPLPPPPPLMMFPEKNGFLPSLSTEKIKAEFESFPGLPLPPPPVDEKSERESSSMFLPPPPPPTPSQKPAHLLSSSAPEKHSGDFMQQYSQKEASNSQNSQAKIITGKTGVLPPPTLPKPKLPKHIKDNKNDFSPKVELATSLSDMECKITTSKDQKKVMVMTSSEHTETKQNVISKSLDERKQLSIDSANCLSHTVPGTSAPRKKQIAPLIKSHSFPESSGQQNPKPYMRKFKTPLMIAEEKYRQQKEEIEKQKQESSYYNIVKTQSQNQHITEVEKEMPLQKTNEEVSLSGIDSECTVVQPSPGSQSNARILGVCSDNQLSTTSPETVAAKRLHHVLAASEDKDKMKKEVLQSSRDIMQSKSACEIKQSHQECSTQQTQQKKYLEQLHLPQSKPISPNFKVKTIKLPTLDHTLNETDHSYESHKQQSEIDVQTFTKKQYLKTKKTEASTECSHKQSLAERHYQLPKKEKRVTVQLPTESIQKNQEDKLKMVPRKQREFSGSDRGKLPGSEEKNQGPSMIGRKEERLITERKHEHLKNKSAPKVVKQKVIDAHLDSQTQNFQQTQIQTAESKAEHKKLPQPYNSLQEEKCLEVKGIQEKQVFSNTKDSKQEITQNKSFFSSVKESQRDDGKGALNIVEFLRKREELQQILSRVKQFEAEPNKSGLKTFQTLLNTIPGWLISEDKREYAVHIAMENNLEKVKEEITHIKTQAEDMLVSYENIIQTAMMSSKTGKPGNKPTSLDETSSKVSNVHVSNNKNSEQKENKIAKEKTVQHQVAAHHEATVRSHVKTHQEIKLDDSNIPPPSLKTRPPSPTFITIESTARRTENPTKNELSQSPKKDSYVEPPPRRPMSQKSEIHRANTSPSPPRSRSEQLVRLKDTTAKLSKGAIPCPAATPVPIVEKRSEIIMSPATLRRQIKIETRGRDSPPTITIPVNINHAASGSFRESVDAQEEIRKVEKRATYVHKDGLNSTDHMVPDTESYDAVEIIRKVAVPPRLSEHTQRYEAANRTVQMAENFVNDPENEINRWFREFEHGPVSEAKSNRRVYAKGETNHNIQQESRTFCKEEFGLTSLGNTSFTDFSCKHPRELREKIPVKQPRICSETRSLSEHFSGMDAFESQIVESKMKTSSSHSSEAGKSGCDFKHAPPTYEDVIAGHILDISDSPKEVRKNFQKTWQESGRVFKGLGYATADASATEMRTTFQEESAFISEAAAPRQGNMYTLSKDSLSNGVPSGRQAEFS

SEQ ID NO: 70016 - protein, 938 aa, Homo sapiens
MFPMQKGSLNLLRQKWESCDYQRSECHPRDSHCTIFQPQESKLLAPEGEVVSAPQSLDPTSLPYSTGEEMWSSKPEEKDSVDKSNNTREYGRPEVLKEDSLSSRRRIERFSIALDELRSVFEAPKSGNKPAEYGGKEVEIERSLCSPAFKSHPGSQLEDSVKDSDKKGKETSFDKMSPESGHSRIFEATAGPNKPESGFAEDSAARGEGVSDLHEVVSLKERMARYQAAVSRGDCRSFSANMMEESEMCAVPGGLAKVKKQFEDEITSSRNTFAQYQYQHQNRSEQEAIHSSQVGTSRSSQEMARNEQEGSKVQKIDVHGTEMVSHLEKHTEEVNQASQFHQYVQETVIDTPEDEEIPKVSTKLLKEQFEKSAQEKILYSDKEMTTPAKQIKKLLLQDKEICILCQKTVYPMECLVADKQNFHKSCFRCHHCNSKLSLGNYASLHGQIYCKPHFKQLFKSKGNYDEGFGHKQHKDRWNCKNQSRSVDFIPNEEPNMCKNIAENTLVPGDRNEHLDAGNSEGQRNDLRKLGERGKLKVIWPPSKEIPKKTLPFEEELKMSKPKWPPEMTTLLSPEFKSESLLEDVRTPENKGQRQDHFPFLQPYLQSTHVCQKEDVIGIKEMKMPEGRKDEKKEGRKNVQDRPSEAEDTKSNRKSAMDLNDNNNVIVQSAEKEKNEKTNQTNGAEVLQVTNTDDEMMPENHKENLNKNNNNNYVAVSYLNNCRQKTSILEFLDLLPLSSEANDTANEYEIEKLENTSRISELLGIFESEKTYSRNVLAMALKKQTDRAAAGSPVQPAPKPSLSRGLMVKGGSSIISPDTNLLNIKGSHSKSKNLHFFFSNTVKITAFSKKNENIFNCDLIDSVDQIKNMPCLDLREFGKDVKPWHVETTEAARNNENTGFDALSHECTAKPLFPRVEVQSEQLTVEEQIKRNRCYSDTE

SEQ ID NO: 70017 - protein, 3549 aa, Homo sapiens; identical to SEQ ID NO: 70015

SEQ ID NO: 70018 - protein, 3327 aa, Homo sapiens
MARYQAAVSRGDCRSFSANMMEESEMCAVPGGLAKVKKQFEDEITSSRNTFAQYQYQHQNRSEQEAIHSSQVGTSRSSQEMARNEQEGSKVQKIDVHGTEMVSHLEKHTEEVNQASQFHQYVQETVIDTPEDEEIPKVSTKLLKEQFEKSAQEKILYSDKEMTTPAKQIKTESEYEETFKPSSVVSTSSTSCVSTSQRKETSTTRYSDHSVTSSTLAQINATSSGMTEEFPPPPPDVLQTSVDVTAFSQSPELPSPPRRLPVPKDVYSKQRNLYELNRLYKHIHPELRKNLEKDYISEVSEIVSSQMNSGSSVSADVQQARYVFENTNDSSQKDLNSEREYLEWDEILKGEVQSIRWIFENQPLDSINNGSPDEGDISRGIADQEIIAGGDVKYTTWMFETQPIDTLGAYSSDTVENAEKIPELARGDVCTARWMFETRPLDSMNKMHQSQEESAVTISKDITGGDVKTVRYMFETQHLDQLGQLHSVDEVHLLQLRSELKEIKGNVKRSIKCFETQPLYVIRDGSGQMLEIKTVHREDVEKGDVRTARWMFETQPLDTINKDITEIKVVRGISMEENVKGGVSKAKWLFETQPLEKIKESEEVIIEKEKIIGTDVSRKCWMFETQPLDILKEVPDADSLQREEIIGGDVQTTKHLFETLPIEALKDSPDIGKLQKITASEEEKGDVRHQKWIFETQPLEDIRKDKKEYTRTVKLEEVDRGDVKNYTHIFESNNLIKFDASHKIEVEGVTRGAVELNKSLFETTPLYAIQDPLGKYHQVKTVQQEEIVRGDVRSCRWLFETRPIDQFDESIHKFQIIRGISAQEIQTGNVKSAKWLFETQPLDSIKYFSDVEETESKTEQTRDIVKGDVKTCKWLFETQPMESLYEKVSLMTSSEEIHKGDVKTCTWLFETQPLDTIKDDSETAVKLQTVKQEEIQGGDVRTACFLFETENLDSIQGEEVKEIKPVEMDIQAGDVSSMRYKFENQSLDSISSSSEEVLKKIKTLKTEDIQKGNVLNCRWLFENQPIDKIKESQEGDECVKTVTDIQGGDVRKGCFIFETFSLDEIKEESDYISTKKTITEEVIQGDVKSYRMLFETQPLYAIQDREGSYHEVTTVKKEEVIHGDVRGTRWLFETKPLDSINKSETVYVIKSVTQEDIQKGDVSSVRYRFETQPLDQISEESHNIMPSIDHIQGGNVKTSRQFFESENFDKNNYIRTVSVNEIQKGNVKTSTWLFETHTMDELRGEGLEYENIKTVTQEDVQKGDVKQAVWLFENRTFDSIMEAHKGITKMTKEEIPPSDVKTTTWLFETTPLHEFNETRVEKIEIIGKSIKETLEDLYSQKVIQAPGIIIEADEIGDVRMAKYKLMNQASPEIQKEEIIRADLRNIMVNLLSKRDCTEREILISEEEKGNVNLTKTQLLNRSTEFHAEKEEIVKGDVQQAIKNLFSEERSVKKGILIQEDEKGDINMTIYCLLHENDGDTIEREEVIGGDVKRTIHNLLSSTSNNKISERAKIDASERGNVQFFTTCIEAGALDYLKQLHTESNETLTAKKQEGEKEIIGGDVEGTKLLLKKRQSLVERTVSETDIIPGDVHNTVKVFMTEPQSTFGKIPKEEIIKGDLTSTLNSLSQAVNQKTVTKTEEIIKGNMLATLKSLKESSHRWKESKQPDAIPGDIEKAIECLEKATNTKTEILKKELLKDDLETSLRSLKEAQRSFKEVHKEGVIKKDAKAVMAGSSGEQKTDIHQVAVQRNKNSLLQPKPGPFEPAAKWQGGADTLSQTMGKSCHGNLVEERTEVNLPKAPKGTVKIVIDREQNNDALEKSLRRLSNSHHKSNVLESGDKTGVWTDTTGEQHLRDEYMSRQLTSTVSVKNNLTTKESDRAVRELKKDDVFNSIQSAGKTVGKQQTYELRNDHQKMEGFHIKSPKKTKNIKILTDTQSSKPSPTQHPVSMPVGGTYDLSGDFQKQTLLKQETKYSNKDIKKKNINLQPMWQLLPVEQDTSNVTEMKVSEKSHNTFKATNKKRETDVHLKSQDFLMKTNTSTGLKMAMERSLNPINFNPENNVKESECPLPPPSPPPPPPSNASSEIEFPLPPPPPLMMFPEKNGFLPSLSTEKIKAEFESFPGLPLPPPPVDEKSERESSSMFLPPPPPPTPSQKPAHLLSSSAPEKHSGDFMQQYSQKEASNSQNSQAKIITGKTGVLPPPTLPKPKLPKHIKDNKNDFSPKVELATSLSDMECKITTSKDQKKVMVMTSSEHTETKQNVISKSLDERKQLSIDSANCLSHTVPGTSAPRKKQIAPLIKSHSFPESSGQQNPKPYMRKFKTPLMIAEEKYRQQKEEIEKQKQESSYYNIVKTQSQNQHITEVEKEMPLQKTNEEVSLSGIDSECTVVQPSPGSQSNARILGVCSDNQLSTTSPETVAAKRLHHVLAASEDKDKMKKEVLQSSRDIMQSKSACEIKQSHQECSTQQTQQKKYLEQLHLPQSKPISPNFKVKTIKLPTLDHTLNETDHSYESHKQQSEIDVQTFTKKQYLKTKKTEASTECSHKQSLAERHYQLPKKEKRVTVQLPTESIQKNQEDKLKMVPRKQREFSGSDRGKLPGSEEKNQGPSMIGRKEERLITERKHEHLKNKSAPKVVKQKVIDAHLDSQTQNFQQTQIQTAESKAEHKKLPQPYNSLQEEKCLEVKGIQEKQVFSNTKDSKQEITQNKSFFSSVKESQRDDGKGALNIVEFLRKREELQQILSRVKQFEAEPNKSGLKTFQTLLNTIPGWLISEDKREYAVHIAMENNLEKVKEEITHIKTQAEDMLVSYENIIQTAMMSSKTGKPGNKPTSLDETSSKVSNVHVSNNKNSEQKENKIAKEKTVQHQVAAHHEATVRSHVKTHQEIKLDDSNIPPPSLKTRPPSPTFITIESTARRTENPTKNELSQSPKKDSYVEPPPRRPMSQKSEIHRANTSPSPPRSRSEQLVRLKDTTAKLSKGAIPCPAATPVPIVEKRSEIIMSPATLRRQIKIETRGRDSPPTITIPVNINHAASGSFRESVDAQEEIRKVEKRATYVHKDGLNSTDHMVPDTESYDAVEIIRKVAVPPRLSEHTQRYEAANRTVQMAENFVNDPENEINRWFREFEHGPVSEAKSNRRVYAKGETNHNIQQESRTFCKEEFGLTSLGNTSFTDFSCKHPRELREKIPVKQPRICSETRSLSEHFSGMDAFESQIVESKMKTSSSHSSEAGKSGCDFKHAPPTYEDVIAGHILDISDSPKEVRKNFQKTWQESGRVFKGLGYATADASATEMRTTFQEESAFISEAAAPRQGNMYTLSKDSLSNGVPSGRQAEFS

SEQ ID NO: 70019 - protein, 716 aa, Homo sapiens
MARYQAAVSRGDCRSFSANMMEESEMCAVPGGLAKVKKQFEDEITSSRNTFAQYQYQHQNRSEQEAIHSSQVGTSRSSQEMARNEQEGSKVQKIDVHGTEMVSHLEKHTEEVNQASQFHQYVQETVIDTPEDEEIPKVSTKLLKEQFEKSAQEKILYSDKEMTTPAKQIKKLLLQDKEICILCQKTVYPMECLVADKQNFHKSCFRCHHCNSKLSLGNYASLHGQIYCKPHFKQLFKSKGNYDEGFGHKQHKDRWNCKNQSRSVDFIPNEEPNMCKNIAENTLVPGDRNEHLDAGNSEGQRNDLRKLGERGKLKVIWPPSKEIPKKTLPFEEELKMSKPKWPPEMTTLLSPEFKSESLLEDVRTPENKGQRQDHFPFLQPYLQSTHVCQKEDVIGIKEMKMPEGRKDEKKEGRKNVQDRPSEAEDTKSNRKSAMDLNDNNNVIVQSAEKEKNEKTNQTNGAEVLQVTNTDDEMMPENHKENLNKNNNNNYVAVSYLNNCRQKTSILEFLDLLPLSSEANDTANEYEIEKLENTSRISELLGIFESEKTYSRNVLAMALKKQTDRAAAGSPVQPAPKPSLSRGLMVKGGSSIISPDTNLLNIKGSHSKSKNLHFFFSNTVKITAFSKKNENIFNCDLIDSVDQIKNMPCLDLREFGKDVKPWHVETTEAARNNENTGFDALSHECTAKPLFPRVEVQSEQLTVEEQIKRNRCYSDTE

SEQ ID NO: 70020 - protein, 938 aa, Homo sapiens; identical to SEQ ID NO: 70016

SEQ ID NO: 70021 - protein, 963 aa, Homo sapiens
MPLQKTNEEVSLSGIDSECTVVQPSPGSQSNARILGVCSDNQLSTTSPETVAAKRLHHVLAASEDKDKMKKEVLQSSRDIMQSKSACEIKQSHQECSTQQTQQKKYLEQLHLPQSKPISPNFKVKTIKLPTLDHTLNETDHSYESHKQQSEIDVQTFTKKQYLKTKKTEASTECSHKQSLAERHYQLPKKEKRVTVQLPTESIQKNQEDKLKMVPRKQREFSGSDRGKLPGSEEKNQGPSMIGRKEERLITERKHEHLKNKSAPKVVKQKVIDAHLDSQTQNFQQTQIQTAESKAEHKKLPQPYNSLQEEKCLEVKGIQEKQVFSNTKDSKQEITQNKSFFSSVKESQRDDGKGALNIVEFLRKREELQQILSRVKQFEAEPNKSGLKTFQTLLNTIPGWLISEDKREYAVHIAMENNLEKVKEEITHIKTQAEDMLVSYENIIQTAMMSSKTGKPGNKPTSLDETSSKVSNVHVSNNKNSEQKENKIAKEKTVQHQVAAHHEATVRSHVKTHQEIKLDDSNIPPPSLKTRPPSPTFITIESTARRTENPTKNELSQSPKKDSYVEPPPRRPMSQKSEIHRANTSPSPPRSRSEQLVRLKDTTAKLSKGAIPCPAATPVPIVEKRSEIIMSPATLRRQIKIETRGRDSPPTITIPVNINHAASGSFRESVDAQEEIRKVEKRATYVHKDGLNSTDHMVPDTESYDAVEIIRKVAVPPRLSEHTQRYEAANRTVQMAENFVNDPENEINRWFREFEHGPVSEAKSNRRVYAKGETNHNIQQESRTFCKEEFGLTSLGNTSFTDFSCKHPRELREKIPVKQPRICSETRSLSEHFSGMDAFESQIVESKMKTSSSHSSEAGKSGCDFKHAPPTYEDVIAGHILDISDSPKEVRKNFQKTWQESGRVFKGLGYATADASATEMRTTFQEESAFISEAAAPRQGNMYTLSKDSLSNGVPSGRQAEFS

SEQ ID NO: 70022 - protein, 971 aa, Homo sapiens
MFPMQKGSLNLLRQKWESCDYQRSECHPRDSHCTIFQPQESKLLAPEGEVVSAPQSLDPTSLPYSTGEEMWSSKPEEKDSVDKSNNTREYGRPEVLKEDSLSSRRRIERFSIALDELRSVFEAPKSGNKPAEYGGKEVEIERSLCSPAFKSHPGSQLEDSVKDSDKKGKETSFDKMSPESGHSRIFEAVFSTDQAQILRLHLHPKLTKTPKNSLKSSTYISTAGPNKPESGFAEDSAARGEGVSDLHEVVSLKERMARYQAAVSRGDCRSFSANMMEESEMCAVPGGLAKVKKQFEDEITSSRNTFAQYQYQHQNRSEQEAIHSSQVGTSRSSQEMARNEQEGSKVQKIDVHGTEMVSHLEKHTEEVNQASQFHQYVQETVIDTPEDEEIPKVSTKLLKEQFEKSAQEKILYSDKEMTTPAKQIKKLLLQDKEICILCQKTVYPMECLVADKQNFHKSCFRCHHCNSKLSLGNYASLHGQIYCKPHFKQLFKSKGNYDEGFGHKQHKDRWNCKNQSRSVDFIPNEEPNMCKNIAENTLVPGDRNEHLDAGNSEGQRNDLRKLGERGKLKVIWPPSKEIPKKTLPFEEELKMSKPKWPPEMTTLLSPEFKSESLLEDVRTPENKGQRQDHFPFLQPYLQSTHVCQKEDVIGIKEMKMPEGRKDEKKEGRKNVQDRPSEAEDTKSNRKSAMDLNDNNNVIVQSAEKEKNEKTNQTNGAEVLQVTNTDDEMMPENHKENLNKNNNNNYVAVSYLNNCRQKTSILEFLDLLPLSSEANDTANEYEIEKLENTSRISELLGIFESEKTYSRNVLAMALKKQTDRAAAGSPVQPAPKPSLSRGLMVKGGSSIISPDTNLLNIKGSHSKSKNLHFFFSNTVKITAFSKKNENIFNCDLIDSVDQIKNMPCLDLREFGKDVKPWHVETTEAARNNENTGFDALSHECTAKPLFPRVEVQSEQLTVEEQIKRNRCYSDTE

SEQ ID NO: 70023 - protein, 971 aa, Homo sapiens; identical to SEQ ID NO: 70022

SEQ ID NO: 70024 - protein, 459 aa, Homo sapiens
METVFEEMDEESTGGVSSSKEEIVLGQRLHLSFPFSIIFSTVLYCGEVAFGLYMFEIYRKANDTFWMSFTISFIIVGAILDQIILMFFNKDLRRNKAALLFWHILLLGPIVRCLHTIRNYHKWLKNLKQEKEETQVSITKRNTMLEREIAFSIRDNFMQQKAFKYMSVIQAFLGSVPQLILQMYISLTIREWPLNRALLMTFSLLSVTYGAIRCNILAIQISNDDTTIKLPPIEFFCVVMWRFLEVISRVVTLAFFIASLKLKSLPVLLIIYFVSLLAPWLEFWKSGAHLPGNKENNSNMVGTVLMLFLITLLYAAINFSCWSAVKLQLSDDKIIDGRQRWGHRILHYSFQFLENVIMILVFRFFGGKTLLNCCDSLIAVQLIISYLLATGFMLLFYQYLYPWQSGKVLPGRTENQPEAPYYYVNIEKTEKNKNKQLRNYCHSCNRVGYFSIRKSMTCS

SEQ ID NO: 70025 - protein, 462 aa, Homo sapiens
MNTRPQHSERTSTMDRVYEIPEEPNVDPVSSLEEDVIRGANPRFTFPFSILFSTFLYCGEAASALYMVRIYRKNSETYWMTYTFSFFMFSSIMVQLTLIFVHRDLAKDKPLSLFMHLILLGPVIRCLEAMIKYLTLWKKEEQEEPYVSLTRKKMLIDGEEVLIEWEVGHSIRTLAMHRNAYKRMSQIQAFLGSVPQLTYQLYVSLISAEVPLGRVVLMVFSLVSVTYGATLCNMLAIQIKYDDYKIRLGPLEVLCITIWRTLEITSRLLILVLFSATLKLKAVPFLVLNFLIILFEPWIKFWRSGAQMPNNIEKNFSRVGTLVVLISVTILYAGINFSCWSALQLRLADRDLVDKGQNWGHMGLHYSVRLVENVIMVLVFKFFGVKVLLNYCHSLIALQLIIAYLISIGFMLLFFQYLHPLRSLFTHNVVDYLHCVCCHQHPRTRVENSEPPFETEARQSVV

SEQ ID NO: 70026 - protein, 449 aa, Homo sapiens
MDRVYEIPEEPNVDPVSSLEEDVIRGANPRFTFPFSILFSTFLYCGEAASALYMVRIYRKNSETYWMTYTFSFFMFSSIMVQLTLIFVHRDLAKDKPLSLFMHLILLGPVIRCLEAMIKYLTLWKKEEQEEPYVSLTRKKMLIDGEEVLIEWEVGHSIRTLAMHRNAYKRMSQIQAFLGSVPQLTYQLYVSLISAEVPLGRVVLMVFSLVSVTYGATLCNMLAIQIKYDDYKIRLGPLEVLCITIWRTLEITSRLLILVLFSATLKLKAVPFLVLNFLIILFEPWIKFWRSGAQMPNNIEKNFSRVGTLVVLISVTILYAGINFSCWSALQLRLADRDLVDKGQNWGHMGLHYSVRLVENVIMVLVFKFFGVKVLLNYCHSLIALQLIIAYLISIGFMLLFFQYLHPLRSLFTHNVVDYLHCVCCHQHPRTRVENSEPPFETEARQSVV

SEQ ID NO: 70027 - protein, 444 aa, Homo sapiens
MKFPASVLASVFLFVAETTAALSLSSTYRSGGDRMWQALTLLFSLLPCALVQLTLLFVHRDLSRDRPLVLLLHLLQLGPLFRCFEVFCIYFQSGNNEEPYVSITKKRQMPKNGLSEEIEKEVGQAEGKLITHRSAFSRASVIQAFLGSAPQLTLQLYISVMQQDVTVGRSLLMTISLLSIVYGALRCNILAIKIKYDEYEVKVKPLAYVCIFLWRSFEIATRVVVLVLFTSVLKTWVVVIILINFFSFFLYPWILFWCSGSPFPENIEKALSRVGTTIVLCFLTLLYTGINMFCWSAVQLKIDSPDLISKSHNWYQLLVYYMIRFIENAILLLLWYLFKTDIYMYVCAPLLVLQLLIGYCTAILFMLVFYQFFHPCKKLFSSSVSEGFQRWLRCFCWACRQQKPCEPIGKEDLQSSRDRDETPSSSKTSPEPGQFLNAEDLCSA

SEQ ID NO: 70028 - protein, 642 aa, Homo sapiens
MAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYADGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 70029 - protein, 623 aa, Homo sapiens
MPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 70030 - protein, 552 aa, Homo sapiens
MWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 70031 - protein, 303 aa, Homo sapiens
MPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIP

SEQ ID NO: 70032 - protein, 666 aa, Homo sapiens
MAASRKPPRVRVNHQDFQLRNLRIIEPNEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFLQAAKQMDSNWTLMKMGLKDTPTQEDWLVSVLPEGSRVGVDPLIIPTDYWKKMAKVLRSAGHHLIPVKENLVDKIWTDRPERPCKPLLTLGLDYTGISWKDKVADLRLKMAERNVMWFVVTALDEIAWLFNLRGSDVEHNPVFFSYAIIGLETIMLFIDGDRIDAPSVKEHLLLDLGLEAEYRIQVHPYKSILSELKALCADLSPREKVWVSDKASYAVSETIPKDHRCCMPYTPICIAKAVKNSAESEGMRRAHIKDAVALCELFNWLEKEVPKGGVTEISAADKAEEFRRQQADFVDLSFPTISSTGPNGAIIHYAPVPETNRTLSLDEVYLIDSGAQYKDGTTDVTRTMHFGTPTAYEKECFTYVLKGHIAVSAAVFPTGTKGHLLDSFARSALWDSGLDYLHGTGHGVGSFLNVHEGPCGISYKTFSDEPLEAGMIVTDEPGYYEDGAFGIRIENVVLVVPVKTKYNFNNRGSLTFEPLTLVPIQTKMIDVDSLTDKECDWLNNYHLTCRDVIGKELQKQGRQEALEWLIRETQPISKQH

SEQ ID NO: 70033 - protein, 183 aa, Homo sapiens
MARAHWGCCPWLVLLCACAWGHTKPVDLGGQDVRNCSTNPPYLPVTVVNTTMSLTALRQQMQTQNLSAYIIPGTDAHMNEYIGQHDERRAWITGFTGSAGTAVVTMKKAAVWTDSRYWTQAERQMDCNWELHKEVGTTPIVTWLLTEIPAGGRVGFDPFLLSIGMLFLQSLNLSMLTRVTQLP

SEQ ID NO: 70034 - protein, 674 aa, Homo sapiens
MARAHWGCCPWLVLLCACAWGHTKPVDLGGQDVRNCSTNPPYLPVTVVNTTMSLTALRQQMQTQNLSAYIIPGTDAHMNEYIGQHDERRAWITGFTGSAGTAVVTMKKAAVWTDSRYWTQAERQMDCNWELHKEVGTTPIVTWLLTEIPAGGRVGFDPFLLSIDTWESYDLALQGSNRQLVSITTNLVDLVWGSERPPVPNQPIYALQEAFTGSTWQEKVSGVRSQMQKHQKVPTAVLLSALEETAWLFNLRASDIPYNPFFYSYTLLTDSSIRLFANKSRFSSETLSYLNSSCTGPMCVQIEDYSQVRDSIQAYSLGDVRIWIGTSYTMYGIYEMIPKEKLVTDTYSPVMMTKAVKNSKEQALLKASHVRDAVAVIRYLVWLEKNVPKGTVDEFSGAEIVDKFRGEEQFSSGPSFETISASGLNAALAHYSPTKELNRKLSSDEMYLLDSGGQYWDGTTDITRTVHWGTPSAFQKEAYTRVLIGNIDLSRLIFPAATSGRMVEAFARRALWDAGLNYGHGTGHGIGNFLCVHEWPVGFQSNNIAMAKGMFTSIEPGYYKDGEFGIRLEDVALVVEAKTKYPGSYLTFEVVSFVPYDRNLIDVSLLSPEHLQYLNRYYQTIREKVGPELQRRQLLEEFEWLQQHTEPLAARAPDTASWASVLVVSTLAILGWSV

SEQ ID NO: 70035 - protein, 507 aa, Homo sapiens
MPWLLSAPKLVPAVANVRGLSGCMLCSQRRYSLQPVPERRIPNRYLGQPSPFTHPHLLRPGEVTPGLSQVEYALRRHKLMSLIQKEAQGQSGTDQTVVVLSNPTYYMSNDIPYTFHQDNNFLYLCGFQEPDSILVLQSLPGKQLPSHKAILFVPRRDPSRELWDGPRSGTDGAIALTGVDEAYTLEEFQHLLPKMKAETNMVWYDWMRPSHAQLHSDYMQPLTEAKAKSKNKVRGVQQLIQRLRLIKSPAEIERMQIAGKLTSQAFIETMFTSKAPVEEAFLYAKFEFECRARGADILAYPPVVAGGNRSNTLHYVKNNQLIKDGEMVLLDGGCESSCYVSDITRTWPVNGRFTAPQAELYEAVLEIQRDCLALCFPGTSLENIYSMMLTLIGQKLKDLGIMKNIKENNAFKAARKYCPHHVGHYLGMDVHDTPDMPRSLPLQPGMVITIEPGIYIPEDDKDAPEKFRGLGVRIEDDVVVTQDSPLILSADCPKEMNDIEQICSQAS

SEQ ID NO: 70036 - protein, 278 aa, Homo sapiens
MPWLLSAPKLVPAVANVRGLSGCMLCSQRRYSLQPVPERRIPNRYLGQPSPFTHPHLLRPGEVTPGLSQVEYALRRHKLMSLIQKEAQGQSGTDQTVVVLSNPTYYMSNDIPYTFHQDNNFLYLCGFQEPDSILVLQSLPGKQLPSHKAILFVPRRDPSRELWDGPRSGTDGAIALTGVDEAYTLEEFQHLLPKMKAETNMVWYDWMRPSHAQLHSDYMQPLTEAKAKSKNKVRGVQQLIQRLRLIKSPAEIERMQIAGKLTSQRQGFSVLSRLVSNS

SEQ ID NO: 70037 - protein, 288 aa, Homo sapiens
MPWLLSAPKLVPAVANVRGLSGCMLCSQRRYSLQPVPERRIPNRYLGQPSPFTHPHLLRPGEVTPGLSQVEYALRRHKLMSLIQKEAQGQSGTDQTVVVLSNPTYYMSNDIPYTFHQDNNFLYLCGFQEPDSILVLQSLPGKQLPSHKAILFVPRRDPSRELWDGPRSGTDGAIALTGVDEAYTLEEFQHLLPKMKAETNMVWYDWMRPSHAQLHSDYMQPLTEAKAKSKNKVRGVQQLIQRLRLIKSPAEIERMQIAGKLTSQKSVLLARHGGSRLYSHHFGRPRLS

SEQ ID NO: 70038 - protein, 484 aa, Homo sapiens
MLCSQRRYSLQPVPERRIPNRYLGQPSPFTHPHLLRPGEVTPGLSQVEYALRRHKLMSLIQKEAQGQSGTDQTVVVLSNPTYYMSNDIPYTFHQDNNFLYLCGFQEPDSILVLQSLPGKQLPSHKAILFVPRRDPSRELWDGPRSGTDGAIALTGVDEAYTLEEFQHLLPKMKAETNMVWYDWMRPSHAQLHSDYMQPLTEAKAKSKNKVRGVQQLIQRLRLIKSPAEIERMQIAGKLTSQAFIETMFTSKAPVEEAFLYAKFEFECRARGADILAYPPVVAGGNRSNTLHYVKNNQLIKDGEMVLLDGGCESSCYVSDITRTWPVNGRFTAPQAELYEAVLEIQRDCLALCFPGTSLENIYSMMLTLIGQKLKDLGIMKNIKENNAFKAARKYCPHHVGHYLGMDVHDTPDMPRSLPLQPGMVITIEPGIYIPEDDKDAPEKFRGLGVRIEDDVVVTQDSPLILSADCPKEMNDIEQICSQAS

SEQ ID NO: 70039 - protein, 792 aa, Homo sapiens
MAFSGIYKLDDGKPYLNNCFPARNLLRVPEEGQGHWLVVQKGNLKKKPKGLVGAQAERRESLKATSFEFKGKKESRRENQVDLPGHILDQAFLLKHHCVRKPSDLCTINAKENDFKHFHSVIYINASENLLPLEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRGSPHKEPQFMLQSKPRMLEDSDEQLDYTVLPMKKDVDRTEVVFSSYPGFSTSETTKICSLPPIFEILPVKSLKARNQTLAPPFPELRYLSLAYNKIAKEDAVLPVALFPSLCEFVFHNNPLVAHTRGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRAQRIPIPPPKKTRAQLLDDIFIRLRDPRNITEAPLGAVLHQWTERRLVNHKQYLEAKRLLKEFQARYRQLVSGSLRTVFGTTPLPMACPALSESQPKFGHFLEFMDEFCQEPTASDSQG

SEQ ID NO: 70040 - protein, 778 aa, Homo sapiens
MAFSGIYKLDDGKPYLNNCFPARNLLRVPEEGQGHWLVVQKGNLKKKPKGLVGAQAERRESLKATSFEFKGKKESRRENQVDLPGHILDQAFLLKHHCVRKPSDLCTINAKENDFKHFHSVIYINASENLLPLEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRGSPHKEPQFMLQSKPRMLEDSDEQLDYTVLPMKKDVDRTTTKICSLPPIFEILPVKSLKARNQTLAPPFPELRYLSLAYNKIAKEDAVLPVALFPSLCEFVFHNNPLVAHTRGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRAQRIPIPPPKKTRAQLLDDIFIRLRDPRNITEAPLGAVLHQWTERRLVNHKQYLEAKRLLKEFQARYRQLVSGSLRTVFGTTPLPMACPALSESQPKFGHFLEFMDEFCQEPTASDSQG

SEQ ID NO: 70041 - protein, 736 aa, Homo sapiens
MAFSGIYKLDDGKPYLNNCFPARNLLRVPEEGQGHWLVVQKGNLKKKPKGLVGAQAERRESLKATSFEFKGKKESRRENQVDLPGHILDQAFLLKHHCVRKPSDLCTINAKENDFKHFHSVIYINASENLLPLEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRGSPHKEPQFMLQSKPRMLEDSDEQLDYTVLPMKKDVDRTIAKEDAVLPVALFPSLCEFVFHNNPLVAHTRGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRAQRIPIPPPKKTRAQLLDDIFIRLRDPRNITEAPLGAVLHQWTERRLVNHKQYLEAKRLLKEFQARYRQLVSGSLRTVFGTTPLPMACPALSESQPKFGHFLEFMDEFCQEPTASDSQG

SEQ ID NO: 70042 - protein, 296 aa, Homo sapiens
MAFSGIYKLDDGKPYLNNCFPARNLLRVPEEGQGHWLVVQKGNLKKKPKGLVGAQAERRESLKATSFEFKGKKESRRENQVDLPGHILDQAFLLKHHCVRKPSDLCTINVSGLKFSKAKENDFKHFHSVIYINASENLLPLEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRG

SEQ ID NO: 70043 - protein, 598 aa, Homo sapiens
MAFSGIYKLDDGKPYLNNCFPARNLLRVPEEGQGHWLVVQKGNLKKKPKGLVGAQAERRESLKATSFEFKGKKESRRENQVDLPGHILDQAFLLKHHCVRKPSDLCTINAKENDFKHFHSVIYINASENLLPLEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRGSPHKEPQFMLQSKPRMLEDSDEQLDYTVLPMKKDVDRTGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRVLSCTSGQNGGW

SEQ ID NO: 70044 - protein, 517 aa, Homo sapiens
MLDDNRLSNPSCFASLAGLRRLKKLSLDENRIIRIPYLQQVQLYDESVDWNGGRGSPHKEPQFMLQSKPRMLEDSDEQLDYTVLPMKKDVDRTEVVFSSYPGFSTSEIAKEDAVLPVALFPSLCEFVFHNNPLVAHTRGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRAQRIPIPPPKKTRAQLLDDIFIRLRDPRNITEAPLGAVLHQWTERRLVNHKQYLEAKRLLKEFQARYRQLVSGSLRTVFGTTPLPMACPALSESQPKFGHFLEFMDEFCQEPTASDSQG

SEQ ID NO: 70045 - protein, 327 aa, Homo sapiens
MFPSRRKAAQLPWEDGRSGLLSGGLPRKCSVFHLFVACLSLGFFSLLWLQLSCSGDVARAVRGQGQETSGPPRACPPEPPPEHWEEDASWGPHRLAVLVPFRERFEELLVFVPHMRRFLSRKKIRHHIYVLNQVDHFRFNRAALINVGFLESSNSTDYIAMHDVDLLPLNEELDYGFPEAGPFHVASPELHPLYHYKTYVGGILLLSKQHYRLCNGMSNRFWGWGREDDEFYRRIKGAGLQLFRPSGITTGYKTFRHLHDPAWRKRDQKRIAAQKQEQFKVDREGGLNTVKYHVASRTALSVGGAPCTVLNIMLDCDKTATPWCTFS

SEQ ID NO: 70046 - protein, 213 aa, Homo sapiens
MRRFLSRKKIRHHIYVLNQVDHFRFNRAALINVGFLESSNSTDYIAMHDVDLLPLNEELDYGFPEAGPFHVASPELHPLYHYKTYVGGILLLSKQHYRLCNGMSNRFWGWGREDDEFYRRIKGAGLQLFRPSGITTGYKTFRHLHDPAWRKRDQKRIAAQKQEQFKVDREGGLNTVKYHVASRTALSVGGAPCTVLNIMLDCDKTATPWCTFS

SEQ ID NO: 70047 - protein, 959 aa, Homo sapiens
MVAAPCARRLARRSHSALLAALTVLLLQTLVVWNFSSLDSGAGERRGGAAVGGGEQPPPAPAPRRERRDLPAEPAAARGGGGGGGGGGGGRGPQARARGGGPGEPRGQQPASRGALPARALDPHPSPLITLETQDGYFSHRPKEKVRTDSNNENSVPKDFENVDNSNFAPRTQKQKHQPELAKKPPSRQKELLKRKLEQQEKGKGHTFPGKGPGEVLPPGDRAAANSSHGKDVSRPPHARKTGGSSPETKYDQPPKCDISGKEAISALSRAKSKHCRQEIGETYCRHKLGLLMPEKVTRFCPLEGKANKNVQWDEDSVEYMPANPVRIAFVLVVHGRASRQLQRMFKAIYHKDHFYYIHVDKRSNYLHRQVLQVSRQYSNVRVTPWRMATIWGGASLLSTYLQSMRDLLEMTDWPWDFFINLSAADYPIRTNDQLVAFLSRYRDMNFLKSHGRDNARFIRKQGLDRLFLECDAHMWRLGDRRIPEGIAVDGGSDWFLLNRRFVEYVTFSTDDLVTKMKQFYSYTLLPAESFFHTVLENSPHCDTMVDNNLRITNWNRKLGCKCQYKHIVDWCGCSPNDFKPQDFHRFQQTARPTFFARKFEAVVNQEIIGQLDYYLYGNYPAGTPGLRSYWENVYDEPDGIHSLSDVTLTLYHSFARLGLRRAETSLHTDGENSCRYYPMGHPASVHLYFLADRFQGFLIKHHATNLAVSKLETLETWVMPKKVFKIASPPSDFGRLQFSEVGTDWDAKERLFRNFGGLLGPMDEPVGMQKWGKGPNVTVTVIWVDPVNVIAATYDILIESTAEFTHYKPPLNLPLRPGVWTVKILHHWVPVAETKFLVAPLTFSNRQPIKPEEALKLHNGPLRNAYMEQSFQSLNPVLSLPINPAQVEQARRNAASTGTALEGWLDSLVGGMWTAMDICATGPTACPVMQTCSQTAWSSFSPDPKSELGAVKPDGRLR

SEQ ID NO: 70048 - protein, 865 aa, Homo sapiens [sequence omitted]

SEQ ID NO: 70049 - protein, 676 aa, Homo sapiens
MVASARVQKLVRRYKLAIATALAILLLQGLVVWSFSGLEEDEAGEKGRQRKPRPLDPGEGSKDTDSSAGRRGSTGRRHGRWRGRAESPGVPVAKVVRAVTSRQRASRRVPPAPPPEAPGRQNLSGAAAGEALVGAAGFPPHGDTGSVEGAPQPTDNGFTPKCEIVGKDALSALARASTKQCQQEIANVVCLHQAGSLMPKAVPRHCQLTGKMSPGIQWDESQAQQPMDGPPVRIAYMLVVHGRAIRQLKRLLKAVYHEQHFFYIHVDKRSDYLHREVVELAQGYDNVRVTPWRMVTIWGGASLLRMYLRSMRDLLEVPGWAWDFFINLSATDYPTRTNEELVAFLSKNRDKNFLKSHGRDNSRFIKKQGLDRLFHECDSHMWRLGERQIPAGIVVDGGSDWFVLTRSFVEYVVYTDDPLVAQLRQFYTYTLLPAESFFHTVLENSLACETLVDNNLRVTNWNRKLGCKCQYKHIVDWCGCSPNDFKPQDFLRLQQVSRPTFFARKFESTVNQEVLEILDFHLYGSYPPGTPALKAYWENTYDAADGPSGLSDVMLTAYTAFARLSLHHAATAAPPMGTPLCRFEPRGLPSSVHLYFYDDHFQGYLVTQAVQPSAQGPAETLEMWLMPQGSLKLLGRSDQASRLQSLENRGLSMLPRLVSNSWPQAVLPLQPPKALG

SEQ ID NO: 70050 - protein, 536 aa, Homo sapiens
MAEHAPRRCCLGWDFSTQQVKVVAVDAELNVFYEESVHFDRDLPEFGTQGGVHVHKDGLTVTSPVLMWVQALDIILEKMKASGFDFSQVLALSGAGQQHGSIYWKAGAQQALTSLSPDLRLHQQLQDCFSISDCPVWMDSSTTAQCRQLEAAVGGAQALSCLTGSRAYERFTGNQIAKIYQQNPEAYSHTERISLVSSFAASLFLGSYSPIDYSDGSGMNLLQIQDKVWSQACLGACAPHLEEKLSPPVPSCSVVGAISSYYVQRYGFPPGCKVVAFTGDNPASLAGMRLEEGDIAVSLGTSDTLFLWLQEPMPALEGHIFCNPVDSQHYMALLCFKNGSLMREKIRNESVSRSWSDFSKALQSTEMGNGGNLGFYFDVMEITPEIIGRHRFNTENHKVAAFPGDVEVRALIEGQFMAKRIHAEGLGYRVMSKTKILATGGASHNREILQVLADVFDAPVYVIDTANSACVGSAYRAFHGLAGGTDVPFSEVVKLAPNPRLAATPSPGASQVYEALLPQYAKLEQRILSQTRGPPE

SEQ ID NO: 70051 - protein, 399 aa, Homo sapiens
MDSSTTAQCRQLEAAVGGAQALSCLTGSRAYERFTGNQIAKIYQQNPEAYSHTERISLVSSFAASLFLGSYSPIDYSDGSGMNLLQIQDKVWSQACLGACAPHLEEKLSPPVPSCSVVGAISSYYVQRYGFPPGCKVVAFTGDNPASLAGMRLEEGDIAVSLGTSDTLFLWLQEPMPALEGHIFCNPVDSQHYMALLCFKNGSLMREKIRNESVSRSWSDFSKALQSTEMGNGGNLGFYFDVMEITPEIIGRHRFNTENHKVAAFPGDVEVRALIEGQFMAKRIHAEGLGYRVMSKTKILATGGASHNREILQVLADVFDAPVYVIDTANSACVGSAYRAFHGLAGGTDVPFSEVVKLAPNPRLAATPSPGASQVYEALLPQYAKLEQRILSQTRGPPE

SEQ ID NO: 70052 - protein, 1422 aa, Homo sapiens
MSGIKRTIKETDPDYEDVSVALPNKRHKAIENSARDAAVQKIETIIKEQFALEMKNKEHEIEVIDQRLIEARRMMDKLRACIVANYYASAGLLKVSEGSKTCDTMVFNHPAIKKFLESPSRSSSPANQRAETPSANHSESDSLSQHNDFLSDKDNNSNMDIEERLSNNMEQRPSRNTGRDTSRITGSHKTEQRNADLTDETSRLFVKKTIVVGNVSKYIPPDKREENDQSTHKWMVYVRGSRREPSINHFVKKVWFFLHPSYKPNDLVEVREPPFHLTRRGWGEFPVRVQVHFKDSQNKRIDIIHNLKLDRTYTGLQTLGAETVVDVELHRHSLGEDCIYPQSSESDISDAPPSLPLTIPAPVKASSPIKQSHEPVPDTSVEKGFPASTEAERHTPFYALPSSLERTPTKMTTSQKVTFCSHGNSAFQPIASSCKIVPQSQVPNPESPGKSFQPITMSCKIVSGSPISTPSPSPLPRTPTSTPVHVKQGTAGSVINNPYVIMDKQPGQVIGATTPSTGSPTNKISTASQVSQGTGSPVPKIHGSSFVTSTVKQEDSLFASMPPLCPIGSHPKVQSPKPITGGLGAFTKVIIKQEPGEAPHVPATGAASQSPLPQYVTVKGGHMIAVSPQKQVITPGEGIAQSAKVQPSKVVGVPVGSALPSTVKQAVAISGGQILVAKASSSVSKAVGPKQVVTQGVAKAIVSGGGGTIVAQPVQTLTKAQVTAAGPQKSGSQGSVMATLQLPATNLANLANLPPGTKLYLTTNSKNPSGKGKLLLIPQGAILRATNNANLQSGSAASGGSGAGGGGGGGGGGGSGSGGGGSTGGGGGTAGGGTQSTAGPGGISQHLTYTSYILKQTPQGTFLVGQPSPQTSGKQLTTGSVVQGTLGVSTSSAQGQQTLKVISGQKTTLFTQAAHGGQASLMKISDSTLKTVPATSQLSKPGTTMLRVAGGVITTATSPAVALSANGPAQQSEGMAPVSSSTVSSVTKTSGQQQVCVSQATVGTCKAATPTVVSATSLVPTPNPISGKATVSGLLKIHSSQSSPQQAVLTIPSQLKPLSVNTSGGVQTILMPVNKVVQSFSTSKPPAILPVAAPTPVVPSSAPAAVAKVKTEPETPGPSCLSQEGQTAVKTEESSELGNYVIKIDHLETIQQLLTAVVKKIPLITAKSEDASCFSAKSVEQYYGWNIGKRRAAEWQRAMTMRKVLQEILEKNPRFHHLTPLKTKHIAHWCRCHGYTPPDPESLRNDGDSIEDVLTQIDSEPECPSSFSSADNLCRKLEDLQQFQKREPENEEEVDILSLSEPVKINIKKEQEEKQEEVKFYLPPTPGSEFIGDVTQKIGITLQPVALHRNVYASVVEDMILKATEQLVNDILRQALAVGYQTASHNRIPKEITVSNIHQAICNIPFLDFLTNKHMGILNEDQ

SEQ ID NO: 70053 - protein, 1422 aa, Homo sapiens; identical to SEQ ID NO: 70052

SEQ ID NO: 70054 - protein, 227 aa, Homo sapiens
MFKRMAEFGPDSGGRVKGVTIVKPIVYGNVARYFGKKREEDGHTHQWTVYVKPYRNEDMSAYVKKIQFKLHESYGNPLRVVTKPPYEITETGWGEFEIIIKIFFIDPNERPVTLYHLLKLFQSDTNAMLGKKTVVSEFYDEMIFQDPTAMMQQLLTTSRQLTLGAYKHETEFAELEVKTREKLEAAKKKTSFEIAELKERLKASRETINCLKNEIRKLEEDDQAKDI

SEQ ID NO: 70055 - protein, 350 aa, Homo sapiens
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSH

SEQ ID NO: 70056 - protein, 257 aa, Homo sapiens
MSGFENLNTDFYQTSYSIDDQSQQSYDYGGSGGPYSKQYAGYDYSQQGRFVPPDMMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISALAMEGQQLLVAYPCALLYGVFALISVF

SEQ ID NO: 70057 - protein, 265 aa, Homo sapiens
MSGFENLNTDFYQTSYSIDDQSQQSYDYGGSGGPYSKQYAGYDYSQQGRFVPPDMMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISALAMEGQQLLVALQPNITYGSNYFLFCCLPYPQQHF

SEQ ID NO: 70058 - protein, 257 aa, Homo sapiens; identical to SEQ ID NO: 70056

SEQ ID NO: 70059 - protein, 203 aa, Homo sapiens
MMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISALAMEGQQLLVAYPCALLYGVFALISVF

SEQ ID NO: 70060 - protein, 177 aa, Homo sapiens
MMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISAL

SEQ ID NO: 70061 - protein, 101 aa, Homo sapiens
MMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGI

SEQ ID NO: 70062 - protein, 142 aa, Homo sapiens
MSGFENLNTDFYQTSYSIDDQSQQSYDYGGSGGPYSKQYAGYDYSQQGRFVPPDMMQPQQPYTGQIYQPTQAYTPASPQPFYGNNFEDEPPLLEELGINFDHIWQKTLTVLHPLKVADGSIMNETDLAQWFFALLLEPHCYW

SEQ ID NO: 70063 - protein, 293 aa, Homo sapiens
MAYHSGYGAHGSKHRARAAPDPPPLFDDTSGGYSSQPGGYPATGADVAFSVNHLLGDPMANVAMAYGSSIASHGKDMVHKELHRFVSVSKLKYFFAVDTAYVAKKLGLLVFPYTHQNWEVQYSRDAPLPPRQDLNAPDLYIPTMAFITYVLLAGMALGIQKRFSPEVLGLCASTALVWVVMEVLALLLGLYLATVRSDLSTFHLLAYSGYKYVGMILSVLTGLLFGSDGYYVALAWTSSALMYFIVRSLRTAALGPDSMGGPVPRQRLQLYLTLGAAAFQPLIIYWLTFHLVR

SEQ ID NO: 70064 - protein, 119 aa, Homo sapiens
MVKMTKSKTFQAYLPNCHRTYSCIHCRAHLANHDELISKSFQGSQGRAYLFNSVVNVGCGPAEERVLLTGLHAVADIYCENCKTTLGWKYEHAFESSQKYKEGKFIIELAHMIKDNGWE

SEQ ID NO: 70065 - protein, 119 aa, Homo sapiens
MVKMTRSKTFQAYLPSCHRTYSCIHCRAHLANHDELISKSFQGSQGRAYLFNSVVNVGCGPAEERVLLTGLHAVADIYCENCKTTLGWKYEHAFESSQKYKEGKYIIELAHMIKDNGWD

SEQ ID NO: 70066 - protein, 119 aa, Homo sapiens
MVRISKPKTFQAYLDDCHRRYSCAHCRAHLANHDDLISKSFQGSQGRAYLFNSVVNVGCGPAEERVLLTGLHAVADIHCENCKTTLGWKYEQAFESSQKYKEGKYIIELNHMIKDNGWD

SEQ ID NO: 70067 - protein, 157 aa, Homo sapiens
MCVAQVLTAHLLPPRQALGSLCSPWAAPRVGPLPPAPAMVRISKPKTFQAYLDDCHRRYSCAHCRAHLANHDDLISKSFQGSQGRAYLFNSVVNVGCGPAEERVLLTGLHAVADIHCENCKTTLGWKYEQAFESSQKYKEGKYIIELNHMIKDNGWD

SEQ ID NO: 70068 - protein, 127 aa, Homo sapiens
MPSCDPGPGPACLPTKTFRSYLPRCHRTYSCVHCRAHLAKHDELISKSFQGSHGRAYLFNSVVNVGCGPAEQRLLLTGLHSVADIFCESCKTTLGWKYEQAFETSQKYKEGKYIIEMSHMVKDNGWD

SEQ ID NO: 70069 - protein, 127 aa, Homo sapiens; identical to SEQ ID NO: 70068

SEQ ID NO: 70070 - protein, 127 aa, Homo sapiens; identical to SEQ ID NO: 70068

SEQ ID NO: 70071 - protein, 80 aa, Homo sapiens
MPSCDPGPGPACLPTKTFRSYLPRCHRTYSCVHCRAHLAKHDELISKSFQGSHGRAYLFNSVVNVGCGPAEQRLLLTGLH

SEQ ID NO: 70072 - protein, 127 aa, Homo sapiens; identical to SEQ ID NO: 70068

SEQ ID NO: 70073 - protein, 121 aa, Homo sapiens
MGRIFLDHIGGTRLFSCANCDTILTNRSELISTRFTGATGRAFLFNKVVNLQYSEVQDRVMLTGRHMVRDVSCKNCNSKLGWIYEFATEDSQRYKEGRVILERALVRESEGFEEHVPSDNS

SEQ ID NO: 70074 - protein, 121 aa, Homo sapiens; identical to SEQ ID NO: 70073

SEQ ID NO: 70075 - protein, 121 aa, Homo sapiens; identical to SEQ ID NO: 70073

SEQ ID NO: 70076 - protein, 121 aa, Homo sapiens; identical to SEQ ID NO: 70073

SEQ ID NO: 70077 - protein, 121 aa, Homo sapiens; identical to SEQ ID NO: 70073

SEQ ID NO: 70078 - protein, 773 aa, Homo sapiens
MFSLSSTVQPQVTVPLSHLINAFHTPKNTSVSLSGVSVSQNQHRDVVPEHEAPSSECMFSDFLTKLNIVSIGKGKIFEGYRSMFMEPAKRMKKSLDTTDNWHIRPEPFSLSIPPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEIRILLRDSYERAKHILKTHAKEHKNLAEALLTYETLDAKEIQIVLEGKKLEVR

SEQ ID NO: 70079 - protein, 740 aa, Homo sapiens
MFSLSSTVQPQVTVPLSHLINAFHTPKNTSVSLSGVSVSQNQHRDVVPEHEAPSSECMFSDFLTKLNIVSIGKGKIFEGYRSMFMEPAKRMKKSLDTTDNWHIRPEPFSLSIPPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEIRILLRDSYERAKHILKTHS

SEQ ID NO: 70080 - protein, 683 aa, Homo sapiens
MFSLSSTVQPQVTVPLSHLINAFHTPKNTSVSLSGVSVSQNQHRDVVPEHEAPSSEPSLNLRDLGLSELKIGQIDQLVENLLPGFCKGKNISSHWHTSHVSAQSFFENKYVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEIRILLRDSYERAKHILKTHAKEHKNLAEALLTYETLDAKEIQIVLEGKKLEVR

SEQ ID NO: 70081 - protein, 716 aa, Homo sapiens
MFSLSSTVQPQVTVPLSHLINAFHTPKNTSVSLSGVSVSQNQHRDVVPEHEAPSSEPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEIRILLRDSYERAKHILKTHAKEHKNLAEALLTYETLDAKEIQIVLEGKKLEVR

SEQ ID NO: 70082 - protein, 248 aa, Homo sapiens
MYQVTVPLSHLINAFHTPKNTSVSLSGVSVSQNQHRDVVPEHEAPSSEPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPF

SEQ ID NO: 70083 - protein, 253 aa, Homo sapiens
MFSLSSTVQPQVTVPLSHLINAFHTPKNTSVSLSGVSVSQNQHRDVVPEHEAPSSEPSLNLRDLGLSELKIGQIDQLVENLLPGFCKGKNISSHWHTSHVSAQSFFENKYVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKG

SEQ ID NO: 70084 - protein, 516 aa, Homo sapiens
MKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEIRILLRDSYERAKHILKTHAKEHKNLAEALLTYETMPKRFKLFLRGKSWK

SEQ ID NO: 70085 - protein, 348 aa, Homo sapiens
MFGPAKGRHFGVHPAPGFPGGVSQQAAGTKAGPAGAWPVGSRTDTMWRLRCKAKDGTHVLQGLSSRTRVRELQGQIAAITGIAPGGQRILVGYPPECLDLSNGDTILEDLPIQSGDMLIIEEDQTRPRSSPAFTKRGASSYVRETLPVLTRTVVPADNSCLFTSVYYVVEGGVLNPACAPEMRRLIAQIVASDPDFYSEAILGKTNQEYCDWIKRDDTWGGAIEISILSKFYQCEICVVDTQTVRIDRFGEDAGYTKRVLLIYDGIHYDPLQRNFPDPDTPPLTIFSSNDDIVLVQALELADEARRRRQFTDVNRFTLRCMVCQKGLTGQAEAREHAKETGHTNFGEV

SEQ ID NO: 70086 - protein, 304 aa, Homo sapiens
METLHIIYSEAKSFTVEGLSSRTRVRELQGQIAAITGIAPGGQRILVGYPPECLDLSNGDTILEDLPIQSGDMLIIEEDQTRPRSSPAFTKRGASSYVRETLPVLTRTVVPADNSCLFTSVYYVVEGGVLNPACAPEMRRLIAQIVASDPDFYSEAILGKTNQEYCDWIKRDDTWGGAIEISILSKFYQCEICVVDTQTVRIDRFGEDAGYTKRVLLIYDGIHYDPLQRNFPDPDTPPLTIFSSNDDIVLVQALELADEARRRRQFTDVNRFTLRCMVCQKGLTGQAEAREHAKETGHTNFGEV

SEQ ID NO: 70087 - protein, 304 aa, Homo sapiens; identical to SEQ ID NO: 70086

SEQ ID NO: 70088 - protein, 279 aa, Homo sapiens
MSPARRCRGMRAAVAASVGLSEGPAGSRSGRLFRPPSPAPAAPGARLLRLPGSGAVQAASPERAGWTEALRAAVAELRAGAVVAVPTDTLYGLACAASCSAALRAVYRLKGRSEAKPLAVCLGRVADVYRYCRVRVPEGLLKDLLPGPVTLVMERSEELNKDLNPFTPLVGIRIPDHAFMQDLAQMFEGPLALTSANLSSQASSLNVEEFQDLWPQLSLVIDGGQIGDGQSPECRLGSTVVDLSVPGKFGIIRPGCALESTTAILQQKYGLLPSHASYL

SEQ ID NO: 70089 - protein, 579 aa, Homo sapiens
MSASSLLEQRPKGQGNKVQNGSVHQKDGLNDDDFEPYLSPQARPNNAYTAMSDSYLPSYYSPSIGFSYSLGEAAWSTGGDTAMPYLTSYGQLSNGEPHFLPDAMFGQPGALGSTPFLGQHGFNFFPSGIDFSAWGNNSSQGQSTQSSGYSSNYAYAPSSLGGAMIDGQSAFANETLNKAPGMNTIDQGMAALKLGSTEVASNVPKVVGSAVGSGSITSNIVASNSLPPATIAPPKPASWADIASKPAKQQPKLKTKNGIAGSSLPPPPIKHNMDIGTWDNKGPVAKAPSQALVQNIGQPTQGSPQPVGQQANNSPPVAQASVGQQTQPLPPPPPQPAQLSVQQQAAQPTRWVAPRNRGSGFGHNGVDGNGVGQSQAGSGSTPSEPHPVLEKLRSINNYNPKDFDWNLKHGRVFIIKSYSEDDIHRSIKYNIWCSTEHGNKRLDAAYRSMNGKGPVYLLFSVNGSGHFCGVAEMKSAVDYNTCAGVWSQDKWKGRFDVRWIFVKDVPNSQLRHIRLENNENKPVTNSRDTQEVPLEKAKQVLKIIASYKHTTSIFDDFSHYEKRQEEEESVKKERQGRGK

SEQ ID NO: 70090 - protein, 569 aa, Homo sapiens
MSASSLLEQRPKGQGNKVQNGSVHQKDGLNDDDFEPYLSPQARPNNAYTAMSDSYLPSYYSPSIGFSYSLGEAAWSTGGDTAMPYLTSYGQLSNGEPHFLPDAMFGQPGALGSTPFLGQHGFNFFPSGIDFSAWGNNSSQGQSTQSSGYSSNYAYAPSSLGGAMIDGQSAFANETLNKAPGMNTIDQGMAALKLGSTEVASNVPKVVGSAVGSGSITSNIVASNSLPPATIAPPKPASWADIASKPAKQQPKLKTKNGIAGSSLPPPPIKHNMDIGTWDNKGPVAKAPSQALVQNIGQPTQGSPQPVGQQANNSPPVAQASVGQQTQPLPPPPPQPAQLSVQQQAAQPTRWVAPRNRGSGFGHNGVDGNGVGQSQAGSGSTPSEPHPVLEKLRSINNYNPKDFDWNLKHGRVFIIKSYSEDDIHRSIKYNIWCSTEHGNKRLDAAYRSMNGKGPVYLLFSVNGSGHFCGVAEMKSAVDYNTCAGVWSQDKWKGRFDVRWIFVKDVPNSQLRHIRLENNENKPVTNSRDTQEVPLEKAKQVLKIIASYKHTTSIFDDFSHYEKRQGRRKC

SEQ ID NO: 70091 - protein, 529 aa, Homo sapiens
MSDSYLPSYYSPSIGFSYSLGEAAWSTGGDTAMPYLTSYGQLSNGEPHFLPDAMFGQPGALGSTPFLGQHGFNFFPSGIDFSAWGNNSSQGQSTQSSGYSSNYAYAPSSLGGAMIDGQSAFANETLNKAPGMNTIDQGMAALKLGSTEVASNVPKVVGSAVGSGSITSNIVASNSLPPATIAPPKPASWADIASKPAKQQPKLKTKNGIAGSSLPPPPIKHNMDIGTWDNKGPVAKAPSQALVQNIGQPTQGSPQPVGQQANNSPPVAQASVGQQTQPLPPPPPQPAQLSVQQQAAQPTRWVAPRNRGSGFGHNGVDGNGVGQSQAGSGSTPSEPHPVLEKLRSINNYNPKDFDWNLKHGRVFIIKSYSEDDIHRSIKYNIWCSTEHGNKRLDAAYRSMNGKGPVYLLFSVNGSGHFCGVAEMKSAVDYNTCAGVWSQDKWKGRFDVRWIFVKDVPNSQLRHIRLENNENKPVTNSRDTQEVPLEKAKQVLKIIASYKHTTSIFDDFSHYEKRQEEEESVKKERQGRGK

SEQ ID NO: 70092 - protein, 579 aa, Homo sapiens; identical to SEQ ID NO: 70089

SEQ ID NO: 70093 - protein, 414 aa, Homo sapiens
MASGDTLYIATDGSEMPAEIVELHEIEVETIPVETIETTVVGEEEEEDDDDEDGGGGDHGGGGGHGHAGHHHHHHHHHHHPPMIALQPLVTDDPTQVHHHQEVILVQTREEVVGGDDSDGLRAEDGFEDQILIPVPAPAGGDDDYIEQTLVTVAAAGKSGGGGSSSSGGGRVKKGGGKKSGKKSYLSGGAGAAGGGGADPGNKKWEQKQVQIKTLEGEFSVTMWSSDEKKDIDHETVVEEQIIGENSPPDYSEYMTGKKLPPGGIPGIDLSDPKQLAEFARMKPRKIKEDDAPRTIACPHKGCTKMFRDNSAMRKHLHTHGPRVHVCAECGKAFVESSKLKRHQLVHTGEKPFQCTFEGCGKRFSLDFNLRTHVRIHTGDRPYVCPFDGCNKKFAQSTNLKSHILTHAKAKNNQ

SEQ ID NO: 70094 - protein, 34 aa, Homo sapiens
MASGDTLYIATDGSEMPAEIVELHEIEVETIPVE

SEQ ID NO: 70095 - protein, 406 aa, Homo sapiens
MAQAPADPGREGHLEQRILQVLTEAGSPVKLAQLVKECQAPKRELNQVLYRMKKELKVSLTSPATWCLGGTDPEGEGPAELALSSPEEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGSAGPRHLPSMAPGDSSTWGTLVDPWGPQDIHMEQSILRRVQLGHSNEMRLHGVPSEGPAHIPPGSPPVSATAAGPEASFEARIPSPGTHPEGEAAQRIHMKSCFLEDATIGNSNKMSISPGVAGPGGVAGSGEGEPGEDAGRRPADTQSRSHFPRDIGQPITPSHSKLTPKLETMTLGNRSHKAAEGSHYVDEASHEGSWWGGGI

SEQ ID NO: 70096 - protein, 446 aa, Homo sapiens
MAQAPADPGREGHLEQRILQVLTEAGSPVKLAQLVKECQAPKRELNQVLYRMKKELKVSLTSPATWCLGGTDPEGEGPAELALSSPAERPQQHAATIPETPGPQFSQQREEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGSAGPRHLPSMAPGDSSTWGTLVDPWGPQDIHMEQSILRRVQLGHSNEMRLHGVPSEGPAHIPPGSPPVSATAAGPEASFEARIPSPGTHPEGEAAQRIHMKSCFLEDATIGNSNKMSISPGVAGPGGVAGSGEGEPGEDAVAAFTEVLNPSKSFMKFGINFFQTPVNVDSLTSSHESQMFLTACRLVIFSRRFSTYFAQIHLRNHSVLHLCPHKIYLLKNKK

SEQ ID NO: 70097 - protein, 380 aa, Homo sapiens
MAQAPADPGREGHLEQRILQVLTEAGSPVKLAQLVKECQAPKRELNQVLYRMKKELKVSLTSPATWCLGGTDPEGEGPAELALSSPAERPQQHAATIPETPGPQFSQQREEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGSAGPRHLPSMAPGDSSTWGTLVDPWGPQDIHMEQSILRRVQLGHSNEMRLHGVPSEGPAHIPPGSPPVSATAAGPEASFEARIPSPGTHPEGEAAQRIHMKSCFLEDATIGNSNKMSISPGVAGPGGVAGSGEGEPGEDAGRRPADTQARSFDGQE

SEQ ID NO: 70098 - protein, 429 aa, Homo sapiens
MAQAPADPGREGHLEQRILQVLTEAGSPVKLAQLVKECQAPKRELNQVLYRMKKELKVSLTSPATWCLGGTDPEGEGPAELALSSPAERPQQHAATIPETPGPQFSQQREEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGSAGPRHLPSMAPGDSSTWGTLVDPWGPQDIHMEQSILRRVQLGHSNEMRLHGVPSEGPAHIPPGSPPVSATAAGPEASFEARIPSPGTHPEGEAAQRIHMKSCFLEDATIGNSNKMSISPGVAGPGGVAGSGEGEPGEDAGRRPADTQSRSHFPRDIGQPITPSHSKLTPKLETMTLGNRSHKAAEGSHYVDEASHEGSWWGGGI

SEQ ID NO: 70099 - protein, 248 aa, Homo sapiens
MAQAPADPGREGHLEQRILQVLTEAGSPVKLAQLVKECQAPKRELNQVLYRMKKELKVSLTSPATWCLGGTDPEGEGPAELALSSPAERPQQHAATIPETPGPQFSQQREEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGKSPKRAQGGDLGGEPPDPLGGGKG

SEQ ID NO: 70100 - protein, 354 aa, Homo sapiens
MAQAPADPGREAERPQQHAATIPETPGPQFSQQREEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGSAGPRHLPSMAPGDSSTWGTLVDPWGPQDIHMEQSILRRVQLGHSNEMRLHGVPSEGPAHIPPGSPPVSATAAGPEASFEARIPSPGTHPEGEAAQRIHMKSCFLEDATIGNSNKMSISPGVAGPGGVAGSGEGEPGEDAGRRPADTQSRSHFPRDIGQPITPSHSKLTPKLETMTLGNRSHKAAEGSHYVDEASHEGSWWGGGI

SEQ ID NO: 70101 - protein, 619 aa, Homo sapiens
MPDPAAHLPFFYGSISRAEAEEHLKLAGMADGLFLLRQCLRSLGGYVLSLVHDVRFHHFPIERQLNGTYAIAGGKAHCGPAELCEFYSRDPDGLPCNLRKPCNRPSGLEPQPGVFDCLRDAMVRDYVRQTWKLEGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 70102 - protein, 493 aa, Homo sapiens
MRLGPRWKGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 70103 - protein, 312 aa, Homo sapiens
MPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 70104 - protein, 447 aa, Homo sapiens
MLLDAGPQYPAIGVTTFGASRHHSAGDVAERDVGLGINPFADGMGAFKLNPSSHELASAGQTAFTSQAPGYAAAAALGHHHHPGHVGSYSSAAFNSTRDFLFRNRGFGDAAAAASAQHSLFAASAGGFGGPHGHTDAAGHLLFPGLHEQAAGHASPNVVNGQMRLGFSGDMYPRPEQYGQVTSPRSEHYAAPQLHGYGPMNVNMAAHHGAGAFFRYMRQPIKQELICKWIEPEQLANPKKSCNKTFSTMHELVTHVTVEHVGGPEQSNHICFWEECPREGKPFKAKYKLVNHIRVHTGEKPFPCPFPGCGKVFARSENLKIHKRTHTGEKPFKCEFEGCDRRFANSSDRKKHMHVHTSDKPYLCKMCDKSYTHPSSLRKHMKVHESSSQGSQPSPAASSGYESSTPPTIVSPSTDNPTTSSLSPSSSAVHHTAGHSALSSNFNEWYV

SEQ ID NO: 70105 - protein, 532 aa, Homo sapiens
MLLDAGPQFPAIGVGSFARHHHHSAAAAAAAAAEMQDRELSLAAAQNGFVDSAAAHMGAFKLNPGAHELSPGQSSAFTSQGPGAYPGSAAAAAAAAALGPHAAHVGSYSGPPFNSTRDFLFRSRGFGDSAPGGGQHGLFGPGAGGLHHAHSDAQGHLLFPGLPEQHGPHGSQNVLNGQMRLGLPGEVFGRSEQYRQVASPRTDPYSAAQLHNQYGPMNMNMGMNMAAAAAHHHHHHHHHPGAFFRYMRQQCIKQELICKWIDPEQLSNPKKSCNKTFSTMHELVTHVSVEHVGGPEQSNHVCFWEECPREGKPFKAKYKLVNHIRVHTGEKPFPCPFPGCGKVFARSENLKIHKRTHTGEKPFQCEFEGCDRRFANSSDRKKHMHVHTSDKPYLCKMCDKSYTHPSSLRKHMKVHESSPQGSESSPAASSGYESSTPPGLVSPSAEPQSSSNLSPAAAAAAAAAAAAAAAVSAVHRGGGSGSGGAGGGSGGGSGSGGGGGGAGGGGGGSSGGGSGTAGGHSGLSSNFNEWYV

SEQ ID NO: 70106 - protein, 162 aa, Homo sapiens
PPPPPPPPAPPPPPPLNPKKSCNKTFSTMHELVTHVSVEHVGGPEQSNHVCFWEECPREGKPFKAKYKLVNHIRVHTGEKPFPCPFPGCGKVFARSENLKIHKRTHTGEKPFQCEFEGCDRRFANSSDRKKHMHVHTSDKPYLCKMCDKSYTHPSSLRKHMK

SEQ ID NO: 70107 - protein, 260 aa, Homo sapiens
MLLDAGPQFPAIGVGSFARHHHHSAAAAAAAAAEMQDRELSLAAAQNGFVDSAAAHMGAFKLNPGAHELSPGQSSAFTSQGPGAYPGSAAAAAAAAALGPHAAHVGSYSGPPFNSTRDFLFRSRGFGDSAPGGGQHGLFGPGAGGLHHAHSDAQGHLLFPGLPEQHGPHGSQNVLNGQMRLGLPGEVFGRSEQYRQVASPRTDPYSAAQLHNQYGPMNMNMGMNMAAAAAHHHHHHHHPVPSLLTNCVHSGLLLSPPRWF

SEQ ID NO: 70108 - protein, 467 aa, Homo sapiens
MTMLLDGGPQFPGLGVGSFGAPRHHEMPNREPAGMGLNPFGDSTHAAAAAAAAAAFKLSPAAAHDLSSGQSSAFTPQGSGYANALGHHHHHHHHHHHTSQVPSYGGAASAAFNSTREFLFRQRSSGLSEAASGGGQHGLFAGSASSLHAPAGIPEPPSYLLFPGLHEQGAGHPSPTGHVDNNQVHLGLRGELFGRADPYRPVASPRTDPYAAGAQFPNYSPMNMNMGVNVAAHHGPGAFFRYMRQPIKQELSCKWIDEAQLSRPKKSCDRTFSTMHELVTHVTMEHVGGPEQNNHVCYWEECPREGKSFKAKYKLVNHIRVHTGEKPFPCPFPGCGKIFARSENLKIHKRTHTGEKPFKCEFEGCDRRFANSSDRKKHMHVHTSDKPYICKVCDKSYTHPSSLRKHMKVHESQGSDSSPAASSGYESSTPPAIASANSKDTTKTPSAVQTSTSHNPGLPPNFNEWYV

SEQ ID NO: 70109 - protein, 457 aa, Homo sapiens
MTMLLDGGPQFPGLGVGSFGAPRHHEMPNREPAGMGLNPFGDSTHAAAAAAAAAAFKLSPAAAHDLSSGQSSAFTPQGSGYANALGHHHHHHHHHHHTSQVPSYGGAASAAFNSTREFLFRQRSSGLSEAASGGGQHGLFAGSASSLHAPAGIPEPPSYLLFPGLHEQGAGHPSPTGHVDNNQVHLGLRGELFGRADPYRPVASPRTDPYAAGAQFPNYSPMNMNMGVNVAAHHGPGAFFRYMRQPIKQELSCKWIDEAQLSRPKKSCDRTFSTMHELVTHVTMEHVGGPEQNNHVCYWEECPREGKSFKAKYKLVNHIRVHTGEKPFPCPFPGCGKIFARSENLKIHKRTHTGEKPFKCEFEGCDRRFANSSDRKKHMHVHTSDKPYICKVCDKSYTHPSSLRKHMKCCPAWYPGQSLIPDEELDTDVGMQQPALHNTTYPKCRVNAEPTVQEMIY

SEQ ID NO: 70110 - protein, 334 aa, Homo sapiens
MRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 70111 - protein, 372 aa, Homo sapiens
MNGPCQSLRKAEGLLEGCTSAVTVFRKLPLDSKAQSQKMRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 70112 - protein, 229 aa, Homo sapiens
MRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHT

SEQ ID NO: 70113 - protein, 68 aa, Homo sapiens
MRYKTSLVMRKRLRLYRNTLKESSSSSGHHGPQLTAASSPSVFPGLHEEPPQASPSRPLNGLLRLGLP

SEQ ID NO: 70114 - protein, 334 aa, Homo sapiens; identical to SEQ ID NO: 70110

SEQ ID NO: 70115 - protein, 334 aa, Homo sapiens; identical to SEQ ID NO: 70110

SEQ ID NO: 70116 - protein, 77 aa, Homo sapiens
MRYKTSLVMRKRLRLYRNTLKESSSSSGHHGPQLTAASSPSVFPGLHEEPPQASPSRPLNGLLRLGLPGDMYARPEP

SEQ ID NO: 70117 - protein, 384 aa, Homo sapiens
MPPFCRNAKLGLLSFLICAGRSLLPLGKNAFWLERIENNNTLWEKAQSQKMRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 70118 - protein, 227 aa, Homo sapiens
MGGKQSTAARSRGPFPGVSTDDSAVPPPGGAPHFGHYRTGGGAMGLRSRSVSSVAGMGMDPSTAGGVPFGLYTPASRGTGDSERAPGGGGSASDSTYAHGNGYQETGGGHHRDGMLYLGSRASLADALPLHIAPRWFSSHSGFKCPICSKSVASDEMEMHFIMCLSKPRLSYNDDVLTKDAGECVICLEELLQGDTIARLPCLCIYHKSCIDSWFEVNRSCPEHPAD

SEQ ID NO: 70119 - protein, 180 aa, Homo sapiens
QRGVPAAGTPSSPRLLVSRSLGGAVGSVASGARAAQSPFSIPNSSSGPYGSQDSVHSSPEDGGGGRDRPVGGSPGGPRLVIGSLPAHLSPHMFGGFKCPVCSKFVSSDEMDLHLVMCLTKPRITYNEDVLSKDAGECAICLEELQQGDTIARLPCLCIYHKGCIDEWFEVNRSCPEHPSD

SEQ ID NO: 70120 - protein, 242 aa, Homo sapiens
MGAKQSGPAAANGRTRAYSGSDLPSSSSGGANGTAGGGGGARAAAAGRFPAQVPSAHQPSASGGAAAAAAAPAAPAAPRSRSLGGAVGSVASGARAAQSPFSIPNSSSGPYGSQDSVHSSPEDGGGGRDRPVGGSPGGPRLVIGSLPAHLSPHMFGGFKCPVCSKFVSSDEMDLHLVMCLTKPRITYNEDVLSKDAGECAICLEELQQGDTIARLPCLCIYHKGCIDEWFEVNRSCPEHPSD

SEQ ID NO: 70121 - protein, 836 aa, Homo sapiens
MHPLGLCNNNDEEDLYEYGWVGVVKLEQPELDPKPCLTVLGKAKRAVQRGATAVIFDVSENPEAIDQLNQGSEDPLKRPVVYVKGADAIKLMNIVNKQKVARARIQHRPPRQPTEYFDMGIFLAFFVVVSLVCLILLVKIKLKQRRSQNSMNRLAVQALEKMETRKFNSKSKGRREGSCGALDTLSSSSTSDCAICLEKYIDGEELRVIPCTHRFHRKCVDPWLLQHHTCPHCRHNIIEQKGNPSAVCVETSNLSRGRQQRVTLPVHYPGRVHRTNAIPAYPTRTSMDSHGNPVTLLTMDRHGEQSLYSPQTPAYIRSYPPLHLDHSLAAHRCGLEHRAYSPAHPFRRPKLSGRSFSKAACFSQYETMYQHYYFQGLSYPEQEGQSPPSLAPRGPARAFPPSGSGSLLFPTVVHVAPPSHLESGSTSSFSCYHGHRSVCSGYLADCPGSDSSSSSSSGQCHCSSSDSVVDCTEVSNQGVYGSCSTFRSSLSSDYDPFIYRSRSPCRASEAGGSGSSGRGPALCFEGSPPPEELPAVHSHGAGRGEPWPGPASPSGDQVSTCSLEMNYSSNSSLEHRGPNSSTSEVGLEASPGAAPDLRRTWKGGHELPSCACCCEPQPSPAGPSAGAAGSSTLFLGPHLYEGSGPAGGEPQSGSSQGLYGLHPDHLPRTDGVKYEGLPCCFYEEKQVARGGGGGSGCYTEDYSVSVQYTLTEEPPPGCYPGARDLSQRIPIIPEDVDCDLGLPSDCQGTHSLGSWGGTRGPDTPRPHRGLGATREEERALCCQARALLRPGCPPEEAGAVRANFPSALQDTQESSTTATEAAGPRSHSADSSSPGA

SEQ ID NO: 70122 - protein, 836 aa, Homo sapiens; identical to SEQ ID NO: 70121

SEQ ID NO: 70123 - protein, 836 aa, Homo sapiens; identical to SEQ ID NO: 70121

SEQ ID NO: 70124 - protein, 643 aa, Homo sapiens
VPSVWRSTLMERSCGSSPVLTGFTGSAWTPLLQHHTCPHCRHNIIEQKGNPSAVCVETSNLSRGRQQRVTLPVHYPGRVHRTNAIPAYPTRTSMDSHGNPVTLLTMDRHGEQSLYSPQTPAYIRSYPPLHLDHSLAAHRCGLEHRAYSPAHPFRRPKLSGRSFSKAACFSQYETMYQHYYFQGLSYPEQEGQSPPSLAPRGPARAFPPSGSGSLLFPTVVHVAPPSHLESGSTSSFSCYHGHRSVCSGYLADCPGSDSSSSSSSGQCHCSSSDSVVDCTEVSNQGVYGSCSTFRSSLSSDYDPFIYRSRSPCRASEAGGSGSSGRGPALCFEGSPPPEELPAVHSHGAGRGEPWPGPASPSGDQVSTCSLEMNYSSNSSLEHRGPNSSTSEVGLEASPGAAPDLRRTWKGGHELPSCACCCEPQPSPAGPSAGAAGSSTLFLGPHLYEGSGPAGGEPQSGSSQGLYGLHPDHLPRTDGVKYEGLPCCFYEEKQVARGGGGGSGCYTEDYSVSVQYTLTEEPPPGCYPGARDLSQRIPIIPEDVDCDLGLPSDCQGTHSLGSWGGTRGPDTPRPHRGLGATREEERALCCQARALLRPGCPPEEAGAVRANFPSALQDTQESSTTATEAAGPRSHSADSSSPGA

SEQ ID NO: 70125 - protein, 936 aa, Homo sapiens
MRPRSGGRPGATGRRRRRLRRRPRGLRCSRLPPPPPLPLLLGLLLAAAGPGAARAKETAFVEVVLFESSPSGDYTTYTTGLTGRFSRAGATLSAEGEIVQMHPLGLCNNNDEEDLYEYGWVGVVKLEQPELDPKPCLTVLGKAKRAVQRGATAVIFDVSENPEAIDQLNQGSEDPLKRPVVYVKGADAIKLMNIVNKQKVARARIQHRPPRQPTEYFDMGIFLAFFVVVSLVCLILLVKIKLKQRRSQNSMNRLAVQALEKMETRKFNSKSKGRREGSCGALDTLSSSSTSDCAICLEKYIDGEELRVIPCTHRFHRKCVDPWLLQHHTCPHCRHNIIEQKGNPSAVCVETSNLSRGRQQRVTLPVHYPGRVHRTNAIPAYPTRTSMDSHGNPVTLLTMDRHGEQSLYSPQTPAYIRSYPPLHLDHSLAAHRCGLEHRAYSPAHPFRRPKLSGRSFSKAACFSQYETMYQHYYFQGLSYPEQEGQSPPSLAPRGPARAFPPSGSGSLLFPTVVHVAPPSHLESGSTSSFSCYHGHRSVCSGYLADCPGSDSSSSSSSGQCHCSSSDSVVDCTEVSNQGVYGSCSTFRSSLSSDYDPFIYRSRSPCRASEAGGSGSSGRGPALCFEGSPPPEELPAVHSHGAGRGEPWPGPASPSGDQVSTCSLEMNYSSNSSLEHRGPNSSTSEVGLEASPGAAPDLRRTWKGGHELPSCACCCEPQPSPAGPSAGAAGSSTLFLGPHLYEGSGPAGGEPQSGSSQGLYGLHPDHLPRTDGVKYEGLPCCFYEEKQVARGGGGGSGCYTEDYSVSVQYTLTEEPPPGCYPGARDLSQRIPIIPEDVDCDLGLPSDCQGTHSLGSWGGTRGPDTPRPHRGLGATREEERALCCQARALLRPGCPPEEAGAVRANFPSALQDTQESSTTATEAAGPRSHSADSSSPGA

SEQ ID NO: 70126 - protein, 429 aa, Homo sapiens
MPLCRPEHLMPRASRVPVAASLPLSHAVIPTQLPSRPGHRPPGRPRRCPKASCLPPPVGPSSTQTAKRVTMGWPRPGRALVAVKALLVLSLLQVPAQAVVRAVLEDNSSSVDFADLPALFGVPLAPEGIRGYLMEVKPANACHPIEAPRLGNRSLGAIVLIRRYDCTFDLKVLNAQRAGFEAAIVHNVHSDDLVSMTHVYEDLRGQIAIPSVFVSEAASQDLRVILGCNKSAHALLLPDDPPCHDLGCHPVLTVSWVLGCTLALVVSAFFVLNHLWLWAQACCSHRRPVKTSTCQKAQVRTFTWHNDLCAICLDEYEEGDQLKILPCSHTYHCKCIDPWFSQAPRRSCPVCKQSVAATEDSFDSTTYSFRDEDPSLPGHRPPIWAIQVQLRSRRLELLGRASPHCHCSTTSLEAEYTTVSSAPPEAPGQ

SEQ ID NO: 70127 - protein, 479 aa, Homo sapiens
MAALEKMTFPKKMTFPEKPSHKKYRAALKKEKRKKRRQELARLRDSGLSQEEEEDTFIEEQQLEEEKLLERERERLHEEWLLREQKAQEEFRIKKEKEEAAKKWLEEQERKLKEQWKEQQRKEREEEEQKQQEKKEKEEAVQKMLDQAENDLENSTTWQNPEPPVDFRVMEKDRANCPFYSKTGACRFGDRCSRKHNFPTSSPTLLIKSMFTTFGMEQCRRDDYDPDASLEYSEEETYQQFLDFYEDVLPEFKNVGKVIQFKVSCNLEPHLRGNVYVQYQSEEECQAALSLFNGRWYAGRQLQCEFCPVTRWKMAICGLFEIQQCPRGKHCNFLHVFRNPNNEFWEANRDIYLSSDQTGSSFGKNSERREKMGHHDHYYSRQRGRRNPSPDHTYKRNGESERKKSSHRGKKSHKRTSKSRERHNSPSRGRNRHRSWDQGRRSQSRRSHRSRSQSSSRCRSRGRRKSGNRDRTVQSPQSK

SEQ ID NO: 70128 - protein, 482 aa, Homo sapiens
MAAPEKMTFPEKPSHKKYRAALKKEKRKKRRQELARLRDSGLSQKEEEEDTFIEEQQLEEEKLLERERQRLHEEWLLREQKAQEEFRIKKEKEEAAKKRQEEQERKLKEQWEEQQRKEREEEEQKRQEKKEKEEALQKMLDQAENELENGTTWQNPEPPVDFRVMEKDRANCPFYSKTGACRFGDRCSRKHNFPTSSPTLLIKSMFTTFGMEQCRRDDYDPDASLEYSEEETYQQFLDFYEDVLPEFKNVGKVIQFKVSCNLEPHLRGNVYVQYQSEEECQAALSLFNGRWYAGRQLQCEFCPVTRWKMAICGLFEIQQCPRGKHCNFLHVFRNPNNEFWEANRDIYLSPDRTGSSFGKNSERRERMGHHDDYYSRLRGRRNPSPDHSYKRNGESERKSSRHRGKKSHKRTSKSRERHNSRSRGRNRDRSRDRSRGRGSRSRSRSRSRRSRRSRSQSSSRSRSRGRRRSGNRDRTVQSPKSK

SEQ ID NO: 70129 - protein, 147 aa, Homo sapiens
MAAPEKMTFPEKPSHKKYRAALKKEKRKKRRQELARLRDSGLSQKEEEEDTFIEEQQLEEEKLLERERLECSGVISAHRNLHLPGSHDSPASASRVAGITGTHRHTQLIFFCTFSRDGVSPCWPGWSRSLDLMICPPRPHKVLRLQV

SEQ ID NO: 70130 - protein, 1145 aa, Homo sapiens
MCKCCNLFSPNQSELLSHVSEKHMEEGVNVDEIIIPLRPLSTPEPPNSSKTGDEFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWEVTEEEPSSNHTVMIQETVQQASVELAEQHHLVVSSDDVEGIETVTVYTQGGEASEFIVYVQEAMQPVEEQAVEQPAQEL

SEQ ID NO: 70131 - protein, 1181 aa, Homo sapiens
METRAAENTAIFMCKCCNLFSPNQSELLSHVSEKHMEEGVNVDEIIIPLRPLSTPEPPNSSKTGDEFLVMKRKRGRPKGSTKKSSTEEELAENIVSPTEDSPLAPEEGNSLPPSSLECSKCCRKFSNTRQLRKHICIIVLNLGEEEGEAGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWETATEAPEEPSTQYLHITEAEEDVQGTQAAVAALQDLRYTSESGDRLDPTAVNILQQIIELGAETHDATALASVVAMAPGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 70132 - protein, 58 aa, Homo sapiens
METRAAGLLEFAGGPLHTLFAWVSPVEAAEQQRLLPVPASGSFVPEGHLPDASQSSPV

SEQ ID NO: 70133 - protein, 550 aa, Homo sapiens
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDRKARYLKNIFISKHSSEESGYASVAGQSLPGPMVDQSPSVSTSFGLSAMSPTKAAVDSLMTIGQSLLQGTLQPPAGPEEPTLAGGGRHPGVAEVKTEMMQVDEVPSQGFIQRELFSKLGELAVGMKSESRTIGEQCSVCGVELPDNEAVEQHRKLHSGMKTYGCELCGKRFLDSLRLRMHLLAHSAGAKAFVCDQCGAQFSKEDALETHRQTHTGTDMAVFCLLCGKRFQAQSALQQHMEVHAGVRSYICSECNRTFPSHTALKRHLRSHTGDHPYECEFCGSCFRDESTLKSHKRIHTGEKPYECNGCGKKFSLKHQLETHYRVHTGEKPFECKLCHQRSRDYSAMIKHLRTHNGASPYQCTICTEYCPSLSSMQKHMKGHKPEEIPPDWRIEKTYLYLCYV

SEQ ID NO: 70134 - protein, 673 aa, Homo sapiens
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDRKARYLKNIFISKHSSEESGYASVAGQSLPGPMVDQSPSVSTSFGLSAMSPTKAAVDSLMTIGQSLLQGTLQPPAGPEEPTLAGGGRHPGVAEVKTEMMQVDEVPSQDSPGAAESSISGGMGDKVEERGKEGPGTPTRSSVITSARELHYGREESAEQVPPPAEAGQAPTGRPEHPAPPPEKHLGIYSVLPNHKADAVLSMPSSVTSGLHVQPALAVSMDFSTYGGLLPQGFIQRELFSKLGELAVGMKSESRTIGEQCSVCGVELPDNEAVEQHRKLHSGMKTYGCELCGKRFLDSLRLRMHLLAHSAGAKAFVCDQCGAQFSKEDALETHRQTHTGTDMAVFCLLCGKRFQAQSALQQHMEVHAGVRSYICSECNRTFPSHTALKRHLRSHTGDHPYECEFCGSCFRDESTLKSHKRIHTGEKPYECNGCGKKFSLKHQLETHYRVHTGEKPFECKLCHQRSRDYSAMIKHLRTHNGASPYQCTICTEYCPSLSSMQKHMKGHKPEEIPPDWRIEKTYLYLCYV

SEQ ID NO: 70135 - protein, 673 aa, Homo sapiens; identical to SEQ ID NO: 70134

SEQ ID NO: 70136 - protein, 148 aa, Homo sapiens
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDR

SEQ ID NO: 70137 - protein, 115 aa, Homo sapiens
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLE

SEQ ID NO: 70138 - protein, 240 aa, Homo sapiens
EALPVRLLRPLLLRPHFQDAPPGDPRHGQGAQVPTLRQEVQPGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVG

SEQ ID NO: 70139 - protein, 810 aa, Homo sapiens
MDFPQHSQHVLEQLNQQRQLGLLCDCTFVVDGVHFKAHKAVLAACSEYFKMLFVDQKDVVHLDISNAAGLGQVLEFMYTAKLSLSPENVDDVLAVATFLQMQDIITACHALKSLAEPATSPGGNAEALATEGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVGNLKAHLKIHIADGPLKCRECGKQFTTSGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTGPATLPAVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 70140 - protein, 803 aa, Homo sapiens
MDFPQHSQHVLEQLNQQRQLGLLCDCTFVVDGVHFKAHKAVLAACSEYFKMLFVDQKDVVHLDISNAAGLGQVLEFMYTAKLSLSPENVDDVLAVATFLQMQDIITACHALKSLAEPATSPGGNAEALATEGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVGNLKAHLKIHIADGPLKCRECGKQFTTSGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 70141 - protein, 210 aa, Homo sapiens
  MOD_RES (1)..(1): Any amino acid
XSKHIIIHTGEKPYLCDKCGRGFNRVDNLRSHVKTVHQGKAGIKILEPEEGSEVSVVTVDDMVTLATEALAATAVTQLTGPATLPAVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 70142 - protein, 241 aa, Homo sapiens
  MOD_RES (1)..(1): Any amino acid
XEALPVRLLRPLLLRPHFQDAPPGDPRHGQGAQVPTLRQEVQPGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVG

SEQ ID NO: 70143 - protein, 722 aa, Homo sapiens
MDFPQHSQHVLEQLNQQRQLGLLCDCTFVVDGVHFKAHKAVLAACSEYFKMLFVDQKDVVHLDISNAAGLGQVLEFMYTAKLSLSPENVDDVLAVAPGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVGNLKAHLKIHIADGPLKCRECGKQFTTSGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 70144 - protein, 509 aa, Homo sapiens
MDFPQHSQHVLEQLNQQRQLGLLCDCTFVVDGVHFKAHKAVLAACSEYFKMLFVDQKDVVHLDISNAAGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVCGPLPEPAPGSRRWPQPHACHVVGRAGSTAPASRSSSACSPRKQAQREPLPRGSSRLLCGGQADSGRGLVLKKWGGAAYLSPLGPGTSPDPGEIEPFTDPGKPESQLFLCGRGR

SEQ ID NO: 70145 - protein, 721 aa, Homo sapiens
MMCWPWPLSSKCRTSSRPAMPSSHLLSRLPALGEMRRPWPQKVCPVPSPGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVGNLKAHLKIHIADGPLKCRECGKQFTTSGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 70146 - protein, 668 aa, Homo sapiens
MTERIHSINLHNFSNSVLETLNEQRNRGHFCDVTVRIHGSMLRAHRCVLAAGSPFFQDKLLLGYSDIEIPSVVSVQSVQKLIDFMYSGVLRVSQSEALQILTAASILQIKTVIDECTRIVSQNVGDVFPGIQDSGQDTPRGTPESGTSGQSSDTESGYLQSHPQHSVDRIYSALYACSMQNGSGERSFYSGAVVSHHETALGLPRDHHMEDPSWITRIHERSQQMERYLSTTPETTHCRKQPRPVRIQTLVGNIHIKQEMEDDYDYYGQQRVQILERNESEECTEDTDQAEGTESEPKGESFDSGVSSSIGTEPDSVEQQFGPGAARDSQAEPTQPEQAAEAPAEGGPQTNQLETGASSPERSNEVEMDSTVITVSNSSDKSVLQQPSVNTSIGQPLPSTQLYLRQTETLTSNLRMPLTLTSNTQVIGTAGNTYLPALFTTQPAGSGPKPFLFSLPQPLAGQQTQFVTVSQPGLSTFTAQLPAPQPLASSAGHSTASGQGEKKPYECTLCNKTFTAKQNYVKHMFVHTGEKPHQCSICWRSFSLKDYLIKHMVTHTGVRAYQCSICNKRFTQKSSLNVHMRLHRGEKSYECYICKKKFSHKTLLERHVALHSASNGTPPAGTPPGARAGPPGVVACTEGTTYVCSVCPAKFDQIEQFNDHMRMHVSDG

SEQ ID NO: 70147 - protein, 668 aa, Homo sapiens; identical to SEQ ID NO: 70146

SEQ ID NO: 70148 - protein, 668 aa, Homo sapiens; identical to SEQ ID NO: 70146

SEQ ID NO: 70149 - protein, 668 aa, Homo sapiens; identical to SEQ ID NO: 70146

SEQ ID NO: 70150 - protein, 57 aa, Homo sapiens
MTERIHSINLHNFSNSVLETLNEQRNRGHFCDVTVRIHGSMLRAHRCVLAAGSPFFQ

SEQ ID NO: 70151 - protein, 668 aa, Homo sapiens; identical to SEQ ID NO: 70146

SEQ ID NO: 70152 - protein, 741 aa, Homo sapiens
MLERKKPKTAENQKASEENEITQPGGSSAKPGLPCLNFEAVLSPDPALIHSTHSLTNSHAHTGSSDCDISCKGMTERIHSINLHNFSNSVLETLNEQRNRGHFCDVTVRIHGSMLRAHRCVLAAGSPFFQDKLLLGYSDIEIPSVVSVQSVQKLIDFMYSGVLRVSQSEALQILTAASILQIKTVIDECTRIVSQNVGDVFPGIQDSGQDTPRGTPESGTSGQSSDTESGYLQSHPQHSVDRIYSALYACSMQNGSGERSFYSGAVVSHHETALGLPRDHHMEDPSWITRIHERSQQMERYLSTTPETTHCRKQPRPVRIQTLVGNIHIKQEMEDDYDYYGQQRVQILERNESEECTEDTDQAEGTESEPKGESFDSGVSSSIGTEPDSVEQQFGPGAARDSQAEPTQPEQAAEAPAEGGPQTNQLETGASSPERSNEVEMDSTVITVSNSSDKSVLQQPSVNTSIGQPLPSTQLYLRQTETLTSNLRMPLTLTSNTQVIGTAGNTYLPALFTTQPAGSGPKPFLFSLPQPLAGQQTQFVTVSQPGLSTFTAQLPAPQPLASSAGHSTASGQGEKKPYECTLCNKTFTAKQNYVKHMFVHTGEKPHQCSICWRSFSLKDYLIKHMVTHTGVRAYQCSICNKRFTQKSSLNVHMRLHRGEKSYECYICKKKFSHKTLLERHVALHSASNGTPPAGTPPGARAGPPGVVACTEGTTYVCSVCPAKFDQIEQFNDHMRMHVSDG

SEQ ID NO: 70153 - protein, 668 aa, Homo sapiens; identical to SEQ ID NO: 70146

SEQ ID NO: 70154 - protein, 19 aa, Homo sapiens
MLERKKPKTAENQKASEEN

SEQ ID NO: 70155 - protein, 697 aa, Homo sapiens
MAETSPEPSGQLVVHSDAHSDTVLASFEDQRKKGFLCDITLIVENVHFRAHKALLAASSEYFSMMFAEEGEIGQSIYMLEGMVADTFGILLEFIYTGYLHASEKSTEQILATAQFLKVYDLVKAYTDFQNNHSSPKPTTLNTAGAPVVVISNKKNDPPKRKRGRPKKVNTLQEEKSELAAEEEIQLRVNNSVQNRQNFVVKGDSGVLNEQIAAKEKEESEPTCEPSREEEMPVEKDENYDPKTEDGQASQSRYSKRRIWRSVKLKDYKLVGDQEDHGSAKRICGRRKRPGGPEARCKDCGKVFKYNHFLAIHQRSHTGERPFKCNECGKGFAQKHSLQVHTRMHTGERPYTCTVCSKALTTKHSLLEHMSLHSGQKSFTCDQCGKYFSQNRQLKSHYRVHTGHSLPECKDCHRKFMDVSQLKKHLRTHTGEKPFTCEICGKSFTAKSSLQTHIRIHRGEKPYSCGICGKSFSDSSAKRRHCILHTGKKPFSCPECNLQFARLDNLKAHLKIHSKEKHASDASSISGSSNTEEVRNILQLQPYQLSTSGEQEIQLLVTDSVHNINFMPGPSQGISIVTAESSQNMTADQAANLTLLTQQPEQLQNLILSAQQEQTEHIQSLNMIESQMGPSQTEPVHVITLSKETLEHLHAHQEQTEELHLATSTSDPAQHLQLTQEPGPPPPTHHVPQPTPLGQEQS

SEQ ID NO: 70156 - protein, 435 aa, Homo sapiens
MDTASHSLVLLQQLNMQREFGFLCDCTVAIGDVYFKAHRAVLAAFSNYFKMIFIHQTSECIKIQPTDIQPDIFSYLLHIMYTGKGPKQIVDHSRLEEGIRFLHADYLSHIATEMNQVFSPETVQSSNLYGIQISTTQKTVVKQGLEVKEAPSSNSGNRAAVQGDHPQLQLSLAIGLDDGTADQQRACPATQALEEHQKPPVSIKQERCDPESVISQSHPSPSSEVTGPTFTENSVKIHLCHYCGERFDSRSNLRQHLHTHVSGSLPFGVPASILESNDLGEVHPLNENSEALECRRLSSFIVKENEQQPDHTNRGTTEPLQISQVSLISKDTEPVELNCNFSFSRKRKMSCTICGHKFPRKSQLLEHMYTHKGKSYRYNRCQRFGNALAQRFQPYCDSWSDVSLKSSRLSQEHLDLPCALESELTQENVDTILVE

SEQ ID NO: 70157 - protein, 435 aa, Homo sapiens; identical to SEQ ID NO: 70156

SEQ ID NO: 70158 - protein, 487 aa, Homo sapiens
MSLPPIRLPSPYGSDRLVQLAARLRPALCDTLITVGSQEFPAHSLVLAGVSQQLGRRGQWALGEGISPSTFAQLLNFVYGESVELQPGELRPLQEAARALGVQSLEEACWRARGDRAKKPDPGLKKHQEEPEKPSRNPERELGDPGEKQKPEQVSRTGGREQEMLHKHSPPRGRPEMAGATQEAQQEQTRSKEKRLQAPVGQRGADGKHGVLTWLRENPGGSEESLRKLPGPLPPAGSLQTSVTPRPSWAEAPWLVGGQPALWSILLMPPRYGIPFYHSTPTTGAWQEVWREQRIPLSLNAPKGLWSQNQLASSSPTPGSLPQGPAQLSPGEMEESDQGHTGALATCAGHEDKAGCPPRPHPPPAPPARSRPYACSVCGKRFSLKHQMETHYRVHTGEKPFSCSLCPQRSRDFSAMTKHLRTHGAAPYRCSLCGAGCPSLASMQAHMRGHSPSQLPPGWTIRSTFLYSSSRPSRPSTSPCCPSSSTT

SEQ ID NO: 70159 - protein, 487 aa, Homo sapiens; identical to SEQ ID NO: 70158

SEQ ID NO: 70160 - protein, 672 aa, Homo sapiens
MESRKLISATDIQYSGSLLNSLNEQRGHGLFCDVTVIVEDRKFRAHKNILSASSTYFHQLFSVAGQVVELSFIRAEIFAEILNYIYSSKIVRVRSDLLDELIKSGQLLGVKFIAELGVPLSQVKSISGTAQDGNTEPLPPDSGDKNLVIQKSKDEAQDNGATIMPIITESFSLSAEDYEMKKIIVTDSDDDDDDVIFCSEILPTKETLPSNNTVAQVQSNPGPVAISDVAPSASNNSPPLTNITPTQKLPTPVNQATLSQTQGSEKLLVSSAPTHLTPNIILLNQTPLSTPPNVSSSLPNHMPSSINLLVQNQQTPNSAILTGNKANEEEEEEIIDDDDDTISSSPDSAVSNTSLVPQADTSQNTSFDGSLIQKMQIPTLLQEPLSNSLKISDIITRNTNDPGVGSKHLMEGQKIITLDTATEIEGLSTGCKVYANIGEDTYDIVIPVKDDPDEGEARLENEIPKTSGSEMANKRMKVKHDDHYELIVDGRVYYICIVCKRSYVCLTSLRRHFNIHSWEKKYPCRYCEKVFPLAEYRTKHEIHHTGERRYQCLACGKSFINYQFMSSHIKSVHSQDPSGDSKLYRLHPCRSLQIRQYAYLSDRSSTIPAMKDDGIGYKVDTGKEPPVGTTTSTQNKPMTWEDIFIQQENDSIFKQNVTDGSTEFEFIIPESY

SEQ ID NO: 70161 - protein, 672 aa, Homo sapiens; identical to SEQ ID NO: 70160

SEQ ID NO: 70162 - protein, 672 aa, Homo sapiens; identical to SEQ ID NO: 70160

SEQ ID NO: 70163 - protein, 504 aa, Homo sapiens
MSVEMDSSSFIQFDVPEYSSTVLSQLNELRLQGKLCDIIVHIQGQPFRAHKAVLAASSPYFRDHSALSTMSGLSISVIKNPNVFEQLLSFCYTGRMSLQLKDVVSFLTAASFLQMQCVIDKCTQILESIHSKISVGDVDSVTVGAEENPESRNGVKDSSFFANPVEISPPYCSQGRQPTASSDLRMETTPSKALRSRLQEEGHSDRGSSGSVSEYEIQIEGDHEQGDLLVRESQITEVKVKMEKSDRPSCSDSSSLGDDGYHTEMVDGEQVVAVNVGSYGSVLQHAYSYSQAASQPTNVSEAFGSLSNSSPSRSMLSCFRGGRARQKRALSVHLHSDLQGLVQGSDSEAMMNNPGYESSPRERSARGHWYPYNERLICIYCGKSFNQKGSLDRHMRLHMGITPFVCKFCGKKYTRKDQLEYHIRGHTDDKPFRCEICGKCFPFQGTLNQHLRKNHPGVAEVRSRIESPERTDVYVEQKLENDASASEMGLDSRMEIHTVSDAPD

SEQ ID NO: 70164 - protein, 500 aa, Homo sapiens
MDSSSFIQFDVPEYSSTVLSQLNELRLQGKLCDIIVHIQGQPFRAHKAVLAASSPYFRDHSALSTMSGLSISVIKNPNVFEQLLSFCYTGRMSLQLKDVVSFLTAASFLQMQCVIDKCTQILESIHSKISVGDVDSVTVGAEENPESRNGVKDSSFFANPVEISPPYCSQGRQPTASSDLRMETTPSKALRSRLQEEGHSDRGSSGSVSEYEIQIEGDHEQGDLLVRESQITEVKVKMEKSDRPSCSDSSSLGDDGYHTEMVDGEQVVAVNVGSYGSVLQHAYSYSQAASQPTNVSEAFGSLSNSSPSRSMLSCFRGGRARQKRALSVHLHSDLQGLVQGSDSEAMMNNPGYESSPRERSARGHWYPYNERLICIYCGKSFNQKGSLDRHMRLHMGITPFVCKFCGKKYTRKDQLEYHIRGHTDDKPFRCEICGKCFPFQGTLNQHLRKNHPGVAEVRSRIESPERTDVYVEQKLENDASASEMGLDSRMEIHTVSDAPD

SEQ ID NO: 70165 - protein, 1196 aa, Homo sapiens
MMTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISFLEDLTDRNFSNSPGPYVFCITEKGVVKEEKNEKRHEEPAITNGPRITNAFSIIETENSNNMFSPLDLRASFKKVSDSMRTASLCLERTDVCHEAEPVRTLAEHSYAVSSVAEAYRSQPVREHDGSSPGNTGKENCEALAAKPKTCRKPKTFSIPQDSDSATENIPPPPVSNLEVNQERSPQPAAVLTRSKSPNNEGDVHFSREDENQSSDVPGPPAAEVPPLVYNCSCCSKAFDSSTLLSAHMQLHKPTQEPLVCKYCNKQFTTLNRLDRHEQICMRSSHMPIPGGNQRFLENYPTIGQNGGSFTGPEPLLSENRIGEFSSTGSTLPDTDHMVKFVNGQMLYSCVVCKRSYVTLSSLRRHANVHSWRRTYPCHYCNKVFALAEYRTRHEIWHTGERRYQCIFCLETFMTYYILKNHQKSFHAIDHRLSISKKTANGGLKPSVYPYKLYRLLPMKCKRAPYKSYRNSSYENARENSQMNESAPGTYVVQNPHSSELPTLNFQDTVNTLTNSPAIPLETSACQDIPTSANVQNAEGTKWGEEALKMDLDNNFYSTEVSVSSTENAVSSDLRAGDVPVLSLSNSSENAASVISYSGSAPSVIVHSSQFSSVIMHSNAIAAMTSSNHRAFSDPAVSQSLKDDSKPEPDKVGRFASRPKSIKEKKKTTSHTRGEIPEESNYVADPGGSLSKTTNIAEETSKIETYIAKPALPGTSTNSNVAPLCQITVKIGNEAIVKRHILGSKLFYKRGRRPKYQMQEEPLPQGNDPEPSGDSPLGLCQSECMEMSEVFDDASDQDSTDKPWRPYYNYKPKKKSRQLKKMRKVNWRKEHGNRSPSHKCKYPAELDCAVGKAPQDKPFEEEETKEMPKLQCELCDGDKAVGAGNQGRPHRHLTSRPYACELCAKQFQSPSTLKMHMRCHTGEKPYQCKTCGRCFSVQGNLQKHERIHLGLKEFVCQYCNKAFTLNETLKIHERIHTGEKRYHCQFCFQRFLYLSTKRNHEQRHIREHNGKGYACFQCPKICKTAAALGMHQKKHLFKSPSQQEKIGDVCHENSNPLENQHFIGSEDNDQKDNIQTGVENVVL

SEQ ID NO: 70166 - protein, 1195 aa, Homo sapiens
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISFLEDLTDRNFSNSPGPYVFCITEKGVVKEEKNEKRHEEPAITNGPRITNAFSIIETENSNNMFSPLDLRASFKKVSDSMRTASLCLERTDVCHEAEPVRTLAEHSYAVSSVAEAYRSQPVREHDGSSPGNTGKENCEALAAKPKTCRKPKTFSIPQDSDSATENIPPPPVSNLEVNQERSPQPAAVLTRSKSPNNEGDVHFSREDENQSSDVPGPPAAEVPPLVYNCSCCSKAFDSSTLLSAHMQLHKPTQEPLVCKYCNKQFTTLNRLDRHEQICMRSSHMPIPGGNQRFLENYPTIGQNGGSFTGPEPLLSENRIGEFSSTGSTLPDTDHMVKFVNGQMLYSCVVCKRSYVTLSSLRRHANVHSWRRTYPCHYCNKVFALAEYRTRHEIWHTGERRYQCIFCLETFMTYYILKNHQKSFHAIDHRLSISKKTANGGLKPSVYPYKLYRLLPMKCKRAPYKSYRNSSYENARENSQMNESAPGTYVVQNPHSSELPTLNFQDTVNTLTNSPAIPLETSACQDIPTSANVQNAEGTKWGEEALKMDLDNNFYSTEVSVSSTENAVSSDLRAGDVPVLSLSNSSENAASVISYSGSAPSVIVHSSQFSSVIMHSNAIAAMTSSNHRAFSDPAVSQSLKDDSKPEPDKVGRFASRPKSIKEKKKTTSHTRGEIPEESNYVADPGGSLSKTTNIAEETSKIETYIAKPALPGTSTNSNVAPLCQITVKIGNEAIVKRHILGSKLFYKRGRRPKYQMQEEPLPQGNDPEPSGDSPLGLCQSECMEMSEVFDDASDQDSTDKPWRPYYNYKPKKKSRQLKKMRKVNWRKEHGNRSPSHKCKYPAELDCAVGKAPQDKPFEEEETKEMPKLQCELCDGDKAVGAGNQGRPHRHLTSRPYACELCAKQFQSPSTLKMHMRCHTGEKPYQCKTCGRCFSVQGNLQKHERIHLGLKEFVCQYCNKAFTLNETLKIHERIHTGEKRYHCQFCFQRFLYLSTKRNHEQRHIREHNGKGYACFQCPKICKTAAALGMHQKKHLFKSPSQQEKIGDVCHENSNPLENQHFIGSEDNDQKDNIQTGVENVVL

SEQ ID NO: 70167 - protein, 34 aa, Homo sapiens
MTVMSLSRDLKDDFHSDTVLSILNEQRIRGILCD

SEQ ID NO: 70168 - protein, 94 aa, Homo sapiens
MTVMSLSRDLKDDFHSDTVLSILNEQRIRGILCDVTIIVEDTKFKAHSNVLAASSLYFKNIFWSHTICISSHVLELDDLKAEVFTEILNYIYSS

SEQ ID NO: 70169 - protein, 118 aa, Homo sapiens
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISF

SEQ ID NO: 70170 - protein, 111 aa, Homo sapiens
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAG

SEQ ID NO: 70171 - protein, 150 aa, Homo sapiens
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISFLEDLTDRNFSNSPGPYVFCITEKGVVKEEKNE

SEQ ID NO: 70172 - protein, 771 aa, Homo sapiens
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISFLEDLTDRNFSNSPGPYVFCITEKGVVKEEKNEKRHEEPAITNGPRITNAFSIIETENSNNMFSPLDLRASFKKVSDSMRTASLCLERTDVCHEAEPVRTLAEHSYAVSSVAEAYRSQPVREHDGSSPGNTGKENCEALAAKPKTCRKPKTFSIPQDSDSATENIPPPPVSNLEVNQERSPQPAAVLTRSKSPNNEGDVHFSREDENQSSDVPGPPAAEVPPLVYNCSCCSKAFDSSTLLSAHMQLHKPTQEPLVCKYCNKQFTTLNRLDRHEQICMRSSHMPIPGGNQRFLENYPTIGQNGGSFTGPEPLLSENRIGEFSSTGSTLPDTDHMVKFVNGQMLYSCVVCKRSYVTLSSLRRHANVHSWRRTYPCHYCNKVFALAEYRTRHEIWHTGERRYQCIFCLETFMTYYILKNHQKSFHAIDHRLSISKKTANGGLKPSVYPYKLYRLLPMKCKRAPYKSYRNSSYENARENSQMNESAPGTYVVQNPHSSELPTLNFQDTVNTLTNSPAIPLETSACQDIPTSANVQNAEGTKWGEEALKMDLDNNFYSTEVSVSSTENAVSSDLRAGDVPVLSLSNSSENAASVISYSGSAPSVIVHSSQFSSVIMHSNAIAAMTSSNHRAFSDPAVSQSLKDDSKPEPDKVGRFASRP

SEQ ID NO: 70173 - protein, 146 aa, Homo sapiens
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISFLEDLTDRNFSNSPGPYVFCITEKGVVKE

SEQ ID NO: 70174 - protein, 210 aa, Homo sapiens
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISFLEDLTDRNFSNSPGPYVFCITEKGVVKEEKNEKRHEEPAITNGPRITNAFSIIETENSNNMFSPLDLRASFKKVSDSMRTASLCLERTDVCH

SEQ ID NO: 70175 - protein, 108 aa, Homo sapiens
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLA

SEQ ID NO: 70176 - protein, 70 aa, Homo sapiens
MTVMSLSRDLKDDFHSDTVLSILNEQRIRGILCDVTIIVEDTKFKAHSNVLAASSLYFKNIFWSHTICIS

SEQ ID NO: 70177 - protein, 1195 aa, Homo sapiens; identical to SEQ ID NO: 70166

SEQ ID NO: 70178 - protein, 1013 aa, Homo sapiens
MPPPAEVTDPSHAPAVLRQLNEQRLRGLFCDVTLIAGDTKFPAHRSVLAASSPFFREALLTSAPLPLPPATGGAAPNPATTTAASSSSSSSSSSSSSSSSASSSSSSSSSSPPPASPPASSPPRVLELPGVPAAAFSDVLNFIYSARLALPGGGGDGAAVAEIGALGRRLGISRLQGLGEGGDAWVPPTPAPMATSQPEEDSFGPGPRPAGEWEGDRAEAQAPDLQCSLPRRPLPCPQCGKSFIHPKRLQTHEAQCRRGASTRGSTGLGAGGAGPGGPAGVDASALPPPVGFRGGPEHVVKVVGGHVLYVCAACERSYVTLSSLKRHSNVHSWRRKYPCRYCEKVFALAEYRTKHEVWHTGERRYQCIFCWETFVTYYNLKTHQRAFHGISPGLLASEKTPNGGYKPKLNTLKLYRLLPMRAAKRPYKTYSQGAPEAPLSPTLNTPAPVAMPASPPPGPPPAPEPGPPPSVITFAHPAPSVIVHGGSSSGGGGSGTASTGGSQAASVITYTAPPRPPKKREYPPPPPEPAATPTSPATAVSPATAAGPAMATTTEEAKGRNPRAGRTLTYTAKPVGGIGGGGGPPTGAGRGPSQLQAPPPLCQITVRIGEEAIVKRRISETDLRPGELSGEEMEESEEDEEEEDEEEEEEDEEESKAGGEDQLWRPYYSYKPKRKAGAAGGASVGGSGLPRGRRPPRWRQKLERRSWEETPAAESPAGRARTERRHRCGDCAQTFTTLRKLRKHQEAHGGGSHSSRAGRRPSTRFTCPHCAKVCKTAAALSRHGQRHAAERPGGTPTPVIAYSKGSAGTRPGDVKEEAPQEMQVSSSSGEAGGGSTAAEEASETASLQDPIISGGEEPPVVASGGSYVYPPVQEFPLALIGGGREPGGGRGKSGSEGPVGAGEGDRMEGIGAAKVTFYPEPYPLVYGPQLLAAYPYNFSNLAALPVALNMVLPDEKGAGALPFLPGVFGYAVNPQAAPPAPPTPPPPTLPPPIPPKGEGERAGVERTQKGDVG

SEQ ID NO: 70179 - protein, 1013 aa, Homo sapiens; identical to SEQ ID NO: 70178

SEQ ID NO: 70180 - protein, 235 aa, Homo sapiens
MELPNYSRQLLQQLYTLCKEQQFCDCTISIGTIYFRAHKLVLAAASLLFKTLLDNTDTISIDASVVSPEEFALLLEMMYTGKLPVGKHNFSKIISLADSLQMFDVAVSCKNLLTSLLAATPGGPVKAETEEAAHSVSQEMSVNSPTAQESQRNAETPAETPTTAEACSPSPAVQTFSEAKKTSTEPGCERKHYQLNFLLENEGVFSDALMVTQDVLKKLEMCSNCCVPVEAVPIF

SEQ ID NO: 70181 - protein, 1127 aa, Homo sapiens
MELPNYSRQLLQQLYTLCKEQQFCDCTISIGTIYFRAHKLVLAAASLLFKTLLDNTDTISIDASVVSPEEFALLLEMMYTGKLPVGKHNFSKIISLADSLQMFDVAVSCKNLLTSLVNCSVQGQVVRDVSAPSSETFRKEPEKPQVEILSSEGAGEPHSSPELAATPGGPVKAETEEAAHSVSQEMSVNSPTAQESQRNAETPAETPTTAEACSPSPAVQTFSEAKKTSTEPGCERKHYQLNFLLENEGVFSDALMVTQDVLKKLEMCSEIKGPQKEVILNCCEGRTPKETIENLLHRMTEEKTLTAEGLVKLLQAVKTTFPNLGLLLEKLQKSATLPSTTVQPSPDDYGTELLRRYHENLSEIFTDNQILLKMISHMTSLAPGEREVMEKLVKRDSGSGGFNSLISAVLEKQTLSATAIWQLLLVVQETKTCPLDLLMEEIRREPGADAFFRAVTTPEHATLETILRHNQLILEAIQQKIEYKLFTSEEEHLAETVKEILSIPSETASPEASLRAVLSRAMEKSVPAIEICHLLCSVHKSFPGLQPVMQELAYIGVLTKEDGEKETWKVSNKFHLEANNKEDEKAAKEDSQPGEQNDQGETGSLPGQQEKEASASPDPAKKSFICKACDKSFHFYCRLKVHMKRCRVAKSKQVQCKECSETKDSKKELDKHQLEAHGAGGEPDAPKKKKKRLPVTCDLCGREFAHASGMQYHKLTEHFDEKPFSCEECGAKFAANSTLKNHLRLHTGDRPFMCKHCLMTFTQASALAYHTKKKHSEGKMYACQYCDAVFAQSIELSRHVRTHTGDKPYVCRDCGKGFRQANGLSIHLHTFHNIEDPYDCKKCRMSFPTLQDHRKHIHEVHSKEYHPCPTCGKIFSAPSMLERHVVTHVGGKPFSCGICNKAYQQLSGLWYHNRTHHPDVFAAQNHRSSKFSSLQCSSCDKTFPNTIEHKKHIKAEHADMKFHECDQCKELFPTPALLQVHVKCQHSGSQPFRCLYCAATFRFPGALQHHVTTEHFKQSETTFPCELCGELFTSQAQLDSHLESEHPKVMSTETQAAASQMAQVIQTPEPVAPTEQVITLEETQLAGSQVFVTLPDSQASQASSELVAVTVEDLLDGTVTLICGEAK

SEQ ID NO: 70182 - protein, 1239 aa, Homo sapiens
MELPNYSRQLLQQLYTLCKEQQFCDCTISIGTIYFRAHKLVLAAASLLFKTLLDNTDTISIDASVVSPEEFALLLEMMYTGKLPVGKHNFSKIISLADSLQMFDVAVSCKNLLTSLVNCSVQGQVVRDVSAPSSETFRKEPEKPQVEILSSEGAGEPHSSPELAATPGGPVKAETEEAAHSVSQEMSVNSPTAQESQRNAETPAETPTTAEACSPSPAVQTFSEAKKTSTEPGCERKHYQLNFLLENEGVFSDALMVTQDVLKKLEMCSEIKGPQKEMIVKCFEGEGGHSAFQRILGKVREESLDVQTVVSLLRLYQYSNPAVKTALLDRKPEDVDTVQPKGSTEEGKTLSVLLLEHKEDLIQCVTQLRPIMESLETAKEEFLTGTEKRVILNCCEGRTPKETIENLLHRMTEEKTLTAEGLVKLLQAVKTTFPNLGLLLEKLQKSATLPSTTVQPSPDDYGTELLRRYHENLSEIFTDNQILLKMISHMTSLAPGEREVMEKLVKRDSGSGGFNSLISAVLEKQTLSATAIWQLLLVVQETKTCPLDLLMEEIRREPGADAFFRAVTTPEHATLETILRHNQLILEAIQQKIEYKLFTSEEEHLAETVKEILSIPSETASPEASLRAVLSRAMEKSVPAIEICHLLCSVHKSFPGLQPVMQELAYIGVLTKEDGEKETWKVSNKFHLEANNKEDEKAAKEDSQPGEQNDQGETGSLPGQQEKEASASPDPAKKSFICKACDKSFHFYCRLKVHMKRCRVAKSKQVQCKECSETKDSKKELDKHQLEAHGAGGEPDAPKKKKKRLPVTCDLCGREFAHASGMQYHKLTEHFDEKPFSCEECGAKFAANSTLKNHLRLHTGDRPFMCKHCLMTFTQASALAYHTKKKHSEGKMYACQYCDAVFAQSIELSRHVRTHTGDKPYVCRDCGKGFRQANGLSIHLHTFHNIEDPYDCKKCRMSFPTLQDHRKHIHEVHSKEYHPCPTCGKIFSAPSMLERHVVTHVGGKPFSCGICNKAYQQLSGLWYHNRTHHPDVFAAQNHRSSKFSSLQCSSCDKTFPNTIEHKKHIKAEHADMKFHECDQCKELFPTPALLQVHVKCQHSGSQPFRCLYCAATFRFPGALQHHVTTEHFKQSETTFPCELCGELFTSQAQLDSHLESEHPKVMSTETQAAASQMAQVIQTPEPVAPTEQVITLEETQLAGSQVFVTLPDSQASQASSELVAVTVEDLLDGTVTLICGEAK

SEQ ID NO: 70183 - protein, 453 aa, Homo sapiens
MELPNYSRQLLQQLYTLCKEQQFCDCTISIGTIYFRAHKLVLAAASLLFKTLLDNTDTISIDASVVSPEEFALLLEMMYTGKLPVGKHNFSKIISLADSLQMFDVAVSCKNLLTSLVNCSVQGQVVRDVSAPSSETFRKEPEKPQVEILSSEGAGEPHSSPELAATPGGPVKAETEEAAHSVSQEMSVNSPTAQESQRNAETPAETPTTAEACSPSPAVQTFSEAKKTSTEPGCERKHYQLNFLLENEGVFSDALMVTQDVLKKLEMCSEIKGPQKEMIVKCFEGEGGHSAFQRILGKVREESLDVQTVVSLLRLYQYSNPAVKTALLDRKPEDVDTVQPKGSTEEGKTLSVLLLEHKEDLIQCVTQLRPIMESLETAKEEFLTGTEKRVILNCCEGRTPKETIENLLHRMTEEKTLTAEGLVKLLQAVKTTFPNLGLLLEKLQKSATLPSTT

SEQ ID NO: 70184 - protein, 1239 aa, Homo sapiens; identical to SEQ ID NO: 70182

SEQ ID NO: 70185 - protein, 422 aa, Homo sapiens
MEFPEHGGRLLGRLRQQRELGFLCDCTVLVGDARFPAHRAVLAACSVYFHLFYRDRPAGSRDTVRLNGDIVTAPAFGRLLDFMYEGRLDLRSLPVEDVLAAASYLHMYDIVKVCKGRLQEKDRSLDPGNPAPGAEPAQPPCPWPVWTADLCPAARKAKLPPFGVKAALPPRASGPPPCQVPEESDQALDLSLKSGPRQERVHPPCVLQTPLCSQRQPGAQPLVKDERDSLSEQEESSSSRSPHSPPKPPPVPAAKGLVVGLQPLPLSGEGSRELELGAGRLASEDELGPGGPLCICPLCSKLFPSSHVLQLHLSAHFRERDSTRARLSPDGVAPTCPLCGKTFSCTYTLKRHERTHSGEKPYTCVQCGKSFQYSHNLSRHTVVHTREKPHACRWCERRFTQSGDLYRHVRKFHCGLVKSLLV

SEQ ID NO: 70186 - protein, 422 aa, Homo sapiens; identical to SEQ ID NO: 70185

SEQ ID NO: 70187 - protein, 604 aa, Homo sapiens
MASTWAIQAHMDQDEPLEVKIEEEKYTTRQDWDLRKNNTHSREVFRQYFRQFCYQETSGPREALSRLRELCHQWLRPETHTKEQILELLVLEQFLTILPEELQAWVQEQHPESGEEVVTVLEDLERELDEPGEQVSVHTGEQEMFLQETVRLRKEGEPSMSLQSMKAQPKYESPELESQQEQVLDVETGNEYGNLKQEVSEEMEPHGKTSSKFENDMSKSARCGETREPEEITEEPSACSREDKQPTCDENGVSLTENSDHTEHQRICPGEESYGCDDCGKAFSQHSHLIEHQRIHTGDRPYKCEECGKAFRGRTVLIRHKIIHTGEKPYKCNECGKAFGRWSALNQHQRLHTGEKHYHCNDCGKAFSQKAGLFHHIKIHTRDKPYQCTQCNKSFSRRSILTQHQGVHTGAKPYECNECGKAFVYNSSLVSHQEIHHKEKCYQCKECGKSFSQSGLIQHQRIHTGEKPYKCDVCEKAFIQRTSLTEHQRIHTGERPYKCDKCGKAFTQRSVLTEHQRIHTGERPYKCDECGNAFRGITSLIQHQRIHTGEKPYQCDECGKAFRQRKKTSYKEILLKNHSEPQAGVNLLLSSLIPEWQSCFRRDL

SEQ ID NO: 70188 - protein, 604 aa, Homo sapiens; identical to SEQ ID NO: 70187

SEQ ID NO: 70189 - protein, 491 aa, Homo sapiens
MAIPKHSLSPVPWEEDSFLQVKVEEEEEASLSQGGESSHDHIAHSEAARLRFRHFRYEEASGPHEALAHLRALCCQWLQPEAHSKEQILELLVLEQFLGALPPEIQAWVGAQSPKSGEEAAVLVEDLTQVLDKRGWDPGAEPTEASCKQSDLGESEPSNVTETLMGGVSLGPAFVKACEPEGSSERSGLSGEIWTKSVTQQIHFKKTSGPYKDVPTDQRGRESGASRNSSSAWPNLTSQEKPPSEDKFDLVDAYGTEPPYTYSGKRSSKCRECRKMFQSASALEAHQKTHSRKTPYACSECGKAFSRSTHLAQHQVVHTGAKPHECKECGKAFSRVTHLTQHQRIHTGEKPYKCGECGKTFSRSTHLTQHQRVHTGERPYECDACGKAFSQSTHLTQHQRIHTGEKPYKCDACGRAFSDCSALIRHLRIHSGEKPYQCKVCPKAFAQSSSLIEHQRIHTGEKPYKCSDCGKAFSRSSALMVHLRIHITVLQ

SEQ ID NO: 70190 - protein, 433 aa, Homo sapiens
MALDLRTIFQCEPSENNLGSENSAFQQSQGPAVQREEGISEFSRMVLNSFQDSNNSYARQELQRLYRIFHSWLQPEKHSKDEIISLLVLEQFMIGGHCNDKASVKEKWKSSGKNLERFIEDLTDDSINPPALVHVHMQGQEALFSEDMPLRDVIVHLTKQVNAQTTREANMGTPSQTSQDTSLETGQGYEDEQDGWNSSSKTTRVNENITNQGNQIVSLIIIQEENGPRPEEGGVSSDNPYNSKRAELVTARSQEGSINGITFQGVPMVMGAGCISQPEQSSPESALTHQSNEGNSTCEVHQKGSHGVQKSYKCEECPKVFKYLCHLLAHQRRHRNERPFVCPECQKGFFQISDLRVHQIIHTGKKPFTCSMCKKSFSHKTNLRSHERIHTGEKPYTCPFCKTSYRQSSTYHRHMRTHEKITLPSVPSTPEAS

SEQ ID NO: 70191 - protein, 810 aa, Homo sapiens
MPNQGEDCYFFFYSTCTKGDSCPFRHCEAAIGNETVCTLWQEGRCFRQVCRFRHMEIDKKRSEIPCYWENQPTGCQKLNCAFHHNRGRYVDGLFLPPSKTVLPTVPESPEEEVKASQLSVQQNKLSVQSNPSPQLRSVMKVESSENVPSPTHPPVVINAADDDEDDDDQFSEEGDETKTPTLQPTPEVHNGLRVTSVRKPAVNIKQGECLNFGIKTLEEIKSKKMKEKSKKQGEGSSGVSSLLLHPEPVPGPEKENVRTVVRTVTLSTKQGEEPLVRLSLTERLGKRKFSAGGDSDPPLKRSLAQRLGKKVEAPETNIDKTPKKAQVSKSLKERLGMSADPDNEDATDKVNKVGEIHVKTLEEILLERASQKRGELQTKLKTEGPSKTDDSTSGARSSSTIRIKTFSEVLAEKKHRQQEAERQKSKKDTTCIKLKIDSEIKKTVVLPPIVASRGQSEEPAGKTKSMQEVHIKTLEEIKLEKALRVQQSSESSTSSPSQHEATPGARRLLRITKRTGMKEEKNLQEGNEVDSQSSIRTEAKEASGETTGVDITKIQVKRCETMREKHMQKQQEREKSVLTPLRGDVASCNTQVAEKPVLTAVPGITRHLTKRLPTKSSQKVEVETSGIGDSLLNVKCAAQTLEKRGKAKPKVNVKPSVVKVVSSPKLAPKRKAVEMHAAVIAAVKPLSSSSVLQEPPAKKAAVAVVPLVSEDKSVTVPEAENPRDSLVLPPTQSSSDSSPPEVSGPSSSQMSMKTRRLSSASTGKPPLSVEDDFEKLIWEISGGKLEAEIDLDPGKDEDDLLLELSEMIDS

SEQ ID NO: 70192 - protein, 810 aa, Homo sapiens; identical to SEQ ID NO: 70191

SEQ ID NO: 70193 - protein, 810 aa, Homo sapiens; identical to SEQ ID NO: 70191

SEQ ID NO: 70194 - protein, 810 aa, Homo sapiens; identical to SEQ ID NO: 70191

SEQ ID NO: 70195 - protein, 50 aa, Homo sapiens
MPNQGEDCYFFFYSTCTKGDSCPFRHCEAAIGNETVCTLWQEGRCFRQVC

SEQ ID NO: 70196 - protein, 515 aa, Homo sapiens
MPNQGEDCYFFFYSTCTKGDSCPFRHCEAAIGNETVCTLWQEGRCFRQVCRFRHMEIDKKRSEIPCYWENQPTGCQKLNCAFHHNRGRYVDGLFLPPSKTVLPTVPESPEEEVKASQLSVQQNKLSVQSNPSPQLRSVMKVESSENVPSPTHPPVVINAADDDEDDDDQFSEEGDETKTPTLQPTPEVHNGLRVTSVRKPAVNIKQGECLNFGIKTLEEIKSKKMKEKSKKQGEGSSGVSSLLLHPEPVPGPEKENVRTVVRTVTLSTKQGEEPLVRLSLTERLGKRKFSAGGDSDPPLKRSLAQRLGKKVEAPETNIDKTPKKAQVSKSLKERLGMSADPDNEDATDKVNKVGEIHVKTLEEILLERASQKRGELQTKLKTEGPSKTDDSTSGARSSSTIRIKTFSEVLAEKKHRQQEAERQKSKKDTTCIKLKIDSEIKKTVVLPPIVASRGQSEEPAGKTKSMQEVHIKTLEEIKLEKALRVQQSSESSTSSPSQHEATPGARRLLRITKRT

SEQ ID NO: 70197 - protein, 756 aa, Homo sapiens
MEIDKKRSEIPCYWENQPTGCQKLNCAFHHNRGRYVDGLFLPPSKTVLPTVPESPEEEVKASQLSVQQNKLSVQSNPSPQLRSVMKVESSENVPSPTHPPVVINAADDDEDDDDQFSEEGDETKTPTLQPTPEVHNGLRVTSVRKPAVNIKQGECLNFGIKTLEEIKSKKMKEKSKKQGEGSSGVSSLLLHPEPVPGPEKENVRTVVRTVTLSTKQGEEPLVRLSLTERLGKRKFSAGGDSDPPLKRSLAQRLGKKVEAPETNIDKTPKKAQVSKSLKERLGMSADPDNEDATDKVNKVGEIHVKTLEEILLERASQKRGELQTKLKTEGPSKTDDSTSGARSSSTIRIKTFSEVLAEKKHRQQEAERQKSKKDTTCIKLKIDSEIKKTVVLPPIVASRGQSEEPAGKTKSMQEVHIKTLEEIKLEKALRVQQSSESSTSSPSQHEATPGARRLLRITKRTGMKEEKNLQEGNEVDSQSSIRTEAKEASGETTGVDITKIQVKRCETMREKHMQKQQEREKSVLTPLRGDVASCNTQVAEKPVLTAVPGITRHLTKRLPTKSSQKVEVETSGIGDSLLNVKCAAQTLEKRGKAKPKVNVKPSVVKVVSSPKLAPKRKAVEMHAAVIAAVKPLSSSSVLQEPPAKKAAVAVVPLVSEDKSVTVPEAENPRDSLVLPPTQSSSDSSPPEVSGPSSSQMSMKTRRLSSASTGKPPLSVEDDFEKLIWEISGGKLEAEIDLDPGKDEDDLLLELSEMIDS

SEQ ID NO: 70198 - protein, 810 aa, Homo sapiens; identical to SEQ ID NO: 70191

SEQ ID NO: 70199 - protein, 527 aa, Homo sapiens
MEHPSKMEFFQKLGYDREDVLRVLGKLGEGALVNDVLQELIRTGSRPGALEHPAAPRLVPRGSCGVPDSAQRGPGTALEEDFRTLASSLRPIVIDGSNVAMSHGNKETFSCRGIKLAVDWFRDRGHTYIKVFVPSWRKDPPRADTPIREQHVLAELERQAVLVYTPSRKVHGKRLVCYDDRYIVKVAYEQDGVIVSNDNYRDLQSENPEWKWFIEQRLLMFSFVNDRFMPPDDPLGRHGPSLSNFLSRKPKPPEPSWQHCPYGKKCTYGIKCKFYHPERPHHAQLAVADELRAKTGARPGAGAEEQRPPRAPGGSAGARAAPREPFAHSLPPARGSPDLAALRGSFSRLAFSDDLGPLGPPLPVPACSLTPRLGGPDWVSAGGRVPGPLSLPSPESQFSPGDLPPPPGLQLQPRGEHRPRDLHGDLLSPRRPPDDPWARPPRSDRFPGRSVWAEPAWGDGATGGLSVYATEDDEGDARARARIALYSVFPRDQVDRVMAAFPELSDLARLILLVQRCQSAGAPLGKP

SEQ ID NO: 70200 - protein, 527 aa, Homo sapiens; identical to SEQ ID NO: 70199

SEQ ID NO: 70201 - protein, 321 aa, Homo sapiens
MEHPSKMEFFQKLGYDREDVLRVLGKLGEGALVNDVLQELIRTGSRPGALEHPAAPRLVPRGSCGVPDSAQRGPGTALEEDFRTLASSLRPIVIDGSNVAMSHGNKETFSCRGIKLAVDWFRDRGHTYIKVFVPSWRKDPPRADTPIREQHVLAELERQAVLVYTPSRKVHGKRLVCYDDRYIVKVAYEQDGVIVSNDNYRDLQSENPEWKWFIEQRLLMFSFVNDRFMPPDDPLGRHGPSLSNFLSRKPKPPEPSWQHCPYGKKCTYGIKCKFYHPERPHHAQLAVADELRAKTGARLGVRGRPPASARPAAPAAGRTPP

SEQ ID NO: 70202 - protein, 321 aa, Homo sapiens
MEHPSKMEFFQKLGYDREDVLRVLGKLGEGALVNDVLQELIRTGSRPGALEHPAAPRLVPRGSCGVPDSAQRGPGTALEEDFRTLASSLRPIVIDGSNVAMSHGNKETFSCRGIKLAVDWFRDRGHTYIKVFVPSWRKDPPRADTPIREQHVLAELERQAVLVYTPSRKVHGKRLVCYDDRYIVKVAYEQDGVIVSNDNYRDLQSENPEWKWFIEQRLLMFSFVNDRFMPPDDPLGRHGPSLSNFLSRKPKPPEPSWQHCPYGKKCTYGIKCKFYHPERPHHAQLAVADELRAKTGARPVLPGRPPASARPAAPAAGRTPP

SEQ ID NO: 70203 - protein, 736 aa, Homo sapiens
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 70204 - protein, 579 aa, Homo sapiens
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQAEMSELSVAQKPEKLLERCKYWPACKNGDECAYHHPISPCKAFPNCKFAEKCLFVHPNCKYDAKCTKPDCPFTHVSRRIPVLSPKPVAPPAPPSSSQLCRYFPACKKMECPFYHPKHCRFNTQCTRPDCTFYHPTINVPPRHALKWIRPQTSE

SEQ ID NO: 70205 - protein, 306 aa, Homo sapiens
MRMSSKFPSPPLPIFLPPEPVDLGSITSSSCSLNELDNISHLLRKISADINEIKGMKAAILTVEANLFDLNVRVSKNEAKISSLEVKMNEYSTTYECNRQFEDQEEDTESQSRTTDVKIIGFLRNVEKGTQQRQLLSRLQIDPVMAETLQMSQAEMSELSVAQKPEKLLERCKYWPACKNGDECAYHHPISPCKAFPNCKFAEKCLFVHPNCKYDAKCTKPDCPFTHVSRRIPVLSPKPVAPPAPPSSSQLCRYFPACKKMECPFYHPKHCRFNTQCTRPDCTFYHPTINVPPRHALKWIRPQTSE

SEQ ID NO: 70206 - protein, 571 aa, Homo sapiens
MVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 70207 - protein, 673 aa, Homo sapiens
MEIGTEISRKIRSAIKGKLQELGAYIDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 70208 - protein, 571 aa, Homo sapiens; identical to SEQ ID NO: 70206

SEQ ID NO: 70209 - protein, 585 aa, Homo sapiens
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQAEMSELSVAQKPEKLLERCKYWPACKNGDECAYHHPISPCKAFPNCKFAEKCLFVHPNCKYDAKCTKPDCPFTHVSRRIPVLSPKPVAPPAPPSSSQLCRYFPACKKMECPFYHPKHCRFNTQCTRPDCTFYHPTINVPPRHALKWIRPQTSE

SEQ ID NO: 70210 - protein, 711 aa, Homo sapiens
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 70211 - protein, 711 aa, Homo sapiens
MEIGTEISRKIRSAIKGKLQELGAYIDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 70212 - protein, 282 aa, Homo sapiens
MRMSSKFPSPPLPIFLPPEPVDLGSITSSSCSLNELDNISHLLRKISADINEIKGMKAAILTVEANLFDLNVRVSKNEAKISSLEVKMNEYSTTYECNRQFEDQEEDTESQSRTTDVKIIGFLRNVEKAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 70213 - protein, 72 aa, Homo sapiens
MVMVANKKSQDQMTEDLSLFLGNNTIRFTVWLHGVLDKLRSVTTEPSSLKSSDTNIFDSNVPSNKSNFSRGD

SEQ ID NO: 70214 - protein, 94 aa, Homo sapiens
MVMVANKKSQDQMTEDLSLFLGNNTIRFTVWLHGVLDKLRSVTTEPSSLKSSDTNIFDSNVPSNKSNFSRGDERRHEAAVPPLAIPSARPEKRD

SEQ ID NO: 70215 - protein, 215 aa, Homo sapiens
MVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDM

SEQ ID NO: 70216 - protein, 651 aa, Homo sapiens
  MOD_RES (1)..(1): Any amino acid
XSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPVAPPAPPSSSQLCRYFPACKKMECPFYHPKHCRFNTQCTRPDCTFYHPTINVPPRHALKWIRPQTSE

SEQ ID NO: 70217 - protein, 133 aa, Homo sapiens
MVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAP

SEQ ID NO: 70218 - protein, 730 aa, Homo sapiens
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNAEMSELSVAQKPEKLLERCKYWPACKNGDECAYHHPISPCKAFPNCKFAEKCLFVHPNCKYDAKCTKPDCPFTHVSRRIPVLSPKPVAPPAPPSSSQLCRYFPACKKMECPFYHPKHCRFNTQCTRPDCTFYHPTINVPPRHALKWIRPQTSE

SEQ ID NO: 70219 - protein, 902 aa, Homo sapiens
MADPEVCCFITKILCAHGGRMALDALLQEIALSEPQLCEVLQVAGPDRFVVLETGGEAGITRSVVATTRARVCRRKYCQRPCDNLHLCKLNLLGRCNYSQSERNLCKYSHEVLSEENFKVLKNHELSGLNKEELAVLLLQSDPFFMPEICKSYKGEGRQQICNQQPPCSRLHICDHFTRGNCRFPNCLRSHNLMDRKVLAIMREHGLNPDVVQNIQDICNSKHMQKNPPGPRAPSSHRRNMAYRARSKSRDRFFQGSQEFLASASASAERSCTPSPDQISHRASLEDAPVDDLTRKFTYLGSQDRARPPSGSSKATDLGGTSQAGTSQRFLENGSQEDLLHGNPGSTYLASNSTSAPNWKSLTSWTNDQGARRKTVFSPTLPAARSSLGSLQTPEAVTTRKGTGLLSSDYRIINGKSGTQDIQPGPLFNNNADGVATDITSTRSLNYKSTSSGHREISSPRIQDAGPASRDVQATGRIADDADPRVALVNDSLSDVTSTTSSRVDDHDSEEICLDHLCKGCPLNGSCSKVHFHLPYRWQMLIGKTWTDFEHMETIEKGYCNPGIHLCSVGSYTINFRVMSCDSFPIRRLSTPSSVTKPANSVFTTKWIWYWKNESGTWIQYGEEKDKRKNSNVDSSYLESLYQSCPRGVVPFQAGSRNYELSFQGMIQTNIASKTQKDVIRRPTFVPQWYVQQMKRGPDHQPAKTSSVSLTATFRPQEDFCFLSSKKYKLSEIHHLHPEYVRVSEHFKASMKNFKIEKIKKIENSELLDKFTWKKSQMKEEGKLLFYATSRAYVESICSNNFDSFLHETHENKYGKGIYFAKDAIYSHKNCPYDAKNVVMFVAQVLVGKFTEGNITYTSPPPQFDSCVDTRSNPSVFVIFQKDQVYPQYVIEYTEDKACVIS

SEQ ID NO: 70220 - protein, 699 aa, Homo sapiens
MADPEVCCFITKILCAHGGRMALDALLQEIALSEPQLCEVLQVAGPDRFVVLETGGEAGITRSVVATTRARVCRRKYCQRPCDNLHLCKLNLLGRCNYSQSERNLCKYSHEVLSEENFKVLKNHELSGLNKEELAVLLLQSDPFFMPEICKSYKGEGRQQICNQQPPCSRLHICDHFTRGNCRFPNCLRSHNLMDRKVLAIMREHGLNPDVVQNIQDICNSKHMQKNPPGPRAPSSHRRNMAYRARSKSRDRFFQGSQEFLASASASAERSCTPSPDQISHRASLEDAPVDDLTRKFTYLGSQDRARPPSGSSKATDLGGTSQAGTSQRFLENGSQEDLLHGNPGSTYLASNSTSAPNWKSLTSWTNDQGARRKTVFSPTLPAARSSLGSLQTPEAVTTRKGTGLLSSDYRIINGKSGTQDIQPGPLFNNNADGVATDITSTRSLNYKSTSSGHREISSPRIQDAGPASRDVQATGRIADDADPRVALVNDSLSDVTSTTSSRVDDHDSEEICLDHLCKGCPLNGSCSKVHFHLPYRWQMLIGKTWTDFEHMETIEKGYCNPGIHLCSVGSYTINFRVMSCDSFPIRRLSTPSSVTKPANSVFTTKWIWYWKNESGTWIQYGEEKDKRKNSNVDSSYLESLYQSCPRGVVPFQAGSRNYELSFQGMIQTNIASKTQKDVIRRPTFVPQWYVQQMKRGPE

SEQ ID NO: 70221 - protein, 506 aa, Homo sapiens
MAYRARSKSRDRFFQGSQEFLASASASAERSCTPSPDQISHRASLEDAPVDDLTRKFTYLGSQDRARPPSGSSKATDLGGTSQAGTSQRFLENGSQEDLLHGNPGSTYLASNSTSAPNWKSLTSWTNDQGARRKTVFSPTLPAARSSLGSLQTPEAVTTRKGTGLLSSDYRIINGKSGTQDIQPGPLFNNNADGVATDITSTRSLNYKSTSSGHREISSPRIQDAGPASRDVQATGRIADDADPRVALVNDSLSDVTSTTSSRVDDHDSEEICLDHLCKGCPLNGSCSKVHFHLPYRWQMLIGKTWTDFEHMETIEKGYCNPGIHLCSVGSYTINFRVMSCDSFPIRRLSTPSSVTKPANSVFTTKWIWYWKNESGTWIQYGEEKDKRKNSNVDSSYLESLYQSCPRGVVPFQAGSRNYELSFQGMIQTNIASKTQKDVIRRPTFVPQWYVQEERARVSVLKQLFADRCLRCSCPGLIKSLVNLEPVFLKSSCLHYSAVSICIIDE

SEQ ID NO: 70222 - protein, 217 aa, Homo sapiens
MSGGLAPSKSTVYVSNLPFSLTNNDLYRIFSKYGKVVKVTIMKDKDTRKSKGVAFILFLDKDSAQNCTRAINNKQLFGRVIKASIAIDNGRAAEFIRRRNYFDKSKCYECGESGHLSYACPKNMLGEREPPKKKEKKKKKKAPEPEEEIEEVEESEDEGEDPALDSLSQAIAFQQAKIEEEQKKWKPSSGVPSTSDDSRRPRIKKSTYFSDEEELSD

SEQ ID NO: 70223 - protein, 166 aa, Homo sapiens
MAMSQESLTFKDVFVDFTLEEWQQLDSAQKNLYRDVMLENYSHLVSVGYLVAKPDVIFRLGPGEESWMADGGTPVRTCAEVWQVDEQIDHYKESQDKLPWQAAFIGKETLKDESGQESRTCRKSIYLSTEFDSVRQRLPKYYSWEKAFKTSFKLSWSKWKLCKKER

SEQ ID NO: 70224 - protein, 171 aa, Homo sapiens
MAMSQESLTFKDVFVDFTLEEWQQLDSAQKNLYRDVMLENYSHLVSVGYLVAKPDVIFRLGPGEESWMADGGTPVRTCAGEDRPEVWQVDEQIDHYKESQDKLPWQAAFIGKETLKDESGQESRTCRKSIYLSTEFDSVRQRLPKYYSWEKAFKTSFKLSWSKWKLCKKER

SEQ ID NO: 70225 - protein, 98 aa, Homo sapiens
MAMSQESLTFKDVFVDFTLEEWQQLDSAQKNLYRDVMLENYSHLVSVGYLVAKPDVIFRLGPGEESWMADGGTPVRTCAGEDRPDVSIFASCILKCCY

SEQ ID NO: 70226 - protein, 98 aa, Homo sapiens; identical to SEQ ID NO: 70225

SEQ ID NO: 70227 - protein, 171 aa, Homo sapiens
VAMSQESLTFKDVFVDFTLEEWQQLDSAQKNLYRDVMLENYSHLVSVGYLVAKPDVIFRLGPGEESWMADGGTPVRTCAGEDRPEVWQVDEQIDHYKESQDKLPWQAAFIGKETLKDESGQESRTCRKSIYLSTEFDSVRQRLPKYYSWEKAFKTSFKLSWSKWKLCKKER

SEQ ID NO: 70228 - protein, 98 aa, Homo sapiens; identical to SEQ ID NO: 70225

SEQ ID NO: 70229 - protein, 287 aa, Homo sapiens
MMNRFRKWLYKPKRSDPQLLARFYYADEELNQVAAELDSLDGRKDPQRCTLLVSQFRSCQDNVLNIINQIMDECIPQDRAPRDFCVKFPEEIRHDNLAGQLWFGAECLAAGSIIMNRELESMAMRPLAKELTRSLEDVRGALRDQALRDLNTYTEKMREALRHFDVLFAEFELSYVSAMVPVKSPREYYVQQEVIVLFCETVERALDFGYLTQDMIDDYEPALMFSIPRLAIVCPLLPAHPRTRAGATAHVACRMVAGSSSGALTHPPVSKQGVISALLRPLPELPP

SEQ ID NO: 70230 - protein, 172 aa, Homo sapiens
MMNRFRKWLYKPKDNVLNIINQIMDECIPQDRAPRDFCVKFPEEIRHDNLAGQLWFGAECLAAGSIIMNRELESMAMRPLAKELTRSLEDVRGALRDQALRDLNTYTEKMREALRHFDVLFAEFELSYVSAMVPVKSPREYYVQQEVIVLFCETVERNGKGVLKFMWNCNGP

SEQ ID NO: 70231 - protein, 163 aa, Homo sapiens
MDECIPQDRAPRDFCVKFPEEIRHDNLAGQLWFGAECLAAGSIIMNRELESMAMRPLAKELTRSLEDVRGALRDQALRDLNTYTEKMREALRHFDVLFAEFELSYVSAMVPVKSPREYYVQQEVIVLFCETVERALDFGYLTQDMIDDYEPALMFSIPRLAIV

SEQ ID NO: 70232 - protein, 3703 aa, Homo sapiens
MEGCDSPVVSGKDNGCGIPQHQQWTELNSTHLPDKPSSMEQSTGESHGPLDSLRAPFNERLAESTASAGPPSEPASKEVTCNECSASFASLQTYMEHHCPSARPPPPLREESASDTGEEGDEESDVENLAGEIVYQPDGSAYIVESLSQLTQGGGACGSGSGSGPLPSLFLNSLPGAGGKQGDPSCAAPVYPQIINTFHIASSFGKWFEGPDQAFPNTSALAGLSPVLHSFRVFDVRHKSNKDYLNSDGSAKSSCVSKDVPNNVDLSKFDGFVLYGKRKPILMCFLCKLSFGYVRSFVTHAVHDHRMTLSEDERKILSNKNISAIIQGIGKDKEPLVSFLEPKNKNFQHPLVSTANLIGPGHSFYGKFSGIRMEGEEALPAGSAAGPEQPQAGLLTPSTLLNLGGLTSSVLKTPITSVPLGPLASSPTKSSEGKDSGAAEGEKQEVGDGDCFSEKVEPAEEEAEEEEEEEEAEEEEEEEEEEEEEEEDEGCKGLFPSELDEELEDRPHEEPGAAAGSSSKKDLALSNQSISNSPLMPNVLQTLSRGTASTSSNSASSFVVFDGANRRNRLSFNSEGVRANVAEGGRRLDFADESANKDNATAPEPNESTEGDDGGFVPHHQHAGSLCELGVGECPSGSGVECPKCDTVLGSSRSLGGHMTMMHSRNSCKTLKCPKCNWHYKYQQTLEAHMKEKHPEPGGSCVYCKSGQPHPRLARGESYTCGYKPFRCEVCNYSTTTKGNLSIHMQSDKHLNNMQNLQNGGGEQVFSHTAGAAAAAVAAAAAAANISSSCGAPSPTKPKTKPTWRCEVCDYETNVARNLRIHMTSEKHMHNMMLLQQNMTQIQHNRHLGLGSLPSPAEAELYQYYLAQNMNLPNLKMDSAASDAQFMMSGFQLDPAGPMAAMTPALVGGEIPLDMRLGGGQLVSEELMNLGESFIQTNDPSLKLFQCAVCNKFTTDNLDMLGLHMNVERSLSEDEWKAVMGDSYQCKLCRYNTQLKANFQLHCKTDKHVQKYQLVAHIKEGGKANEWRLKCVAIGNPVHLKCNACDYYTNSLEKLRLHTVNSRHEASLKLYKHLQQHESGVEGESCYYHCVLCNYSTKAKLNLIQHVRSMKHQRSESLRKLQRLQKGLPEEDEDLGQIFTIRRCPSTDPEEAIEDVEGPSETAADPEELAKDQEGGASSSQAEKELTDSPATSKRISFPGSSESPLSSKRPKTAEEIKPEQMYQCPYCKYSNADVNRLRVHAMTQHSVQPMLRCPLCQDMLNNKIHLQLHLTHLHSVAPDCVEKLIMTVTTPEMVMPSSMFLPAAVPDRDGNSNLEEAGKQPETSEDLGKNILPSASTEQSGDLKPSPADPGSVREDSGFICWKKGCNQVFKTSAALQTHFNEVHAKRPQLPVSDRHVYKYRCNQCSLAFKTIEKLQLHSQYHVIRAATMCCLCQRSFRTFQALKKHLETSHLELSEADIQQLYGGLLANGDLLAMGDPTLAEDHTIIVEEDKEEESDLEDKQSPTGSDSGSVQEDSGSEPKRALPFRKGPNFTMEKFLDPSRPYKCTVCKESFTQKNILLVHYNSVSHLHKLKRALQESATGQPEPTSSPDNKPFKCNTCNVAYSQSSTLEIHMRSVLHQTKARAAKLEAASGSSNGTGNSSSISLSSSTPSPVSTSGSNTFTTSNPSSAGIAPSSNLLSQVPTESVGMPPLGNPIGANIASPSEPKEANRKKLADMIASRQQQQQQQQQQQQQQQQQQQAQTLAQAQAQVQAHLQQELQQQAALIQSQLFNPTLLPHFPMTTETLLQLQQQQHLLFPFYIPSAEFQLNPEVSLPVTSGALTLTGTGPGLLEDLKAQVQVPQQSHQQILPQQQQNQLSIAQSHSALLQPSQHPEKKNKLVIKEKEKESQRERDSAEGGEGNTGPKETLPDALKAKEKKELAPGGGSEPSMLPPRIASDARGNATKALLENFGFELVIQYNENKQKVQKKNGKTDQGENLEKLECDSCGKLFSNILILKSHQEHVHQNYFPFKQLERFAKQYRDHYDKLYPLRPQTPEPPPPPPPPPPPPLPAAPPQPASTPAIPASAPPITSPTIAPAQPSVPLTQLSMPMELPIFSPLMMQTMPLQTLPAQLPPQLGPVEPLPADLAQLYQHQLNPTLLQQQNKRPRTRITDDQLRVLRQYFDINNSPSEEQIKEMADKSGLPQKVIKHWFRNTLFKERQRNKDSPYNFSNPPITSLEELKIDSRPPSPEPPKQEYWGSKRSSRTRFTDYQLRVLQDFFDANAYPKDDEFEQLSNLLNLPTRVIVVWFQNARQKARKNYENQGEGKDGERRELTNDRYIRTSNLNYQCKKCSLVFQRIFDLIKHQKKLCYKDEDEEGQDDSQNEDSMDAMEILTPTSSSCSTPMPSQAYSAPAPSANNTASSAFLQLTAEAEELATFNSKTEAGDEKPKLAEAPSAQPNQTQEKQGQPKPELQQQEQPEQKTNTPQQKLPQLVSLPSLPQPPPQAPPPQCPLPQSSPSPSQLSHLPLKPLHTSTPQQLANLPPQLIPYQCDQCKLAFPSFEHWQEHQQLHFLSAQNQFIHPQFLDRSLDMPFMLFDPSNPLLASQLLSGAIPQIPASSATSPSTPTSTMNTLKRKLEEKASASPGENDSGTGGEEPQRDKRLRTTITPEQLEILYQKYLLDSNPTRKMLDHIAHEVGLKKRVVQVWFQNTRARERKGQFRAVGPAQAHRRCPFCRALFKAKTALEAHIRSRHWHEAKRAGYNLTLSAMLLDCDGGLQMKGDIFDGTSFSHLPPSSSDGQGVPLSPVSKTMELSPRTLLSPSSIKVEGIEDFESPSMSSVNLNFDQTKLDNDDCSSVNTAITDTTTGDEGNADNDSATGIATETKSSSAPNEGLTKAAMMAMSEYEDRLSSGLVSPAPSFYSKEYDNEGTVDYSETSSLADPCSPSPGASGSAGKSGDSGDRPGQKRFRTQMTNLQLKVLKSCFNDYRTPTMLECEVLGNDIGLPKRVVQVWFQNARAKEKKSKLSMAKHFGINQTSYEGPKTECTLCGIKYSARLSVRDHIFSQQHISKVKDTIGSQLDKEKEYFDPATVRQLMAQQELDRIKKANEVLGLAAQQQGMFDNTPLQALNLPTAYPALQGIPPVLLPGLNSPSLPGFTPSNTALTSPKPNLMGLPSTTVPSPGLPTSGLPNKPSSASLSSPTPAQATMAMGPQQPPQQQQQQQQPQVQQPPPPPAAQPPPTPQLPLQQQQQRKDKDSEKVKEKEKAHKGKGEPLPVPKKEKGEAPTATAATISAPLPTMEYAVDPAQLQALQAALTSDPTALLTSQFLPYFVPGFSPYYAPQIPGALQSGYLQPMYGMEGLFPYSPALSQALMGLSPGSLLQQYQQYQQSLQEAIQQQQQRQLQQQQQQKVQQQQPKASQTPVPPGAPSPDKDPAKESPKPEEQKNTPREVSPLLPKLPEEPEAESKSADSLYDPFIVPKVQYKLVCRKCQAGFSDEEAARSHLKSLCFFGQSVVNLQEMVLHVPTGGGGGGSGGGGGGGGGGGGGGSYHCLACESALCGEEALSQHLESALHKHRTITRAARNAKEHPSLLPHSACFPDPSTASTSQSAAHSNDSPPPPSAAAPSSASPHASRKSWPQVVSRASAAKPPSFPPLSSSSTVTSSSCSTSGVQPSMPTDDYSEESDTDLSQKSDGPASPVEGPKDPSCPKDSGLTSVGTDTFRL

SEQ ID NO: 70233 - protein, 2789 aa, Homo sapiens
MRLGGGQLVSEELMNLGESFIQTNDPSLKLFQCAVCNKFTTDNLDMLGLHMNVERSLSEDEWKAVMGDSYQCKLCRYNTQLKANFQLHCKTDKHVQKYQLVAHIKEGGKANEWRLKCVAIGNPVHLKCNACDYYTNSLEKLRLHTVNSRHEASLKLYKHLQQHESGVEGESCYYHCVLCNYSTKAKLNLIQHVRSMKHQRSESLRKLQRLQKGLPEEDEDLGQIFTIRRCPSTDPEEAIEDVEGPSETAADPEELAKDQEGGASSSQAEKELTDSPATSKRISFPGSSESPLSSKRPKTAEEIKPEQMYQCPYCKYSNADVNRLRVHAMTQHSVQPMLRCPLCQDMLNNKIHLQLHLTHLHSVAPDCVEKLIMTVTTPEMVMPSSMFLPAAVPDRDGNSNLEEAGKQPETSEDLGKNILPSASTEQSGDLKPSPADPGSVREDSGFICWKKGCNQVFKTSAALQTHFNEVHAKRPQLPVSDRHVYKYRCNQCSLAFKTIEKLQLHSQYHVIRAATMCCLCQRSFRTFQALKKHLETSHLELSEADIQQLYGGLLANGDLLAMGDPTLAEDHTIIVEEDKEEESDLEDKQSPTGSDSGSVQEDSGSEPKRALPFRKGPNFTMEKFLDPSRPYKCTVCKESFTQKNILLVHYNSVSHLHKLKRALQESATGQPEPTSSPDNKPFKCNTCNVAYSQSSTLEIHMRSVLHQTKARAAKLEAASGSSNGTGNSSSISLSSSTPSPVSTSGSNTFTTSNPSSAGIAPSSNLLSQVPTESVGMPPLGNPIGANIASPSEPKEANRKKLADMIASRQQQQQQQQQQQQQQQQQQQAQTLAQAQAQVQAHLQQELQQQAALIQSQLFNPTLLPHFPMTTETLLQLQQQQHLLFPFYIPSAEFQLNPEVSLPVTSGALTLTGTGPGLLEDLKAQVQVPQQSHQQILPQQQQNQLSIAQSHSALLQPSQHPEKKNKLVIKEKEKESQRERDSAEGGEGNTGPKETLPDALKAKEKKELAPGGGSEPSMLPPRIASDARGNATKALLENFGFELVIQYNENKQKVQKKNGKTDQGENLEKLECDSCGKLFSNILILKSHQEHVHQNYFPFKQLERFAKQYRDHYDKLYPLRPQTPEPPPPPPPPPPPPLPAAPPQPASTPAIPASAPPITSPTIAPAQPSVPLTQLSMPMELPIFSPLMMQTMPLQTLPAQLPPQLGPVEPLPADLAQLYQHQLNPTLLQQQNKRPRTRITDDQLRVLRQYFDINNSPSEEQIKEMADKSGLPQKVIKHWFRNTLFKERQRNKDSPYNFSNPPITSLEELKIDSRPPSPEPPKQEYWGSKRSSRTRFTDYQLRVLQDFFDANAYPKDDEFEQLSNLLNLPTRVIVVWFQNARQKARKNYENQGEGKDGERRELTNDRYIRTSNLNYQCKKCSLVFQRIFDLIKHQKKLCYKDEDEEGQDDSQNEDSMDAMEILTPTSSSCSTPMPSQAYSAPAPSANNTASSAFLQLTAEAEELATFNSKTEAGDEKPKLAEAPSAQPNQTQEKQGQPKPELQQQEQPEQKTNTPQQKLPQLVSLPSLPQPPPQAPPPQCPLPQSSPSPSQLSHLPLKPLHTSTPQQLANLPPQLIPYQCDQCKLAFPSFEHWQEHQQLHFLSAQNQFIHPQFLDRSLDMPFMLFDPSNPLLASQLLSGAIPQIPASSATSPSTPTSTMNTLKRKLEEKASASPGENDSGTGGEEPQRDKRLRTTITPEQLEILYQKYLLDSNPTRKMLDHIAHEVGLKKRVVQVWFQNTRARERKGQFRAVGPAQAHRRCPFCRALFKAKTALEAHIRSRHWHEAKRAGYNLTLSAMLLDCDGGLQMKGDIFDGTSFSHLPPSSSDGQGVPLSPVSKTMELSPRTLLSPSSIKVEGIEDFESPSMSSVNLNFDQTKLDNDDCSSVNTAITDTTTGDEGNADNDSATGIATETKSSSAPNEGLTKAAMMAMSEYEDRLSSGLVSPAPSFYSKEYDNEGTVDYSETSSLADPCSPSPGASGSAGKSGDSGDRPGQKRFRTQMTNLQLKVLKSCFNDYRTPTMLECEVLGNDIGLPKRVVQVWFQNARAKEKKSKLSMAKHFGINQTSYEGPKTECTLCGIKYSARLSVRDHIFSQQHISKVKDTIGSQLDKEKEYFDPATVRQLMAQQELDRIKKANEVLGLAAQQQGMFDNTPLQALNLPTAYPALQGIPPVLLPGLNSPSLPGFTPSNTALTSPKPNLMGLPSTTVPSPGLPTSGLPNKPSSASLSSPTPAQATMAMGPQQPPQQQQQQQQPQVQQPPPPPAAQPPPTPQLPLQQQQQRKDKDSEKVKEKEKAHKGKGEPLPVPKKEKGEAPTATAATISAPLPTMEYAVDPAQLQALQAALTSDPTALLTSQFLPYFVPGFSPYYAPQIPGALQSGYLQPMYGMEGLFPYSPALSQALMGLSPGSLLQQYQQYQQSLQEAIQQQQQRQLQQQQQQKVQQQQPKASQTPVPPGAPSPDKDPAKESPKPEEQKNTPREVSPLLPKLPEEPEAESKSADSLYDPFIVPKVQYKLVCRKCQAGFSDEEAARSHLKSLCFFGQSVVNLQEMVLHVPTGGGGGGSGGGGGGGGGGGGGGSYHCLACESALCGEEALSQHLESALHKHRTITRAARNAKEHPSLLPHSACFPDPSTASTSQSAAHSNDSPPPPSAAAPSSASPHASRKSWPQVVSRASAAKPPSFPPLSSSSTVTSSSCSTSGVQPSMPTDDYSEESDTDLSQKSDGPASPVEGPKDPSCPKDSGLTSVGTDTFRL

SEQ ID NO: 70234 - protein, 3567 aa, Homo sapiens
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAYIIEDSKESGQNAQTGANSKLFSTAMFLDSLASAGEKSDQSASAPMSFYPQIINTFHIASSLGKPFTADQAFPNTSALAGVGPVLHSFRVYDLRHKREKDYLTSDGSAKNSCVSKDVPNNVDLSKFDGCVSDGKRKPVLMCFLCKLSFGYIRSFVTHAVHDHRMTLNDEEQKLLSNKCVSAIIQGIGKDKEPLISFLEPKKSTSVYPHFSTTNLIGPDPTFRGLWSAFHVENGDSLPAGFAFLKGSASTSSSAEQPLGITQMPKAEVNLGGLSSLVVNTPITSVSLSHSSSESSKMSESKDQENNCERPKESNVLHPNGECPVKSEPTEPGDEDEEDAYSNELDDEEVLGELTDSIGNKDFPLLNQSISPLSSSVLKFIEKGTSSSSATVSDDTEKKKQTAAVRASGSVASNYGISGKDFADASASKDSATAAHPSEIARGDEDSSATPHQHGFTPSTPGTPGPGGDGSPGSGIECPKCDTVLGSSRSLGGHMTMMHSRNSCKTLKCPKCNWHYKYQQTLEAHMKEKHPEPGGSCVYCKTGQPHPRLARGESYTCGYKPFRCEVCNYSTTTKGNLSIHMQSDKHLNNVQNLQNGNGEQVFGHSAPAPNTSLSGCGTPSPSKPKQKPTWRCEVCDYETNVARNLRIHMTSEKHMHNMMLLQQNMKQIQHNLHLGLAPAEAELYQYYLAQNIGLTGMKLENPADPQLMINPFQLDPATAAALAPGLGELSPYISDPALKLFQCAVCNKFTSDSLEALSVHVSSERSLPEEEWRAVIGDIYQCKLCNYNTQLKANFQLHCKTDKHMQKYQLVAHIKEGGKSNEWRLKCIAIGNPVHLKCNACDYYTNSVDKLRLHTTNHRHEAALKLYKHLQKQEGAVNPESCYYYCAVCDYTTKVKLNLVQHVRSVKHQQTEGLRKLQLHQQGLAPEEDNLSEIFFVKDCPPNELETASLGARTCDDDLTEQHEEAEGAIKPTAVAEDDEKDTSERDNSEGKNSNKDSVSVAGGTQPLLLAKEEDVATKRSKPTEDNKFCHEQFYQCPYCNYNSRDQSRIQMHVLSQHSVQPVICCPLCQDVLSNKMHLQLHLTHLHSVSPDCVEKLLMTVPVPDVMMPNSMLLPAAASEKSERDTPAAVTAEGSGKYSGESPMDDKSMAGLEDSKANVEVKNEEQKPTKEPLEVSEWNKNSSKDVKIPDTLQDQLNEQQKRQPLSVSDRHVYKYRCNHCSLAFKTMQKLQIHSQYHAIRAATMCNLCQRSFRTFQALKKHLEAGHPELSEAELQQLYASLPVNGELWAESETMSQDDHGLEQEMEREYEVDHEGKASPVGSDSSSIPDDMGSEPKRTLPFRKGPNFTMEKFLDPSRPYKCTVCKESFTQKNILLVHYNSVSHLHKLKKVLQEASSPVPQETNSNTDNKPYKCSICNVAYSQSSTLEIHMRSVLHQTKARAAKLEPSGHVAGGHSIAANVNSPGQGMLDSMSLAAVNSKDTHLDAKELNKKQTPDLISAQPAHHPPQSPAQIQMQLQHELQQQAAFFQPQFLNPAFLPHFPMTPEALLQFQQPQFLFPFYIPGTEFSLGPDLGLPGSATFGMPGMTGMAGSLLEDLKQQIQTQHHVGQTQLQILQQQAQQYQATQPQLQPQKQQQQPPPPQQQQQQQASKLLKQEQSNIVSADCQIMKDVPSYKEAEDISEKPEKPKQEFISEGEGLKEGKDTKKQKSLEPSIPPPRIASGARGNAAKALLENFGFELVIQYNENRQKVQKKGKSGEGENTDKLECGTCGKLFSNVLILKSHQEHVHGQFFPYAALEKFARQYREAYDKLYPISPSSPETPPPPPPPPPLPPAPPQPSSMGPVKIPNTVSTPLQAPPPTPPPPPPPPPPPPPPPPPPPPSAPPQVQLPVSLDLPLFPSIMMQPVQHPALPPQLALQLPQMDALSADLTQLCQQQLGLDPNFLRHSQFKRPRTRITDDQLKILRAYFDINNSPSEEQIQEMAEKSGLSQKVIKHWFRNTLFKERQRNKDSPYNFSNPPITVLEDIRIDPQPTSLEHYKSDASFSKRSSRTRFTDYQLRVLQDFFDTNAYPKDDEIEQLSTVLNLPTRVIVVWFQNARQKARKSYENQAETKDNEKRELTNERYIRTSNMQYQCKKCNVVFPRIFDLITHQKKQCYKDEDDDAQDESQTEDSMDATDQVVYKHCTVSGQTDAAKNAAAPAASSGSGTSTPLIPSPKPEPEKTSPKPEYPAEKPKQSDPSPPSQGTKPALPLASTSSDPPQASTAQPQPQPQPPKQPQLIGRPPSASQTPVPSSPLQISMTSLQNSLPPQLLQYQCDQCTVAFPTLELWQEHQHMHFLAAQNQFLHSPFLERPMDMPYMIFDPNNPLMTGQLLGSSLTQMPPQASSSHTTAPTTVAASLKRKLDDKEDNNCSEKEGGNSGEDQHRDKRLRTTITPEQLEILYEKYLLDSNPTRKMLDHIAREVGLKKRVVQVWFQNTRARERKGQFRAVGPAQSHKRCPFCRALFKAKSALESHIRSRHWNEGKQAGYSLPPSPLISTEDGGESPQKYIYFDYPSLPLTKIDLSSENELASTVSTPVSKTAELSPKNLLSPSSFKAECSEDVENLNAPPAEAGYDQNKTDFDETSSINTAISDATTGDEGNTEMESTTGSSGDVKPALSPKEPKTLDTLPKPATTPTTEVCDDKFLFSLTSPSIHFNDKDGDHDQSFYITDDPDDNADRSETSSIADPSSPNPFGSSNPFKSKSNDRPGHKRFRTQMSNLQLKVLKACFSDYRTPTMQECEMLGNEIGLPKRVVQVWFQNARAKEKKFKINIGKPFMINQGGTEGTKPECTLCGVKYSARLSIRDHIFSKQHISKVRETVGSQLDREKDYLAPTTVRQLMAQQELDRIKKASDVLGLTVQQPGMMDSSSLHGISLPTAYPGLPGLPPVLLPGMNGPSSLPGFPQNSNIASGMLGFPTSATSSPALSLSSAPTKPLLQTPPPPPPPPPPPPSSSLSGQQTEQQNKESEKKQTKPNKVKKIKEEELEATKPEKHPKKEEKISSALSVLGKVVGETHVDPIQLQALQNAIAGDPASFIGGQFLPYFIPGFASYFTPQLPGTVQGGYFPPVCGMESLFPYGPTMPQTLAGLSPGALLQQYQQYQQNLQESLQKQQKQQQEQQQKPVQAKTSKVESDQPQNSNDASETKEDKSTATESTKEEPQLESKSADFSDTYVVPFVKYEFICRKCQMMFTDEDAAVNHQKSFCYFGQPLIDPQETVLRVPVSKYQCLACDVAISGNEALSQHLQSSLHKEKTIKQAMRNAKEHVRLLPHSVCSPNPNTTSTSQSAASSNNTYPHLSCFSMKSWPNILFQASARRAASPPSSPPSLSLPSTVTSSLCSTSGVQTSLPTESCSDESDSELSQKLEDLDNSLEVKAKPASGLDGNFNSIRMDMFSV

SEQ ID NO: 70235 - protein, 3600 aa, Homo sapiens
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAYIIEDSKESGQNAQTGANSKLFSTAMFLDSLASAGEKSDQSASAPMSFYPQIINTFHIASSLGKPFTADQAFPNTSALAGVGPVLHSFRVYDLRHKREKDYLTSDGSAKNSCVSKDVPNNVDLSKFDGCVSDGKRKPVLMCFLCKLSFGYIRSFVTHAVHDHRMTLNDEEQKLLSNKCVSAIIQGIGKDKEPLISFLEPKKSTSVYPHFSTTNLIGPDPTFRGLWSAFHVENGDSLPAGFAFLKGSASTSSSAEQPLGITQMPKAEVNLGGLSSLVVNTPITSVSLSHSSSESSKMSESKDQENNCERPKESNVLHPNGECPVKSEPTEPGDEDEEDAYSNELDDEEVLGELTDSIGNKDFPLLNQSISPLSSSVLKFIEKGTSSSSATVSDDTEKKKQTAAVRASGSVASNYGISGKDFADASASKDSATAAHPSEIARGDEDSSATPHQHGFTPSTPGTPGPGGDGSPGSGIECPKCDTVLGSSRSLGGHMTMMHSRNSCKTLKCPKCNWHYKYQQTLEAHMKEKHPEPGGSCVYCKTGQPHPRLARGESYTCGYKPFRCEVCNYSTTTKGNLSIHMQSDKHLNNVQNLQNGNGEQVFGHSAPAPNTSLSGCGTPSPSKPKQKPTWRCEVCDYETNVARNLRIHMTSEKHMHNMMLLQQNMKQIQHNLHLGLAPAEAELYQYYLAQNIGLTGMKLENPADPQLMINPFQLDPATAAALAPGLVNNELPPEIRLASGQLMGDDLSLLTAGELSPYISDPALKLFQCAVCNKFTSDSLEALSVHVSSERSLPEEEWRAVIGDIYQCKLCNYNTQLKANFQLHCKTDKHMQKYQLVAHIKEGGKSNEWRLKCIAIGNPVHLKCNACDYYTNSVDKLRLHTTNHRHEAALKLYKHLQKQEGAVNPESCYYYCAVCDYTTKVKLNLVQHVRSVKHQQTEGLRKLQLHQQGLAPEEDNLSEIFFVKDCPPNELETASLGARTCDDDLTEQQLRSTSEEQSEEAEGAIKPTAVAEDDEKDTSERDNSEGKNSNKDSGIITPEKELKVSVAGGTQPLLLAKEEDVATKRSKPTEDNKFCHEQFYQCPYCNYNSRDQSRIQMHVLSQHSVQPVICCPLCQDVLSNKMHLQLHLTHLHSVSPDCVEKLLMTVPVPDVMMPNSMLLPAAASEKSERDTPAAVTAEGSGKYSGESPMDDKSMAGLEDSKANVEVKNEEQKPTKEPLEVSEWNKNSSKDVKIPDTLQDQLNEQQKRQPLSVSDRHVYKYRCNHCSLAFKTMQKLQIHSQYHAIRAATMCNLCQRSFRTFQALKKHLEAGHPELSEAELQQLYASLPVNGELWAESETMSQDDHGLEQEMEREYEVDHEGKASPVGSDSSSIPDDMGSEPKRTLPFRKGPNFTMEKFLDPSRPYKCTVCKESFTQKNILLVHYNSVSHLHKLKKVLQEASSPVPQETNSNTDNKPYKCSICNVAYSQSSTLEIHMRSVLHQTKARAAKLEPSGHVAGGHSIAANVNSPGQGMLDSMSLAAVNSKDTHLDAKELNKKQTPDLISAQPAHHPPQSPAQIQMQLQHELQQQAAFFQPQFLNPAFLPHFPMTPEALLQFQQPQFLFPFYIPGTEFSLGPDLGLPGSATFGMPGMTGMAGSLLEDLKQQIQTQHHVGQTQLQILQQQAQQYQATQPQLQPQKQQQQPPPPQQQQQQQASKLLKQEQSNIVSADCQIMKDVPSYKEAEDISEKPEKPKQEFISEGEGLKEGKDTKKQKSLEPSIPPPRIASGARGNAAKALLENFGFELVIQYNENRQKVQKKGKSGEGENTDKLECGTCGKLFSNVLILKSHQEHVHGQFFPYAALEKFARQYREAYDKLYPISPSSPETPPPPPPPPPLPPAPPQPSSMGPVKIPNTVSTPLQAPPPTPPPPSAPPQVQLPVSLDLPLFPSIMMQPVQHPALPPQLALQLPQMDALSADLTQLCQQQLGLDPNFLRHSQFKRPRTRITDDQLKILRAYFDINNSPSEEQIQEMAEKSGLSQKVIKHWFRNTLFKERQRNKDSPYNFSNPPITVLEDIRIDPQPTSLEHYKSDASFSKRSSRTRFTDYQLRVLQDFFDTNAYPKDDEIEQLSTVLNLPTRVIVVWFQNARQKARKSYENQAETKDNEKRELTNERYIRTSNMQYQCKKCNVVFPRIFDLITHQKKQCYKDEDDDAQDESQTEDSMDATDQVVYKHCTVSGQTDAAKNAAAPAASSGSGTSTPLIPSPKPEPEKTSPKPEYPAEKPKQSDPSPPSQGTKPALPLASTSSDPPQASTAQPQPQPQPPKQPQLIGRPPSASQTPVPSSPLQISMTSLQNSLPPQLLQYQCDQCTVAFPTLELWQEHQHMHFLAAQNQFLHSPFLERPMDMPYMIFDPNNPLMTGQLLGSSLTQMPPQASSSHTTAPTTVAASLKRKLDDKEDNNCSEKEGGNSGEDQHRDKRLRTTITPEQLEILYEKYLLDSNPTRKMLDHIAREVGLKKRVVQVWFQNTRARERKGQFRAVGPAQSHKRCPFCRALFKAKSALESHIRSRHWNEGKQAGYSLPPSPLISTEDGGESPQKYIYFDYPSLPLTKIDLSSENELASTVSTPVSKTAELSPKNLLSPSSFKAECSEDVENLNAPPAEAGYDQNKTDFDETSSINTAISDATTGDEGNTEMESTTGSSGDVKPALSPKEPKTLDTLPKPATTPTTEVCDDKFLFSLTSPSIHFNDKDGDHDQSFYITDDPDDNADRSETSSIADPSSPNPFGSSNPFKSKSNDRPGHKRFRTQMSNLQLKVLKACFSDYRTPTMQECEMLGNEIGLPKRVVQVWFQNARAKEKKFKINIGKPFMINQGGTEGTKPECTLCGVKYSARLSIRDHIFSKQHISKVRETVGSQLDREKDYLAPTTVRQLMAQQELDRIKKASDVLGLTVQQPGMMDSSSLHGISLPTAYPGLPGLPPVLLPGMNGPSSLPGFPQNSNTLTPPGAGMLGFPTSATSSPALSLSSAPTKPLLQTPPPPPPPPPPPPSSSLSGQQTEQQNKESEKKQTKPNKVKKIKEEELEATKPEKHPKKEEKISSALSVLGKVVGETHVDPIQLQALQNAIAGDPASFIGGQFLPYFIPGFASYFTPQLPGTVQGGYFPPVCGMESLFPYGPTMPQTLAGLSPGALLQQYQQYQQNLQESLQKQQKQQQEQQQKPVQAKTSKVESDQPQNSNDASETKEDKSTATESTKEEPQLESKSADFSDTYVVPFVKYEFICRKCQMMFTDEDAAVNHQKSFCYFGQPLIDPQETVLRVPVSKYQCLACDVAISGNEALSQHLQSSLHKEKTIKQAMRNAKEHVRLLPHSVCSPNPNTTSTSQSAASSNNTYPHLSCFSMKSWPNILFQASARRAASPPSSPPSLSLPSTVTSSLCSTSGVQTSLPTESCSDESDSELSQKLEDLDNSLEVKAKPASGLDGNFNSIRMDMFSV

SEQ ID NO: 70236 - protein, 3571 aa, Homo sapiens
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAYIIEDSKESGQNAQTGANSKLFSTAMFLDSLASAGEKSDQSASAPMSFYPQIINTFHIASSLGKPFTADQAFPNTSALAGVGPVLHSFRVYDLRHKREKDYLTSDGSAKNSCVSKDVPNNVDLSKFDGCVSDGKRKPVLMCFLCKLSFGYIRSFVTHAVHDHRMTLNDEEQKLLSNKCVSAIIQGIGKDKEPLISFLEPKKSTSVYPHFSTTNLIGPDPTFRGLWSAFHVENGDSLPAGFAFLKGSASTSSSAEQPLGITQMPKAEVNLGGLSSLVVNTPITSVSLSHSSSESSKMSESKDQENNCERPKESNVLHPNGECPVKSEPTEPGDEDEEDAYSNELDDEEVLGELTDSIGNKDFPLLNQSISPLSSSVLKFIEKGTSSSSATVSDDTEKKKQTAAVRASGSVASNYGISGKDFADASASKDSATAAHPSEIARGDEDSSATPHQHGFTPSTPGTPGPGGDGSPGSGIECPKCDTVLGSSRSLGGHMTMMHSRNSCKTLKCPKCNWHYKYQQTLEAHMKEKHPEPGGSCVYCKTGQPHPRLARGESYTCGYKPFRCEVCNYSTTTKGNLSIHMQSDKHLNNVQNLQNGNGEQVFGHSAPAPNTSLSGCGTPSPSKPKQKPTWRCEVCDYETNVARNLRIHMTSEKHMHNMMLLQQNMKQIQHNLHLGLAPAEAELYQYYLAQNIGLTGMKLENPADPQLMINPFQLDPATAAALAPGLGELSPYISDPALKLFQCAVCNKFTSDSLEALSVHVSSERSLPEEEWRAVIGDIYQCKLCNYNTQLKANFQLHCKTDKHMQKYQLVAHIKEGGKSNEWRLKCIAIGNPVHLKCNACDYYTNSVDKLRLHTTNHRHEAALKLYKHLQKQEGAVNPESCYYYCAVCDYTTKVKLNLVQHVRSVKHQQTEGLRKLQLHQQGLAPEEDNLSEIFFVKDCPPNELETASLGARTCDDDLTEQHEEAEGAIKPTAVAEDDEKDTSERDNSEGKNSNKDSVSVAGGTQPLLLAKEEDVATKRSKPTEDNKFCHEQFYQCPYCNYNSRDQSRIQMHVLSQHSVQPVICCPLCQDVLSNKMHLQLHLTHLHSVSPDCVEKLLMTVPVPDVMMPNSMLLPAAASEKSERDTPAAVTAEGSGKYSGESPMDDKSMAGLEDSKANVEVKNEEQKPTKEPLEVSEWNKNSSKDVKIPDTLQDQLNEQQKRQPLSVSDRHVYKYRCNHCSLAFKTMQKLQIHSQYHAIRAATMCNLCQRSFRTFQALKKHLEAGHPELSEAELQQLYASLPVNGELWAESETMSQDDHGLEQEMEREYEVDHEGKASPVGSDSSSIPDDMGSEPKRTLPFRKGPNFTMEKFLDPSRPYKCTVCKESFTQKNILLVHYNSVSHLHKLKKVLQEASSPVPQETNSNTDNKPYKCSICNVAYSQSSTLEIHMRSVLHQTKARAAKLEPSGHVAGGHSIAANVNSPGQGMLDSMSLAAVNSKDTHLDAKELNKKQTPDLISAQPAHHPPQSPAQIQMQLQHELQQQAAFFQPQFLNPAFLPHFPMTPEALLQFQQPQFLFPFYIPGTEFSLGPDLGLPGSATFGMPGMTGMAGSLLEDLKQQIQTQHHVGQTQLQILQQQAQQYQATQPQLQPQKQQQQPPPPQQQQQQQASKLLKQEQSNIVSADCQIMKDVPSYKEAEDISEKPEKPKQEFISEGEGLKEGKDTKKQKSLEPSIPPPRIASGARGNAAKALLENFGFELVIQYNENRQKVQKKGKSGEGENTDKLECGTCGKLFSNVLILKSHQEHVHGQFFPYAALEKFARQYREAYDKLYPISPSSPETPPPPPPPPPLPPAPPQPSSMGPVKIPNTVSTPLQAPPPTPPPPPPPPPPPPPPPPPPPPSAPPQVQLPVSLDLPLFPSIMMQPVQHPALPPQLALQLPQMDALSADLTQLCQQQLGLDPNFLRHSQFKRPRTRITDDQLKILRAYFDINNSPSEEQIQEMAEKSGLSQKVIKHWFRNTLFKERQRNKDSPYNFSNPPITVLEDIRIDPQPTSLEHYKSDASFSKRSSRTRFTDYQLRVLQDFFDTNAYPKDDEIEQLSTVLNLPTRVIVVWFQNARQKARKSYENQAETKDNEKRELTNERYIRTSNMQYQCKKCNVVFPRIFDLITHQKKQCYKDEDDDAQDESQTEDSMDATDQVVYKHCTVSGQTDAAKNAAAPAASSGSGTSTPLIPSPKPEPEKTSPKPEYPAEKPKQSDPSPPSQGTKPALPLASTSSDPPQASTAQPQPQPQPPKQPQLIGRPPSASQTPVPSSPLQISMTSLQNSLPPQLLQYQCDQCTVAFPTLELWQEHQHMHFLAAQNQFLHSPFLERPMDMPYMIFDPNNPLMTGQLLGSSLTQMPPQASSSHTTAPTTVAASLKRKLDDKEDNNCSEKEGGNSGEDQHRDKRLRTTITPEQLEILYEKYLLDSNPTRKMLDHIAREVGLKKRVVQVWFQNTRARERKGQFRAVGPAQSHKRCPFCRALFKAKSALESHIRSRHWNEGKQAGYSLPPSPLISTEDGGESPQKYIYFDYPSLPLTKIDLSSENELASTVSTPVSKTAELSPKNLLSPSSFKAECSEDVENLNAPPAEAGYDQNKTDFDETSSINTAISDATTGDEGNTEMESTTGSSGDVKPALSPKEPKTLDTLPKPATTPTTEVCDDKFLFSLTSPSIHFNDKDGDHDQSFYITDDPDDNADRSETSSIADPSSPNPFGSSNPFKSKSNDRPGHKRFRTQMSNLQLKVLKACFSDYRTPTMQECEMLGNEIGLPKRVVQVWFQNARAKEKKFKINIGKPFMINQGGTEGTKPECTLCGVKYSARLSIRDHIFSKQHISKVRETVGSQLDREKDYLAPTTVRQLMAQQELDRIKKASDVLGLTVQQPGMMDSSSLHGISLPTAYPGLPGLPPVLLPGMNGPSSLPGFPQNSNTLTPPGAGMLGFPTSATSSPALSLSSAPTKPLLQTPPPPPPPPPPPPSSSLSGQQTEQQNKESEKKQTKPNKVKKIKEEELEATKPEKHPKKEEKISSALSVLGKVVGETHVDPIQLQALQNAIAGDPASFIGGQFLPYFIPGFASYFTPQLPGTVQGGYFPPVCGMESLFPYGPTMPQTLAGLSPGALLQQYQQYQQNLQESLQKQQKQQQEQQQKPVQAKTSKVESDQPQNSNDASETKEDKSTATESTKEEPQLESKSADFSDTYVVPFVKYEFICRKCQMMFTDEDAAVNHQKSFCYFGQPLIDPQETVLRVPVSKYQCLACDVAISGNEALSQHLQSSLHKEKTIKQAMRNAKEHVRLLPHSVCSPNPNTTSTSQSAASSNNTYPHLSCFSMKSWPNILFQASARRAASPPSSPPSLSLPSTVTSSLCSTSGVQTSLPTESCSDESDSELSQKLEDLDNSLEVKAKPASGLDGNFNSIRMDMFSV

SEQ ID NO: 70237 - protein, 155 aa, Homo sapiens
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAYIIEDSKESGQNAQTG

SEQ ID NO: 70238 - protein, 3590 aa, Homo sapiens
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAYIIEDSKESGQNAQTGANSKLFSTAMFLDSLASAGEKSDQSASAPMSFYPQIINTFHIASSLGKPFTADQAFPNTSALAGVGPVLHSFRVYDLRHKREKDYLTSDGSAKNSCVSKDVPNNVDLSKFDGCVSDGKRKPVLMCFLCKLSFGYIRSFVTHAVHDHRMTLNDEEQKLLSNKCVSAIIQGIGKDKEPLISFLEPKKSTSVYPHFSTTNLIGPDPTFRGLWSAFHVENGDSLPAGFAFLKGSASTSSSAEQPLGITQMPKAEVNLGGLSSLVVNTPITSVSLSHSSSESSKMSESKDQENNCERPKESNVLHPNGECPVKSEPTEPGDEDEEDAYSNELDDEEVLGELTDSIGNKDFPLLNQSISPLSSSVLKFIEKGTSSSSATVSDDTEKKKQTAAVRASGSVASNYGISGKDFADASASKDSATAAHPSEIARGDEDSSATPHQHGFTPSTPGTPGPGGDGSPGSGIECPKCDTVLGSSRSLGGHMTMMHSRNSCKTLKCPKCNWHYKYQQTLEAHMKEKHPEPGGSCVYCKTGQPHPRLARGESYTCGYKPFRCEVCNYSTTTKGNLSIHMQSDKHLNNVQNLQNGNGEQVFGHSAPAPNTSLSGCGTPSPSKPKQKPTWRCEVCDYETNVARNLRIHMTSEKHMHNMMLLQQNMKQIQHNLHLGLAPAEAELYQYYLAQNIGLTGMKLENPADPQLMINPFQLDPATAAALAPGLGELSPYISDPALKLFQCAVCNKFTSDSLEALSVHVSSERSLPEEEWRAVIGDIYQCKLCNYNTQLKANFQLHCKTDKHMQKYQLVAHIKEGGKSNEWRLKCIAIGNPVHLKCNACDYYTNSVDKLRLHTTNHRHEAALKLYKHLQKQEGAVNPESCYYYCAVCDYTTKVKLNLVQHVRSVKHQQTEGLRKLQLHQQGLAPEEDNLSEIFFVKDCPPNELETASLGARTCDDDLTEQQLRSTSEEQSEEAEGAIKPTAVAEDDEKDTSERDNSEGKNSNKDSGIITPEKELKVSVAGGTQPLLLAKEEDVATKRSKPTEDNKFCHEQFYQCPYCNYNSRDQSRIQMHVLSQHSVQPVICCPLCQDVLSNKMHLQLHLTHLHSVSPDCVEKLLMTVPVPDVMMPNSMLLPAAASEKSERDTPAAVTAEGSGKYSGESPMDDKSMAGLEDSKANVEVKNEEQKPTKEPLEVSEWNKNSSKDVKIPDTLQDQLNEQQKRQPLSVSDRHVYKYRCNHCSLAFKTMQKLQIHSQYHAIRAATMCNLCQRSFRTFQALKKHLEAGHPELSEAELQQLYASLPVNGELWAESETMSQDDHGLEQEMEREYEVDHEGKASPVGSDSSSIPDDMGSEPKRTLPFRKGPNFTMEKFLDPSRPYKCTVCKESFTQKNILLVHYNSVSHLHKLKKVLQEASSPVPQETNSNTDNKPYKCSICNVAYSQSSTLEIHMRSVLHQTKARAAKLEPSGHVAGGHSIAANVNSPGQGMLDSMSLAAVNSKDTHLDAKELNKKQTPDLISAQPAHHPPQSPAQIQMQLQHELQQQAAFFQPQFLNPAFLPHFPMTPEALLQFQQPQFLFPFYIPGTEFSLGPDLGLPGSATFGMPGMTGMAGSLLEDLKQQIQTQHHVGQTQLQILQQQAQQYQATQPQLQPQKQQQQPPPPQQQQQQQASKLLKQEQSNIVSADCQIMKDVPSYKEAEDISEKPEKPKQEFISEGEGLKEGKDTKKQKSLEPSIPPPRIASGARGNAAKALLENFGFELVIQYNENRQKVQKKGKSGEGENTDKLECGTCGKLFSNVLILKSHQEHVHGQFFPYAALEKFARQYREAYDKLYPISPSSPETPPPPPPPPPLPPAPPQPSSMGPVKIPNTVSTPLQAPPPTPPPPPPPPPPPPPPPPPPPPSAPPQVQLPVSLDLPLFPSIMMQPVQHPALPPQLALQLPQMDALSADLTQLCQQQLGLDPNFLRHSQFKRPRTRITDDQLKILRAYFDINNSPSEEQIQEMAEKSGLSQKVIKHWFRNTLFKERQRNKDSPYNFSNPPITVLEDIRIDPQPTSLEHYKSDASFSKRSSRTRFTDYQLRVLQDFFDTNAYPKDDEIEQLSTVLNLPTRVIVVWFQNARQKARKSYENQAETKDNEKRELTNERYIRTSNMQYQCKKCNVVFPRIFDLITHQKKQCYKDEDDDAQDESQTEDSMDATDQVVYKHCTVSGQTDAAKNAAAPAASSGSGTSTPLIPSPKPEPEKTSPKPEYPAEKPKQSDPSPPSQGTKPALPLASTSSDPPQASTAQPQPQPQPPKQPQLIGRPPSASQTPVPSSPLQISMTSLQNSLPPQLLQYQCDQCTVAFPTLELWQEHQHMHFLAAQNQFLHSPFLERPMDMPYMIFDPNNPLMTGQLLGSSLTQMPPQASSSHTTAPTTVAASLKRKLDDKEDNNCSEKEGGNSGEDQHRDKRLRTTITPEQLEILYEKYLLDSNPTRKMLDHIAREVGLKKRVVQVWFQNTRARERKGQFRAVGPAQSHKRCPFCRALFKAKSALESHIRSRHWNEGKQAGYSLPPSPLISTEDGGESPQKYIYFDYPSLPLTKIDLSSENELASTVSTPVSKTAELSPKNLLSPSSFKAECSEDVENLNAPPAEAGYDQNKTDFDETSSINTAISDATTGDEGNTEMESTTGSSGDVKPALSPKEPKTLDTLPKPATTPTTEVCDDKFLFSLTSPSIHFNDKDGDHDQSFYITDDPDDNADRSETSSIADPSSPNPFGSSNPFKSKSNDRPGHKRFRTQMSNLQLKVLKACFSDYRTPTMQECEMLGNEIGLPKRVVQVWFQNARAKEKKFKINIGKPFMINQGGTEGTKPECTLCGVKYSARLSIRDHIFSKQHISKVRETVGSQLDREKDYLAPTTVRQLMAQQELDRIKKASDVLGLTVQQPGMMDSSSLHGISLPTAYPGLPGLPPVLLPGMNGPSSLPGFPQNSNTLTPPGAGMLGFPTSATSSPALSLSSAPTKPLLQTPPPPPPPPPPPPSSSLSGQQTEQQNKESEKKQTKPNKVKKIKEEELEATKPEKHPKKEEKISSALSVLGKVVGETHVDPIQLQALQNAIAGDPASFIGGQFLPYFIPGFASYFTPQLPGTVQGGYFPPVCGMESLFPYGPTMPQTLAGLSPGALLQQYQQYQQNLQESLQKQQKQQQEQQQKPVQAKTSKVESDQPQNSNDASETKEDKSTATESTKEEPQLESKSADFSDTYVVPFVKYEFICRKCQMMFTDEDAAVNHQKSFCYFGQPLIDPQETVLRVPVSKYQCLACDVAISGNEALSQHLQSSLHKEKTIKQAMRNAKEHVRLLPHSVCSPNPNTTSTSQSAASSNNTYPHLSCFSMKSWPNILFQASARRAASPPSSPPSLSLPSTVTSSLCSTSGVQTSLPTESCSDESDSELSQKLEDLDNSLEVKAKPASGLDGNFNSIRMDMFSV

SEQ ID NO: 70239 - protein, 155 aa, Homo sapiens; identical to SEQ ID NO: 70237

SEQ ID NO: 70240 - protein, 3616 aa, Homo sapiens
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAYIIEDSKESGQNAQTGANSKLFSTAMFLDSLASAGEKSDQSASAPMSFYPQIINTFHIASSLGKPFTADQAFPNTSALAGVGPVLHSFRVYDLRHKREKDYLTSDGSAKNSCVSKDVPNNVDLSKFDGCVSDGKRKPVLMCFLCKLSFGYIRSFVTHAVHDHRMTLNDEEQKLLSNKCVSAIIQGIGKDKEPLISFLEPKKSTSVYPHFSTTNLIGPDPTFRGLWSAFHVENGDSLPAGFAFLKGSASTSSSAEQPLGITQMPKAEVNLGGLSSLVVNTPITSVSLSHSSSESSKMSESKDQENNCERPKESNVLHPNGECPVKSEPTEPGDEDEEDAYSNELDDEEVLGELTDSIGNKDFPLLNQSISPLSSSVLKFIEKGTSSSSATVSDDTEKKKQTAAVRASGSVASNYGISGKDFADASASKDSATAAHPSEIARGDEDSSATPHQHGFTPSTPGTPGPGGDGSPGSGIECPKCDTVLGSSRSLGGHMTMMHSRNSCKTLKCPKCNWHYKYQQTLEAHMKEKHPEPGGSCVYCKTGQPHPRLARGESYTCGYKPFRCEVCNYSTTTKGNLSIHMQSDKHLNNVQNLQNGNGEQVFGHSAPAPNTSLSGCGTPSPSKPKQKPTWRCEVCDYETNVARNLRIHMTSEKHMHNMMLLQQNMKQIQHNLHLGLAPAEAELYQYYLAQNIGLTGMKLENPADPQLMINPFQLDPATAAALAPGLVNNELPPEIRLASGQLMGDDLSLLTAGELSPYISDPALKLFQCAVCNKFTSDSLEALSVHVSSERSLPEEEWRAVIGDIYQCKLCNYNTQLKANFQLHCKTDKHMQKYQLVAHIKEGGKSNEWRLKCIAIGNPVHLKCNACDYYTNSVDKLRLHTTNHRHEAALKLYKHLQKQEGAVNPESCYYYCAVCDYTTKVKLNLVQHVRSVKHQQTEGLRKLQLHQQGLAPEEDNLSEIFFVKDCPPNELETASLGARTCDDDLTEQQLRSTSEEQSEEAEGAIKPTAVAEDDEKDTSERDNSEGKNSNKDSGIITPEKELKVSVAGGTQPLLLAKEEDVATKRSKPTEDNKFCHEQFYQCPYCNYNSRDQSRIQMHVLSQHSVQPVICCPLCQDVLSNKMHLQLHLTHLHSVSPDCVEKLLMTVPVPDVMMPNSMLLPAAASEKSERDTPAAVTAEGSGKYSGESPMDDKSMAGLEDSKANVEVKNEEQKPTKEPLEVSEWNKNSSKDVKIPDTLQDQLNEQQKRQPLSVSDRHVYKYRCNHCSLAFKTMQKLQIHSQYHAIRAATMCNLCQRSFRTFQALKKHLEAGHPELSEAELQQLYASLPVNGELWAESETMSQDDHGLEQEMEREYEVDHEGKASPVGSDSSSIPDDMGSEPKRTLPFRKGPNFTMEKFLDPSRPYKCTVCKESFTQKNILLVHYNSVSHLHKLKKVLQEASSPVPQETNSNTDNKPYKCSICNVAYSQSSTLEIHMRSVLHQTKARAAKLEPSGHVAGGHSIAANVNSPGQGMLDSMSLAAVNSKDTHLDAKELNKKQTPDLISAQPAHHPPQSPAQIQMQLQHELQQQAAFFQPQFLNPAFLPHFPMTPEALLQFQQPQFLFPFYIPGTEFSLGPDLGLPGSATFGMPGMTGMAGSLLEDLKQQIQTQHHVGQTQLQILQQQAQQYQATQPQLQPQKQQQQPPPPQQQQQQQASKLLKQEQSNIVSADCQIMKDVPSYKEAEDISEKPEKPKQEFISEGEGLKEGKDTKKQKSLEPSIPPPRIASGARGNAAKALLENFGFELVIQYNENRQKVQKKGKSGEGENTDKLECGTCGKLFSNVLILKSHQEHVHGQFFPYAALEKFARQYREAYDKLYPISPSSPETPPPPPPPPPLPPAPPQPSSMGPVKIPNTVSTPLQAPPPTPPPPPPPPPPPPPPPPPPPPSAPPQVQLPVSLDLPLFPSIMMQPVQHPALPPQLALQLPQMDALSADLTQLCQQQLGLDPNFLRHSQFKRPRTRITDDQLKILRAYFDINNSPSEEQIQEMAEKSGLSQKVIKHWFRNTLFKERQRNKDSPYNFSNPPITVLEDIRIDPQPTSLEHYKSDASFSKRSSRTRFTDYQLRVLQDFFDTNAYPKDDEIEQLSTVLNLPTRVIVVWFQNARQKARKSYENQAETKDNEKRELTNERYIRTSNMQYQCKKCNVVFPRIFDLITHQKKQCYKDEDDDAQDESQTEDSMDATDQVVYKHCTVSGQTDAAKNAAAPAASSGSGTSTPLIPSPKPEPEKTSPKPEYPAEKPKQSDPSPPSQGTKPALPLASTSSDPPQASTAQPQPQPQPPKQPQLIGRPPSASQTPVPSSPLQISMTSLQNSLPPQLLQYQCDQCTVAFPTLELWQEHQHMHFLAAQNQFLHSPFLERPMDMPYMIFDPNNPLMTGQLLGSSLTQMPPQASSSHTTAPTTVAASLKRKLDDKEDNNCSEKEGGNSGEDQHRDKRLRTTITPEQLEILYEKYLLDSNPTRKMLDHIAREVGLKKRVVQVWFQNTRARERKGQFRAVGPAQSHKRCPFCRALFKAKSALESHIRSRHWNEGKQAGYSLPPSPLISTEDGGESPQKYIYFDYPSLPLTKIDLSSENELASTVSTPVSKTAELSPKNLLSPSSFKAECSEDVENLNAPPAEAGYDQNKTDFDETSSINTAISDATTGDEGNTEMESTTGSSGDVKPALSPKEPKTLDTLPKPATTPTTEVCDDKFLFSLTSPSIHFNDKDGDHDQSFYITDDPDDNADRSETSSIADPSSPNPFGSSNPFKSKSNDRPGHKRFRTQMSNLQLKVLKACFSDYRTPTMQECEMLGNEIGLPKRVVQVWFQNARAKEKKFKINIGKPFMINQGGTEGTKPECTLCGVKYSARLSIRDHIFSKQHISKVRETVGSQLDREKDYLAPTTVRQLMAQQELDRIKKASDVLGLTVQQPGMMDSSSLHGISLPTAYPGLPGLPPVLLPGMNGPSSLPGFPQNSNTLTPPGAGMLGFPTSATSSPALSLSSAPTKPLLQTPPPPPPPPPPPPSSSLSGQQTEQQNKESEKKQTKPNKVKKIKEEELEATKPEKHPKKEEKISSALSVLGKVVGETHVDPIQLQALQNAIAGDPASFIGGQFLPYFIPGFASYFTPQLPGTVQGGYFPPVCGMESLFPYGPTMPQTLAGLSPGALLQQYQQYQQNLQESLQKQQKQQQEQQQKPVQAKTSKVESDQPQNSNDASETKEDKSTATESTKEEPQLESKSADFSDTYVVPFVKYEFICRKCQMMFTDEDAAVNHQKSFCYFGQPLIDPQETVLRVPVSKYQCLACDVAISGNEALSQHLQSSLHKEKTIKQAMRNAKEHVRLLPHSVCSPNPNTTSTSQSAASSNNTYPHLSCFSMKSWPNILFQASARRAASPPSSPPSLSLPSTVTSSLCSTSGVQTSLPTESCSDESDSELSQKLEDLDNSLEVKAKPASGLDGNFNSIRMDMFSV

SEQ ID NO: 70241 - protein, 140 aa, Homo sapiens
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAY

SEQ ID NO: 70242 - protein, 101 aa, Homo sapiens
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCP

SEQ ID NO: 70243 - protein, 750 aa, Homo sapiens
MEFVSGYRDEFLDFTALLFGWFRKFVAERGAVGTSLEGRCRQLEAQIRRLPQDPALWVLHVLPNHSVGISLGQGAEPGPGPGLGTAWLLGDNPPLHLRDLSPYISFVSLEDGEEGEEEEEEDEEEEKREDGGAGSTEKVEPEEDRELAPTSRESPQETNPPGESEEAAREAGGGKDGCREDRVENETRPQKRKGQRSEAAPLHVSCLLLVTDEHGTILGIDLLVDGAQGTASWGSGTKDLAPWAYALLCHSMACPMGSGDPRKPRQLTVGDARLHRELESLVPRLGVKLAKTPMRTWGPRPGFTFASLRARTCHVCHRHSFEAKLTPCPQCSAVLYCGEACLRADWQRCPDDVSHRFWCPRLAAFMERAGELATLPFTYTAEVTSETFNKEAFLASRGLTRGYWTQLSMLIPGPGFSRHPRGNTPSLSLLRGGDPYQLLQGDGTALMPPVPPHPPRGVFGSWQDYYTWRGLSLDSPIAVLLTYPLTVYYVITHLVPQSFPELNIQNKQSLKIHVVEAGKEFDLVMVFWELLVLLPHVALELQFVGDGLPPESDEQHFTLQRDSLEVSVRPGSGISARPSSGTKEKGGRRDLQIKVSARPYHLFQGPKPDLVIASPSSLSAGFNSGFALKDTWLRSLPRLQSLRVPAFFTESSEYSCVMDGQTMAVATGGGTSPPQPNPFRSPFRLRAADNCMSWYCNAFIFHLVYKPAQGSGARPAPGPPPPSPTPSAPPAPTRRRRGEKKPGRGARRRK

SEQ ID NO: 70244 - protein, 703 aa, Homo sapiens
MEFVSGYRDEFLDFTALLFGWFRKFVAERGAVGTSLEGRCRQLEAQIRRLPQDPALWVLHVLPNHSVGISLGQGAEPGPGPGLGTAWLLGDNPPLHLRDLSPYISFVSLEDGEEGEEEEEEDEEEEKREDGGAGSTEKVEPEEDRELAPTSRESPQETNPPGESEEAAREAGGGKDGCREDRVENETRPQKRKGQRSEAAPLHVSCLLLVTDEHGTILGIDLLVDGAQGTASWGSGTKDLAPWAYALLCHSMACPMGSGDPRKPRQLTVGDARLHRELESLVPRLGVKLAKTPMRTWGPRPGFTFASLRARTCHVCHRHSFEAKLTPCPQCSAVLYCGEACLRADWQRCPDDVSHRFWCPRLAAFMERAGELATLPFTYTAEVTSETFNKEAFLASRGLTRGYWTQLSMLIPGPGFSRHPRGNTPSLSLLRGGDPYQLLQGDGTALMPPVPPHPPRGVFVPELNIQNKQSLKIHVVEAGKEFDLVMVFWELLVLLPHVALELQFVGDGLPPESDEQHFTLQRDSLEVSVRPGSGISARPSSGTKEKGGRRDLQIKVSARPYHLFQGPKPDLVIGFNSGFALKDTWLRSLPRLQSLRVPAFFTESSEYSCVMDGQTMAVATGGGTSPPQPNPFRSPFRLRAADNCMSWYCNAFIFHLVYKPAQGSGARPAPGPPPPSPTPSAPPAPTRRRRGEKKPGRGARRRK

SEQ ID NO: 70245 - protein, 573 aa, Homo sapiens
MDAKSLTAWSRTLVTFKDVFVDFTREEWKLLDTAQQIVYRNVMLENYKNLVSLGYQLTKPDVILRLEKGEEPWLVEREIHQETHPDSETAFEIKSSVSSRSIFKDKQSCDIKMEGMARNDLWYLSLEEVWKCRDQLDKYQENPERHLRQVAFTQKKVLTQERVSESGKYGGNCLLPAQLVLREYFHKRDSHTKSLKHDLVLNGHQDSCASNSNECGQTFCQNIHLIQFARTHTGDKSYKCPDNDNSLTHGSSLGISKGIHREKPYECKECGKFFSWRSNLTRHQLIHTGEKPYECKECGKSFSRSSHLIGHQKTHTGEEPYECKECGKSFSWFSHLVTHQRTHTGDKLYTCNQCGKSFVHSSRLIRHQRTHTGEKPYECPECGKSFRQSTHLILHQRTHVRVRPYECNECGKSYSQRSHLVVHHRIHTGLKPFECKDCGKCFSRSSHLYSHQRTHTGEKPYECHDCGKSFSQSSALIVHQRIHTGEKPYECCQCGKAFIRKNDLIKHQRIHVGEETYKCNQCGIIFSQNSPFIVHQIAHTGEQFLTCNQCGTALVNTSNLIGYQTNHIRENAY

SEQ ID NO: 70246 - protein, 573 aa, Homo sapiens; identical to SEQ ID NO: 70245

SEQ ID NO: 70247 - protein, 72 aa, Homo sapiens
MDAKSLTAWSRTLVTFKDVFVDFTREEWKLLDTAQQIVYRNVMLENYKNLVSLGYQLTKPDVILRLEKGEEP

SEQ ID NO: 70248 - protein, 43 aa, Homo sapiens
MDAKSLTAWSRTLVTFKDVFVDFTREEWKLLDTAQQIVYRNVM

SEQ ID NO: 70249 - protein, 47 aa, Homo sapiens
MDAKSLTAWSRTLVTFKDVFVDFTREEWKLLDTAQQIVYRNVMLENY

SEQ ID NO: 70250 - protein, 542 aa, Homo sapiens
MDDPRYGMCPLKGASGCPGAERSLLVQSYFEKGPLTFRDVAIEFSLEEWQCLDSAQQGLYRKVMLENYRNLVFLAGIALTKPDLITCLEQGKEPWNIKRHEMVAKPPVICSHFPQDLWAEQDIKDSFQEAILKKYGKYGHDNLQLQKGCKSVDECKVHKEHDNKLNQCLITTQSNIFQCDPSAKVFHTFSNSNRHKIRHTRKKPFKCKKCEKSFCMLLHLTQHKRFHITENSYQCKDCGKAFNWFSTLTTHRRIHTGEKPYKCEECGKAFNRSSHLTTHKIIHTGEKPYRCEECGKAFNRSSHLTTHKRIHTGVKPYKCTECGKAFNRSSHLTTHRIIHTGEKPYKCEECGKAFNQSSTLTTHKITHAGEKPYKCEECGKAFYRFSYLTKHKTSHTGEKFYKCEECGKGFNWSSALTKHKRIHTGEKPYKCEECGKAFNESSNLTTHKMIHTGEKPYKCDECGKAFNRSSQLTAHKMIHTGEKPYKCEECGKAFNRSSTLTKHKITHTGEKSYKWEECGKDFNQSLSLIKQNNSYWRETLQM

SEQ ID NO: 70251 - protein, 436 aa, Homo sapiens
MDSVAFEDVAVNFTQEEWALLSPSQKNLYRDVTLETFRNLASVGIQWKDQDIENLYQNLGIKLRSLVERLCGRKEGNEHRETFSQIPDCHLNKKSQTGVKPCKCSVCGKVFLRHSFLDRHMRAHAGHKRSECGGEWRETPRKQKQHGKASISPSSGARRTVTPTRKRPYECKVCGKAFNSPNLFQIHQRTHTGKRSYKCREIVRAFTVSSFFRKHGKMHTGEKRYECKYCGKPIDYPSLFQIHVRTHTGEKPYKCKQCGKAFISAGYLRTHEIRSHALEKSHQCQECGKKLSCSSSLHRHERTHSGGKLYECQKCAKVFRCPTSLQAHERAHTGERPYECNKCGKTFNYPSCFRRHKKTHSGEKPYECTRCGKAFGWCSSLRRHEMTHTGEKPFDCKQCGKVFTFSNYLRLHERTHLAGRSQCFGRRQGDHLSPGV

SEQ ID NO: 70252 - protein, 436 aa, Homo sapiens; identical to SEQ ID NO: 70251

SEQ ID NO: 70253 - protein, 316 aa, Homo sapiens
MRAHAGHKRSECGGEWRETPRKQKQHGKASISPSSGARRTVTPTRKRPYECKVCGKAFNSPNLFQIHQRTHTGKRSYKCREIVRAFTVSSFFRKHGKMHTGEKRYECKYCGKPIDYPSLFQIHVRTHTGEKPYKCKQCGKAFISAGYLRTHEIRSHALEKSHQCQECGKKLSCSSSLHRHERTHSGGKLYECQKCAKVFRCPTSLQAHERAHTGERPYECNKCGKTFNYPSCFRRHKKTHSGEKPYECTRCGKAFGWCSSLRRHEMTHTGEKPFDCKQCGKVFTFSNYLRLHERTHLAGRSQCFGRRQGDHLSPGV

SEQ ID NO: 70254 - protein, 436 aa, Homo sapiens; identical to SEQ ID NO: 70251

SEQ ID NO: 70255 - protein, 783 aa, Homo sapiens
MVAKPPVMSFHFAQDLWPEQNIKDSFQKVTLRRYGKCEYENLQLRKGCKHVDECTGHKGGHNTVNQCLTATPSKIFQCNKYVKVFDKFSNSNRYKRRHTGNKHFKCKECSKSFCVLSQLTQHRRIHTRVNSYKCEECGKAFNWFSTLTKHKRIHTGEKPYKCEECGKAFNQSSQLTRHKIIHTEEKPNKCEECGKAFKQASHLTIHKIIHTGEKPYKYEECGKVFSQSSHLTTQKILHTGENLYKCKECGKAFNLFSNLTNHKRIHAGEKPYKCKECGRAFNISSNLNKQEKIHTGGKLNKCEECDKAFNRSLKLTAHKKILMEEKPYKCEECGKVFNQFSTLTRHKIIHTGEKPYKCKECGKAFNQSSNLTEHKKIHTAEKSYKCEECGKAFNQHSNLINHRKIYSGEKPYKCEECGKAFNRSSTLTRHKKIHTGEKPYKCEECDRAFSQSSNLTEHKKIHTGEKPYKCEECGKAFNRFSTLTKHKRIHTGEKPYKCEECGKAFNQSYQLTRHKIVHTKEKLNKCEEFGKAFKQSSHRTIHKIIHTGEKPYKCEEHGKVFNQSSNLTTQKIIHTGENLYKFEEHGKAFNLFSNITNHKIIYTGEKPHKCEECGKAYNRFSNLTIHKRIHTGEKPYQCAECGKAFNCSSTLNRHKIIHTGEKPYKCKECGKAFNLSSTLTAHKKIHTGEKPYKCEECGKAFNQSSNLTTHKKIHTSEKPYKCEECGKSFNQFSSLNIHKIIHTGEKPYKCGDYGRAFNLSSNLTTHKKIHTGEKPYKCEYGKT

SEQ ID NO: 70256 - protein, 91 aa, Homo sapiens
MVAKPPVMSFHFAQDLWPEQNIKDSFQKVTLRRYGKCEYENLQLRKGCKHVDECTGHKGGHNTVNQCLTATPSKIFQCNKYVKVFDKFSNS

SEQ ID NO: 70257 - protein, 783 aa, Homo sapiens; identical to SEQ ID NO: 70255

SEQ ID NO: 70258 - protein, 783 aa, Homo sapiens; identical to SEQ ID NO: 70255

SEQ ID NO: 70259 - protein, 150 aa, Homo sapiens
MVAKPPVMSFHFAQDLWPEQNIKDSFQKVTLRRYGKCEYENLQLRKGCKHVDECTGHKGGHNTVNQCLTATPSKIFQCNKYVKVFDKFSNSNRYKRRHTGNKHFKCKECSKSFCVLSQLTQHRRIHTRVNSYKCEECGKAIIICSDFTQH

SEQ ID NO: 70260 - protein, 417 aa, Homo sapiens
MSQDSVTFADVAVNFTKEEWTLLDPAQRNLYRDVMLENSRNLAFIDWATPCKTKDATPQPDILPKRTFPEANRVCLTSISSQHSTLREDWRCPKTEEPHRQGVNNVKPPAVAPEKDESPVSICEDHEMRNHSKPTCRLVPSQGDSIRQCILTRDSSIFKYNPVLNDSQKTHENNEDDGVLGWNIQWVPCGRKTELKSSTWTGSQNTVHHIRDEIDTGANRHQRNPFGKAFREDGSLRAHNTHGREKMYDFTQCENTSRNNSIHAMQMQLYTAETNKKDCQTGATSANAPNSGSHKSHCTGEKTHKCPECGRAFFYQSFLMRHMKIHTGEKPYECGKCGKAFRYSLHLNKHLRKHVVQKKPYECEECGKVIRESSKYTHIRSHTGEKPYKCKTCGKDFAKSSGLKKHLKTHKDEKPCE

SEQ ID NO: 70261 - protein, 417 aa, Homo sapiens; identical to SEQ ID NO: 70260

SEQ ID NO: 70262 - protein, 483 aa, Homo sapiens
MKRHEMVAKHLVMFYYFAQHLWPEQNIRDSFQKVTLRRYRKCGYENLQLRKGCKSVVECKQHKGDYSGLNQCLKTTLSKIFQCNKYVEVFHKISNSNRHKMRHTENKHFKCKECRKTFCMLSHLTQHKRIQTRVNFYKCEAYGRAFNWSSTLNKHKRIHTGEKPYKCKECGKAFNQTSHLIRHKRIHTEEKPYKCEECGKAFNQSSTLTTHNIIHTGEIPYKCEKCVRAFNQASKLTEHKLIHTGEKRYECEECGKAFNRSSKLTEHKYIHTGEKLYKCEECGKAFNQSSTLTTHKRIHSGEKPYKCEECGKAFKQFSNLTDHKKIHTGEKPYKCEECGKAFNQLSNLTRHKVIHTGEKPYKCGECGKAFNQSSALNTHKIIHTGENPHKCRESGKVFHLSSKLSTCKKIHTGEKLYKCEECGKAFNRSSTLIGHKRIHTGEKPYKCEECGKAFNQSSTLTTHKIIHTEEKQYKCDECGKAST

SEQ ID NO: 70263 - protein, 383 aa, Homo sapiens
MKRHEMVAKHLVMFYYFAQHLWPEQNIRDSFQKVTLRRYRKCGYENLQLRKGCKSVVECKQHKGDYSGLNQCLKTTLSKIFQCNKYVEVFHKISNSNRHKMRHTENKHFKCKECRKTFCMLSHLTQHKRIQTRVNFYKCEAYGRAFNWSSTLNKHKRIHTGEKPYKCKECGKAFNQTSHLIRHKRIHTEEKPYKCEECGKAFNQSSTLTTHNIIHTGEIPYKCEKCVRAFNQASKLTEHKLIHTGEKRYECEECGKAFNRSSKLTEHKYIHTGEKLYKCEECGKAFNQSSTLTTHKRIHSGEKPYKCEECGKAFKQFSNLTDHKKIHTGEKPYKCEECGKAFNQLSNLTRHKVIHTGEKPYKCGECGKANLSSTLTPHKTIHI

SEQ ID NO: 70264 - protein, 455 aa, Homo sapiens
MLENYSNLVSVGYHIIKPDVISKLEQGEEPWIVEGEFLLQSYPDEVWQTDDLIERIQEEENKPSRQTVFIETLIEERGNVPGKTFDVETNPVPSRKIAYKNSLCDSCEKCLTSVSEYISSDGSYARMKADECSGCGKSLLHIKLEKTHPGDQAYEFNQNGEPYTLNEESLYQKIRILEKPFEYIECQKAFQKDTVFVNHMEEKPYKWNGSEIAFLQMSDLTVHQTSHMEMKPYECSECGKSFCKKSKFIIHQRTHTGEKPYECNQCGKSFCQKGTLTVHQRTHTGEKPYECNECGKNFYQKLHLIQHQRTHSGEKPYECSYCGKSFCQKTHLTQHQRTHSGERPYVCHDCGPSRRSQHLMHQKIHTGVKLYKCSECGKCFCRKSTLTTHLRTHTGEKPYECNECGKFFSRLSYLTVHYRTHSGEKPYECNECGKTFYLNSALMRHQRVHTGEKPY

SEQ ID NO: 70265 - protein, 659 aa, Homo sapiens
MNKSLGPVSFKDVAVDFTQEEWQQLDPEQKITYRDVMLENYSNLVSVGYHIIKPDVISKLEQGEEPWIVEGEFLLQSYPDEVWQTDDLIERIQEEENKPSRQTVFIETLIEEREYISSDGSYARMKADECSGCGKSLLHIKLEKTHPGDQAYEFNQNGEPYTLNEESLYQKIRILEKPFEYIECQKAFQKDTVFVNHMEEKPYKWNGSEIAFLQMSDLTVHQTSHMEMKPYECSECGKSFCKKSKFIIHQRTHTGEKPYECNQCGKSFCQKGTLTVHQRTHTGEKPYECNECGKNFYQKLHLIQHQRTHSGEKPYECSYCGKSFCQKTHLTQHQRTHSGERPYVCHDCGKTFSQKSALNDHQKIHTGVKLYKCSECGKCFCRKSTLTTHLRTHTGEKPYECNECGKFFSRLSYLTVHYRTHSGEKPYECNECGKTFYLNSALMRHQRVHTGEKPYECNECGKLFSQLSYLTIHHRTHSGVKPYECSECGKTFYQNSALCRHRRIHKGEKPYECYICGKFFSQMSYLTIHHRIHSGEKPYECSECGKTFCQNSALNRHQRTHTGEKAYECYECGKCFSQMSYLTIHHRIHSGEKPFECNECGKAFSRMSYLTVHYRTHSGEKPYECTECGKKFYHKSAFNSHQRIHRRGNMNVIDVGRLL

SEQ ID NO: 70266 - protein, 755 aa, Homo sapiens
MRATALVRWTGRDLASRRAPATAIPPRPVGSGGAEAAEPQEDLPPLSQSSRFFQEQQKMNKSLGPVSFKDVAVDFTQEEWQQLDPEQKITYRDVMLENYSNLVSVGYHIIKPDVISKLEQGEEPWIVEGEFLLQSYPDEVWQTDDLIERIQEEENKPSRQTVFIETLIEERGNVPGKTFDVETNPVPSRKIAYKNSLCDSCEKCLTSVSEYISSDGSYARMKADECSGCGKSLLHIKLEKTHPGDQAYEFNQNGEPYTLNEESLYQKIRILEKPFEYIECQKAFQKDTVFVNHMEEKPYKWNGSEIAFLQMSDLTVHQTSHMEMKPYECSECGKSFCKKSKFIIHQRTHTGEKPYECNQCGKSFCQKGTLTVHQRTHTGEKPYECNECGKNFYQKLHLIQHQRTHSGEKPYECSYCGKSFCQKTHLTQHQRTHSGERPYVCHDCGKTFSQKSALNDHQKIHTGVKLYKCSECGKCFCRKSTLTTHLRTHTGEKPYECNECGKFFSRLSYLTVHYRTHSGEKPYECNECGKTFYLNSALMRHQRVHTGEKPYECNECGKLFSQLSYLTIHHRTHSGVKPYECSECGKTFYQNSALCRHRRIHKGEKPYECYICGKFFSQMSYLTIHHRIHSGEKPYECSECGKTFCQNSALNRHQRTHTGEKAYECYECGKCFSQMSYLTIHHRIHSGEKPFECNECGKAFSRMSYLTVHYRTHSGEKPYECTECGKKFYHKSAFNSHQRIHRRGNMNVIDVGRLL

SEQ ID NO: 70267 - protein, 697 aa, Homo sapiens
MNKSLGPVSFKDVAVDFTQEEWQQLDPEQKITYRDVMLENYSNLVSVGYHIIKPDVISKLEQGEEPWIVEGEFLLQSYPDEVWQTDDLIERIQEEENKPSRQTVFIETLIEERGNVPGKTFDVETNPVPSRKIAYKNSLCDSCEKCLTSVSEYISSDGSYARMKADECSGCGKSLLHIKLEKTHPGDQAYEFNQNGEPYTLNEESLYQKIRILEKPFEYIECQKAFQKDTVFVNHMEEKPYKWNGSEIAFLQMSDLTVHQTSHMEMKPYECSECGKSFCKKSKFIIHQRTHTGEKPYECNQCGKSFCQKGTLTVHQRTHTGEKPYECNECGKNFYQKLHLIQHQRTHSGEKPYECSYCGKSFCQKTHLTQHQRTHSGERPYVCHDCGKTFSQKSALNDHQKIHTGVKLYKCSECGKCFCRKSTLTTHLRTHTGEKPYECNECGKFFSRLSYLTVHYRTHSGEKPYECNECGKTFYLNSALMRHQRVHTGEKPYECNECGKLFSQLSYLTIHHRTHSGVKPYECSECGKTFYQNSALCRHRRIHKGEKPYECYICGKFFSQMSYLTIHHRIHSGEKPYECSECGKTFCQNSALNRHQRTHTGEKAYECYECGKCFSQMSYLTIHHRIHSGEKPFECNECGKAFSRMSYLTVHYRTHSGEKPYECTECGKKFYHKSAFNSHQRIHRRGNMNVIDVGRLL

SEQ ID NO: 70268 - protein, 390 aa, Homo sapiens
MAEIHNGGELCDFMENGEIFSEHSCLNAHMGTENTGDTYDCDEYGENFPMLHNSAPAGETLSVLNQCRKAFSLPPNVHQRTWIGDKSFEYSDCEEAFVDQSHLQANRITHNGETLYEQKQCGRAFTYSTSHAVSVKMHTVEKPYECKECGKFFRYSSYLNSHMRTHTGEKPYECKECGKCFTVSSHLVEHVRIHTGEKPYQCKECGRAFAGRSGLTKHVRIHTGEKPYECNECGKAYNRFYLLTEHFKTHTEEKPFECKVCGKSFRSSSCLKNHFRIHTGIKPYKCKECGKAFTVSSSLHNHVKIHTGEKPYECKDCGKAFATSSQLIEHIRTHTGEKPYICKECGKTFRASSHLQKHVRIHTGEKPYICNECGKAYNRFYLLTKHLKTH

SEQ ID NO: 70269 - protein, 343 aa, Homo sapiens
MAEIHNGGELCDFMENGEIFSEHSCLNAHMGTENTGDTYDCDEYGENFPMLHNSAPAGETLSVLNQCRKAFSLPPNVHQRTWIGDKSFEYSDCEEAFVDQSHLQANRITHNGETLYEQKQCGRAFTYSTSHAVSVKMHTVEKPYECKECGKFFRYSSYLNSHMRTHTGEKPYECKECGKCFTVSSHLVEHVRIHTGEKPYQCKECGRAFAGRSGLTKHVRIHTGEKPYECNECGKAYNRFYLLTEHFKTHTEEKPFECKVCGKSFRSSSCLKNHFRIHTGIKPYKCKECGKAFTVSSSLHNHVKIHTGEKPYECKDCGKAFATSSQLIEHIRTHTCNPSTLRG

SEQ ID NO: 70270 - protein, 289 aa, Homo sapiens
MSGHPGSWEMNSVAFEDVAVNFTQEEWALLDPSQKNLYRDVMQETFRNLASIGNKGEDQSIEDQYKNSSRNLSSFQIHQRNHTGEKPYECMECGKALGFSRSLNRHKRIHTGEKRYECKQCGKAFSRSSHLRDHERTHTGEKPYECKHCGKAFRYSNCLHYHERTHTGEKPYVCMECGKAFSCLSSLQGHIKAHAGEEPYPCKQCGKAFRYASSLQKHEKTHIAQKPYVCNNCGKGFRCSSSLRDHERTHTGEKPYECQKCGKAFSRASTLWKHKKTHTGEKPYKCKKM

SEQ ID NO: 70271 - protein, 312 aa, Homo sapiens [sequence omitted]

SEQ ID NO: 70272 - protein, 155 aa, Homo sapiens
MNALCVKNSSYHSSLHRHIISHSGNNPYGCEECGKKPCTCKQCQKTSLSVTRVHRDTVMHTGNGHYGCTICEKVFNIPSSFQIHQRNHTGEKPYECMECGKALGFSRSLNRHKRIHTGEKRYECKKCGKAFSRASTLWKHKKTHTGEKPYKCKKM

SEQ ID NO: 70273 - protein, 295 aa, Homo sapiens
MNALCVKNSSYHSSLHRHIISHSGNNPYGCEECGKKPCTCKQCQKTSLSVTRVHRDTVMHTGNGHYGCTICEKVFNIPSSFQIHQRNHTGEKPYECMECGKALGFSRSLNRHKRIHTGEKRYECKQCGKAFSRSSHLRDHERTHTGEKPYECKHCGKAFRYSNCLHYHERTHTGEKPYVCMECGKAFSCLSSLQGHIKAHAGEEPYPCKQCGKAFRYASSLQKHEKTHIAQKPYVCNNCGKGFRCSSSLRDHERTHTGEKPYECQKCGKAFSRASTLWKHKKTHTGEKPYKCKKM

SEQ ID NO: 70274 - protein, 73 aa, Homo sapiens
MSGHPGSWEMNSVAFEDVAVNFTQEEWALLDPSQKNLYRDVMQETFRNLASIGNKGEDQSIEDQYKNSSRNLR

SEQ ID NO: 70275 - protein, 589 aa, Homo sapiens
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQEHMKSHSTESFKCEICNKRYLRESAWKQHLNCYHLEEGGVSKKQRTGKKIHVCQYCEKQFDHFGHFKEHLRKHTGEKPFECPNCHERFARNSTLKCHLTACQTGVGAKKGRKKLYECQVCNSVFNSWDQFKDHLVIHTGDKPNHCTLCDLWFMQGNELRRHLSDAHNISERLVTEEVLSVETRVQTEPVTSMTIIEQVGKVHVLPLLQVQVDSAQVTVEQVHPDLLQDSQVHDSHMSELPEQVQVSYLEVGRIQTEEGTEVHVEELHVERVNQMPVEVQTELLEADLDHVTPEIMNQEERESSQADAAEAAREDHEDAEDLETKPTVDSEAEKAENEDRTALPVLE

SEQ ID NO: 70276 - protein, 623 aa, Homo sapiens
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQVEGIEIVELQLSHVKDLFHCEKCNRSFKLFYHFKEHMKSHSTESFKCEICNKRYLRESAWKQHLNCYHLEEGGVSKKQRTGKKIHVCQYCEKQFDHFGHFKEHLRKHTGEKPFECPNCHERFARNSTLKCHLTACQTGVGAKKGRKKLYECQVCNSVFNSWDQFKDHLVIHTGDKPNHCTLCDLWFMQGNELRRHLSDAHNISERLVTEEVLSVETRVQTEPVTSMTIIEQVGKVHVLPLLQVQVDSAQVTVEQVHPDLLQDSQVHDSHMSELPEQVQVSYLEVGRIQTEEGTEVHVEELHVERVNQMPVEVQTELLEADLDHVTPEIMNQEERESSQADAAEAAREDHEDAEDLETKPTVDSEAEKAENEDRTALPVLE

SEQ ID NO: 70277 - protein, 589 aa, Homo sapiens; identical to SEQ ID NO: 70275

SEQ ID NO: 70278 - protein, 151 aa, Homo sapiens
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETS

SEQ ID NO: 70279 - protein, 623 aa, Homo sapiens; identical to SEQ ID NO: 70276

SEQ ID NO: 70280 - protein, 139 aa, Homo sapiens
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGK

SEQ ID NO: 70281 - protein, 589 aa, Homo sapiens; identical to SEQ ID NO: 70275

SEQ ID NO: 70282 - protein, 265 aa, Homo sapiens
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQEHMKSHSTESFKCEICNKRYLR

SEQ ID NO: 70283 - protein, 706 aa, Homo sapiens
MALPSPQVLMGLPALLMGPAQHTSWPCGSAVPTLKSMVTFEDVAVYFSQEEWELLDAAQRHLYHSVMLENLELVTSLGSWHGVEGEGAHPKQNVSVEVLQVRIPNADPSTKKANSCDMCGPFLKDILHLAEHQGTQSEEKPYTCGACGRDFWLNANLHQHQKEHSGGKPFRWYKDRDALMKSSKVHLSENPFTCREGGKVILGSCDLLQLQAVDSGQKPYSNLGQLPEVCTTQKLFECSNCGKAFLKSSTLPNHLRTHSEEIPFTCPTGGNFLEEKSILGNKKFHTGEIPHVCKECGKAFSHSSKLRKHQKFHTEVKYYECIACGKTFNHKLTFVHHQRIHSGERPYECDECGKAFSNRSHLIRHEKVHTGERPFECLKCGRAFSQSSNFLRHQKVHTQVRPYECSQCGKSFSRSSALIQHWRVHTGERPYECSECGRAFNNNSNLAQHQKVHTGERPFECSECGRDFSQSSHLLRHQKVHTGERPFECCDCGKAFSNSSTLIQHQKVHTGQRPYECSECRKSFSRSSSLIQHWRIHTGEKPYECSECGKAFAHSSTLIEHWRVHTKERPYECNECGKFFSQNSILIKHQKVHTGEKPYKCSECGKFFSRKSSLICHWRVHTGERPYECSECGRAFSSNSHLVRHQRVHTQERPYECIQCGKAFSERSTLVRHQKVHTRERTYECSQCGKLFSHLCNLAQHKKIHT

SEQ ID NO: 70284 - protein, 396 aa, Homo sapiens
PTLKSMVTFEDVAVYFSQEEWELLDAAQRHLYHSVMLENLELVTSLGNALSQHVCLFPIESSVHPKARSWVLLPSRVSCCRCWGAEVLLGVEGEGAHPKQNVSVEVLQHQKEHSGGKPFRWYKDSSGQKPYSNLGQLPEVCTTQKLFECSNCGKAFLKSSTLPNHLRTHSEEIPFTCPTGGNFLEEKSILGNKKFHTGEIPHVCKECGKAFSHSSKLRKHQKFHTEVRPYECSQCGKSFSRSSALIQHWRIHTGEKPYECSECGKAFAHSSTLIEHWRVHTKERPYECNECGKFFSQNSILIKHQKVHTGEKPYKCSECGKFFSRKSSLICHWRVHTGERPYECSECGRAFSSNSHLVRHQRVHTQERPYECIQCGKAFSERSTLVRHQKVHTRER

SEQ ID NO: 70285 - protein, 654 aa, Homo sapiens
MAFRDVAVDFTQDEWRLLSPAQRTLYREVMLENYSNLVSLGISFSKPELITQLEQGKETWREEKKCSPATCPADPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQSGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 70286 - protein, 99 aa, Homo sapiens
MAFRDVAVDFTQDEWRLLSPAQRTLYREVMLENYSNLVSLGISFSKPELITQLEQGKETWREEKKCSPATCPDHQEYGNNCDLQKEADPEPELYLDPFC

SEQ ID NO: 70287 - protein, 653 aa, Homo sapiens
MAFRDVAVDFTQDEWRLLSPAQRTLYREVMLENYSNLVSLGISFSKPELITQLEQGKETWREEKKCSPATCPDPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQSGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 70288 - protein, 657 aa, Homo sapiens
MAHMAFRDVAVDFTQDEWRLLSPAQRTLYREVMLENYSNLVSLGISFSKPELITQLEQGKETWREEKKCSPATCPADPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQSGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 70289 - protein, 654 aa, Homo sapiens; identical to SEQ ID NO: 70285

SEQ ID NO: 70290 - protein, 591 aa, Homo sapiens
MCNGRKTVLADPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQSGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 70291 - protein, 179 aa, Homo sapiens
MAFRDVAVDFTQDEWRLLSPAQRTLYREVMLENYSNLVSLGISFSKPELITQLEQGKETWREEKKCSPATCPADPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRN

SEQ ID NO: 70292 - protein, 143 aa, Homo sapiens
MAFRDVAVDFTQDEWRLLSPAQRTLYREVMLENYSNLVSLGISFSKPELITQLEQGKETWREEKKCSPATCPADPEPELYLDPFCPPGFSSQKFPMQHVLCNHPPWIFTCLCAEGNIQPGDPGPGDQEKQQQASEGRPWSDQA

SEQ ID NO: 70293 - protein, 559 aa, Homo sapiens
MQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQSGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 70294 - protein, 559 aa, Homo sapiens; identical to SEQ ID NO: 70293

SEQ ID NO: 70295 - protein, 427 aa, Homo sapiens
MTLVTAGGAWTGPGCWHEVKDEESSSEQSISIAVSHVNTSKAGLPAQTALPCDICGPILKDILHLDEHQGTHHGLKLHTCGACGRQFWFSANLHQYQKCYSIEQPLRRDKSEASIVKNCTVSKEPHPSEKPFTCKEEQKNFQATLGGCQQKAIHSKRKTHRSTESGDAFHGEQMHYKCSECGKAFSRKDTLVQHQRIHSGEKPYECSECGKAFSRKATLVQHQRIHTGERPYECSECGKTFSRKDNLTQHKRIHTGEMPYKCNECGKYFSHHSNLIVHQRVHNGARPYKCSDCGKVFRHKSTLVQHESIHTGENPYDCSDCGKSFGHKYTLIKHQRIHTESKPFECIECGKFFSRSSDYIAHQRVHTGERPFVCSKCGKDFIRTSHLVRHQRVHTGERPYECSECGKAYSLSSHLNRHQKVHTAGRL

SEQ ID NO: 70296 - protein, 494 aa, Homo sapiens
LRWNHRSRSSGLLGGSEVTEAGGCGRSRCSLCGVARQRRPRLRPRGRTTAVPGSRDLGPPRGSGWSTNCDGGGRGDGPGAGCWHEVKDEESSSEQSISIAVSHVNTSKAGLPAQTALPCDICGPILKDILHLDEHQGTHHGLKLHTCGACGRQFWFSANLHQYQKCYSIEQPLRRDKSEASIVKNCTVSKEPHPSEKPFTCKEEQKNFQATLGGCQQKAIHSKRKTHRSTESGDAFHGEQMHYKCSECGKAFSRKDTLVQHQRIHSGEKPYECSECGKAFSRKATLVQHQRIHTGERPYECSECGKTFSRKDNLTQHKRIHTGEMPYKCNECGKYFSHHSNLIVHQRVHNGARPYKCSDCGKVFRHKSTLVQHESIHTGENPYDCSDCGKSFGHKYTLIKHQRIHTESKPFECIECGKFFSRSSDYIAHQRVHTGERPFVCSKCGKDFIRTSHLVRHQRVHTGERPYECSECGKAYSLSSHLNRHQKVHTAGRL

SEQ ID NO: 70297 - protein, 347 aa, Homo sapiens
MWGMWETILVQCLHQYQKCYSIEQPLRRDKSEASIVKNCTVSKEPHPSEKPFTCKEEQKNFQATLGGCQQKAIHSKRKTHRSTESGDAFHGEQMHYKCSECGKAFSRKDTLVQHQRIHSGEKPYECSECGKAFSRKATLVQHQRIHTGERPYECSECGKTFSRKDNLTQHKRIHTGEMPYKCNECGKYFSHHSNLIVHQRVHNGARPYKCSDCGKVFRHKSTLVQHESIHTGENPYDCSDCGKSFGHKYTLIKHQRIHTESKPFECIECGKFFSRSSDYIAHQRVHTGERPFVCSKCGKDFIRTSHLVRHQRVHTGERPYECSECGKAYSLSSHLNRHQKVHTAGRL

SEQ ID NO: 70298 - protein, 658 aa, Homo sapiens
MTPGVRVSTDPEQVTFEDVVVGFSQEEWGQLKPAQRTLYRDVMLDTFRLLVSVGHWLPKPNVISLLEQEAELWAVESRLPQGVYPDLETRPKVKLSVLKQGISEEISNSVILVERFLWDGLWYCRGEDTEGHWEWSCESLESLAVPVAFTPVKTPVLEQWQRNGFGENISLNPDLPHQPMTPERQSPHTWGTRGKREKPDLNVLQKTCVKEKPYKCQECGKAFSHSSALIEHHRTHTGERPYECHECLKGFRNSSALTKHQRIHTGEKPYKCTQCGRTFNQIAPLIQHQRTHTGEKPYECSECGKSFSFRSSFSQHERTHTGEKPYECSECGKAFRQSIHLTQHLRIHTGEKPYQCGECGKAFSHSSSLTKHQRIHTGEKPYECHECGKAFTQITPLIQHQRTHTGEKPYECGECGKAFSQSTLLTEHRRIHTGEKPYGCNECGKTFSHSSSLSQHERTHTGEKPYECSQCGKAFRQSTHLTQHQRIHTGEKPYECNDCGKAFSHSSSLTKHQRIHTGEKPYECNQCGRAFSQLAPLIQHQRIHTGEKPYECNQCGRAFSQSSLLIEHQRIHTKEKPYGCNECGKSFSHSSSLSQHERTHTGEKPYECHDCGKSFRQSTHLTQHRRIHTGEKPYACRDCGKAFTHSSSLTKHQRTHTG

SEQ ID NO: 70299 - protein, 390 aa, Homo sapiens
MELGSRRRSVGCRCRGLCLAVRREQVTFEDVVVGFSQEEWGQLKPAQRTLYRDVMLDTFRLLVSVGHWLPKPNVISLLEQEAELWAVESRLPQGVYPDLETRPKVKLSVLKQGISEEISNSVILVERFLWDGLWYCRGEDTEGHWEWSCESLESLAVPVAFTPVKTPVLEQWQRNGFGENISLNPDLPHQPMTPERQSPHTWGTRGKREKPDLNVLQKTCVKEKPYKCQECGKAFSHSSALIEHHRTHTGERPYECHECLKGFRNSSALTKHQRIHTGEKPYKCTQCGRTFNQIAPLIQHQRTHTGEKPYECSECGKSFSFRSSFSQHERTHTGEKPYECSECGKAFRQSIHLTQHLRIHTGEKPYQCGECGKAFTHSSSLTKHQRTHTG

SEQ ID NO: 70300 - protein, 682 aa, Homo sapiens
MELGSRRRSVGCRCRGLCLAVRREQVTFEDVVVGFSQEEWGQLKPAQRTLYRDVMLDTFRLLVSVGHWLPKPNVISLLEQEAELWAVESRLPQGVYPEIKGHFQFLLLSDLETRPKVKLSVLKQGISEEISNSVILVERFLWDGLWYCRGEDTEGHWEWSCESLESLAVPVAFTPVKTPVLEQWQRNGFGENISLNPDLPHQPMTPERQSPHTWGTRGKREKPDLNVLQKTCVKEKPYKCQECGKAFSHSSALIEHHRTHTGERPYECHECLKGFRNSSALTKHQRIHTGEKPYKCTQCGRTFNQIAPLIQHQRTHTGEKPYECSECGKSFSFRSSFSQHERTHTGEKPYECSECGKAFRQSIHLTQHLRIHTGEKPYQCGECGKAFSHSSSLTKHQRIHTGEKPYECHECGKAFTQITPLIQHQRTHTGEKPYECGECGKAFSQSTLLTEHRRIHTGEKPYGCNECGKTFSHSSSLSQHERTHTGEKPYECSQCGKAFRQSTHLTQHQRIHTGEKPYECNDCGKAFSHSSSLTKHQRIHTGEKPYECNQCGRAFSQLAPLIQHQRIHTGEKPYECNQCGRAFSQSSLLIEHQRIHTKEKPYGCNECGKSFSHSSSLSQHERTHTGEKPYECHDCGKSFRQSTHLTQHRRIHTGEKPYACRDCGKAFTHSSSLTKHQRTHTG

SEQ ID NO: 70301 - protein, 658 aa, Homo sapiens; identical to SEQ ID NO: 70298

SEQ ID NO: 70302 - protein, 616 aa, Homo sapiens
MLDTFRLLVSVGHWLPKPNVISLLEQEAELWAVESRLPQGVYPDLETRPKVKLSVLKQGISEEISNSVILVERFLWDGLWYCRGEDTEGHWEWSCESLESLAVPVAFTPVKTPVLEQWQRNGFGENISLNPDLPHQPMTPERQSPHTWGTRGKREKPDLNVLQKTCVKEKPYKCQECGKAFSHSSALIEHHRTHTGERPYECHECLKGFRNSSALTKHQRIHTGEKPYKCTQCGRTFNQIAPLIQHQRTHTGEKPYECSECGKSFSFRSSFSQHERTHTGEKPYECSECGKAFRQSIHLTQHLRIHTGEKPYQCGECGKAFSHSSSLTKHQRIHTGEKPYECHECGKAFTQITPLIQHQRTHTGEKPYECGECGKAFSQSTLLTEHRRIHTGEKPYGCNECGKTFSHSSSLSQHERTHTGEKPYECSQCGKAFRQSTHLTQHQRIHTGEKPYECNDCGKAFSHSSSLTKHQRIHTGEKPYECNQCGRAFSQLAPLIQHQRIHTGEKPYECNQCGRAFSQSSLLIEHQRIHTKEKPYGCNECGKSFSHSSSLSQHERTHTGEKPYECHDCGKSFRQSTHLTQHRRIHTGEKPYACRDCGKAFTHSSSLTKHQRTHTG

SEQ ID NO: 70303 - protein, 670 aa, Homo sapiens
MTPGVRVSTDPEQVTFEDVVVGFSQEEWGQLKPAQRTLYRDVMLDTFRLLVSVGHWLPKPNVISLLEQEAELWAVESRLPQGVYPEIKGHFQFLLLSDLETRPKVKLSVLKQGISEEISNSVILVERFLWDGLWYCRGEDTEGHWEWSCESLESLAVPVAFTPVKTPVLEQWQRNGFGENISLNPDLPHQPMTPERQSPHTWGTRGKREKPDLNVLQKTCVKEKPYKCQECGKAFSHSSALIEHHRTHTGERPYECHECLKGFRNSSALTKHQRIHTGEKPYKCTQCGRTFNQIAPLIQHQRTHTGEKPYECSECGKSFSFRSSFSQHERTHTGEKPYECSECGKAFRQSIHLTQHLRIHTGEKPYQCGECGKAFSHSSSLTKHQRIHTGEKPYECHECGKAFTQITPLIQHQRTHTGEKPYECGECGKAFSQSTLLTEHRRIHTGEKPYGCNECGKTFSHSSSLSQHERTHTGEKPYECSQCGKAFRQSTHLTQHQRIHTGEKPYECNDCGKAFSHSSSLTKHQRIHTGEKPYECNQCGRAFSQLAPLIQHQRIHTGEKPYECNQCGRAFSQSSLLIEHQRIHTKEKPYGCNECGKSFSHSSSLSQHERTHTGEKPYECHDCGKSFRQSTHLTQHRRIHTGEKPYACRDCGKAFTHSSSLTKHQRTHTG

SEQ ID NO: 70304 - protein, 676 aa, Homo sapiens
  MOD_RES (1)..(1): Any amino acid
XRSVGCRCRGLCLAVRREQVTFEDVVVGFSQEEWGQLKPAQRTLYRDVMLDTFRLLVSVGHWLPKPNVISLLEQEAELWAVESRLPQGVYPEIKGHFQFLLLSDLETRPKVKLSVLKQGISEEISNSVILVERFLWDGLWYCRGEDTEGHWEWSCESLESLAVPVAFTPVKTPVLEQWQRNGFGENISLNPDLPHQPMTPERQSPHTWGTRGKREKPDLNVLQKTCVKEKPYKCQECGKAFSHSSALIEHHRTHTGERPYECHECLKGFRNSSALTKHQRIHTGEKPYKCTQCGRTFNQIAPLIQHQRTHTGEKPYECSECGKSFSFRSSFSQHERTHTGEKPYECSECGKAFRQSIHLTQHLRIHTGEKPYQCGECGKAFSHSSSLTKHQRIHTGEKPYECHECGKAFTQITPLIQHQRTHTGEKPYECGECGKAFSQSTLLTEHRRIHTGEKPYGCNECGKTFSHSSSLSQHERTHTGEKPYECSQCGKAFRQSTHLTQHQRIHTGEKPYECNDCGKAFSHSSSLTKHQRIHTGEKPYECNQCGRAFSQLAPLIQHQRIHTGEKPYECNQCGRAFSQSSLLIEHQRIHTKEKPYGCNECGKSFSHSSSLSQHERTHTGEKPYECHDCGKSFRQSTHLTQHRRIHTGEKPYACRDCGKAFTHSSSLTKHQRTHTG

SEQ ID NO: 70305 - protein, 540 aa, Homo sapiens
MDSVAFEDVDVNFTQEEWALLDPSQKNLYRDVMWETMRNLASIGKKWKDQNIKDHYKHRGRNLRSHMLERLYQTKDGSQRGGIFSQFANQNLSKKIPGVKLCESIVYGEVSMGQSSLNRHIKDHSGHEPKEYQEYGEKPDTRNQCWKPFSSHHSFRTHEIIHTGEKLYDCKECGKTFFSLKRIRRHIITHSGYTPYKCKVCGKAFDYPSRFRTHERSHTGEKPYECQECGKAFTCITSVRRHMIKHTGDGPYKCKVCGKPFHSLSSFQVHERIHTGEKPFKCKQCGKAFSCSPTLRIHERTHTGEKPYECKQCGKAFSYLPSLRLHERIHTGEKPFVCKQCGKAFRSASTFQIHERTHTGEKPYECKECGEAFSCIPSMRRHMIKHTGEGPYKCKVCGKPFHSLSPFRIHERTHTGEKPYVCKHCGKAFVSSTSIRIHERTHTGEKPYECKQCGKAFSYLNSFRTHEMIHTGEKPFECKRCGKAFRSSSSFRLHERTHTGQKPYHCKECGKAYSCRASFQRHMLTHAEDGPPYKCMWESL

SEQ ID NO: 70306 - protein, 474 aa, Homo sapiens
MLERLYQTKDGSQRGGIFSQFANQNLSKKIPGVKLCESIVYGEVSMGQSSLNRHIKDHSGHEPKEYQEYGEKPDTRNQCWKPFSSHHSFRTHEIIHTGEKLYDCKECGKTFFSLKRIRRHIITHSGYTPYKCKVCGKAFDYPSRFRTHERSHTGEKPYECQECGKAFTCITSVRRHMIKHTGDGPYKCKVCGKPFHSLSSFQVHERIHTGEKPFKCKQCGKAFSCSPTLRIHERTHTGEKPYECKQCGKAFSYLPSLRLHERIHTGEKPFVCKQCGKAFRSASTFQIHERTHTGEKPYECKECGEAFSCIPSMRRHMIKHTGEGPYKCKVCGKPFHSLSPFRIHERTHTGEKPYVCKHCGKAFVSSTSIRIHERTHTGEKPYECKQCGKAFSYLNSFRTHEMIHTGEKPFECKRCGKAFRSSSSFRLHERTHTGQKPYHCKECGKAYSCRASFQRHMLTHAEDGPPYKCMWESL

SEQ ID NO: 70307 - protein, 319 aa, Homo sapiens
MGPLTFMDVAIEFSLEEWQCLDTAQRNVYRHVMLENYRNLVFLDLITCLEQGKEPWNMKRHEMVVAKHSALCSRFAQDLWLEQNIKDSFQKVTLSRYGKYGHKNLQLRKGCKSVDECKGHQGGFNGLNQCLKITTSKIFQCNKYVKVMHKFSNSNRHKIRHTENKHFRCKECDKSLCMLSRLTQHKKIHTRENFYKCEECGKTFNWSTNLSKPKKIHTGEKPYKCEVCGKAFHQSSILTKHKIIRTGEKPYKCAHCGKAFKQSSHLTRHKIIHTEEKPYKCEQCGKVFKQSPTLTKHQIIYTGEEPYKCEECGKAFNLS

SEQ ID NO: 70308 - protein, 262 aa, Homo sapiens
MKRHEMVVAKHSALCSRFAQDLWLEQNIKDSFQKVTLSRYGKYGHKNLQLRKGCKSVDECKGHQGGFNGLNQCLKITTSKIFQCNKYVKVMHKFSNSNRHKIRHTENKHFRCKECDKSLCMLSRLTQHKKIHTRENFYKCEECGKTFNWSTNLSKPKKIHTGEKPYKCEVCGKAFHQSSILTKHKIIRTGEKPYKCAHCGKAFKQSSHLTRHKIIHTEEKPYKCEQCGKVFKQSPTLTKHQIIYTGEEPYKCEECGKAFNLS

SEQ ID NO: 70309 - protein, 262 aa, Homo sapiens; identical to SEQ ID NO: 70308

SEQ ID NO: 70310 - protein, 287 aa, Homo sapiens
MDVAIEFSLEEWQCLDTAQRNVYRHVMLENYRNLVFLALCSRFAQDLWLEQNIKDSFQKVTLSRYGKYGHKNLQLRKGCKSVDECKGHQGGFNGLNQCLKITTSKIFQCNKYVKVMHKFSNSNRHKIRHTENKHFRCKECDKSLCMLSRLTQHKKIHTRENFYKCEECGKTFNWSTNLSKPKKIHTGEKPYKCEVCGKAFHQSSILTKHKIIRTGEKPYKCAHCGKAFKQSSHLTRHKIIHTEEKPYKCEQCGKVFKQSPTLTKHQIIYTGEEPYKCEECGKAFNLS

SEQ ID NO: 70311 - protein, 293 aa, Homo sapiens
MGPLTFMDVAIEFSLEEWQCLDTAQRNVYRHVMLENYRNLVFLALCSRFAQDLWLEQNIKDSFQKVTLSRYGKYGHKNLQLRKGCKSVDECKGHQGGFNGLNQCLKITTSKIFQCNKYVKVMHKFSNSNRHKIRHTENKHFRCKECDKSLCMLSRLTQHKKIHTRENFYKCEECGKTFNWSTNLSKPKKIHTGEKPYKCEVCGKAFHQSSILTKHKIIRTGEKPYKCAHCGKAFKQSSHLTRHKIIHTEEKPYKCEQCGKVFKQSPTLTKHQIIYTGEEPYKCEECGKAFNLS

SEQ ID NO: 70312 - protein, 126 aa, Homo sapiens
MGPLTFMDVAIEFSLEEWQCLDTAQRNVYRHVMLENYRNLVFLDLITCLEQGKEPWNMKRHEMVVAKHSAVAFTFDLSGLNILSFQSILPFVSALYVMGNRNQCLQKHLEARNKDLCVLVLPKTFG

SEQ ID NO: 70313 - protein, 642 aa, Homo sapiens
MDSVSFEDVAVNFTLEEWALLDSSQKKLYEDVMQETFKNLVCLGKKWEDQDIEDDHRNQGKNRRCHMVERLCESRRGSKCGETTSQMPNVNINKETFTGAKPHECSFCGRDFIHHSSLNRHMRSHTGQKPNEYQEYEKQPCKCKAVGKTFSYHHCFRKHERTHTGVKPYECKQCGKAFIYYQPFQRHERTHAGQKPYECKQCGKTFIYYQSFQKHAHTGKKPYECKQCGKAFICYQSFQRHKRTHTGEKPYECKQCGKAFSCPTYFRTHERTHTGEKPYKCKECGKAFSFLSSFRRHKRTHSGEKPYECKECGKAFFYSASFRAHVIIHTGARPYKCKECGKAFNSSNSCRVHERTHIGEKPYECKRCGKSFSWSISLRLHERTHTGEKPYECKQCHKTFSFSSSLREHETTHTGEKPYECKQCGKTFSFSSSLQRHERTHNAEKPYECKQCGKAFRCSSYFRIHERSHTGEKPYECKQCGKVFIRSSSFRLHERTHTGEKPYECKLCGKTFSFSSSLREHEKIHTGNKPFECKQCGKAFLRSSQIRLHERTHTGEKPYQCKQCGKAFISSSKFRMHERTHTGEKPYRCKQCGKAFRFSSSVRIHERSHTGEKPYECKQCGKAFISSSHFRLHERTHMGEKV

SEQ ID NO: 70314 - protein, 457 aa, Homo sapiens
MSQGSVTFRDVAIDFSQEEWKWLQPAQRDLYRCVMLENYGHLVSLGLSISKPDVVSLLEQGKEPWLGKREVKRDLFSVSESSGEIKDFSPKNVIYDDSSQYLIMERILSQGPVYSSFKGGWKCKDHTEMLQENQGCIRKVTVSHQEALAQHMNISTVERPYGCHECGKTFGRRFSLVLHQRTHTGEKPYACKECGKTFSQISNLVKHQMIHTGKKPHECKDCNKTFSYLSFLIEHQRTHTGEKPYECTECGKAFSRASNLTRHQRIHIGKKQYICRKCGKAFSSGSELIRHQITHTGEKPYECIECGKAFRRFSHLTRHQSIHTTKTPYECNECRKAFRCHSFLIKHQRIHAGEKLYECDECGKVFTWHASLIQHTKSHTGEKPYACAECDKAFSRSFSLILHQRTHTGEKPYVCKVCNKSFSWSSNLAKHQRTHTLDNPYEYENSFNYHSFLTEHQ

SEQ ID NO: 70315 - protein, 116 aa, Homo sapiens
MSQGSVTFRDVAIDFSQEEWKWLQPAQRDLYRCVMLENYGHLVSLGLSISKPDVVSLLEQGKEPWLGKREVKRDLFSVSESSGEIKDFSPKNVIYDDSSQYLIMERILSQGPVYSS

SEQ ID NO: 70316 - protein, 227 aa, Homo sapiens
THTGEKPYACKECGKTFSQISNLVKHQMIHTGKKPHECKDCNKTFSYLSFLIEHQRTHTGEKPYECTECGKAFSRASNLTRHQRIHIGKKQYICRKCGKAFSSGSELIRHQITHTGEKPYECIECGKAFRRFSHLTRHQRIHAGEKLYECDECGKVFTWHASLIQHTKSHTGEKPYACAECDKAFSRSFSLILHQRTHTGEKPYVCKVCNKSFSWSSNLAKHQRTHT

SEQ ID NO: 70317 - protein, 354 aa, Homo sapiens
MERILSQGPVYSSFKGGWKCKDHTEMLQENQGCIRKVTVSHQEALAQHMNISTVERPYGCHECGKTFGRRFSLVLHQRTHTGEKPYACKECGKTFSQISNLVKHQMIHTGKKPHECKDCNKTFSYLSFLIEHQRTHTGEKPYECTECGKAFSRASNLTRHQRIHIGKKQYICRKCGKAFSSGSELIRHQITHTGEKPYECIECGKAFRRFSHLTRHQSIHTTKTPYECNECRKAFRCHSFLIKHQRIHAGEKLYECDECGKVFTWHASLIQHTKSHTGEKPYACAECDKAFSRSFSLILHQRTHTGEKPYVCKVCNKSFSWSSNLAKHQRTHTLDNPYEYENSFNYHSFLTEHQ

SEQ ID NO: 70318 - protein, 474 aa, Homo sapiens
MELLTFRDVAIEFSPEEWKCLDPDQQNLYRDVMLENYRNLVSLGVAISNPDLVTCLEQRKEPYNVKIHKIVARPPAMCSHFTQDHWPVQGIEDSFHKLILRRYEKCGHDNLQLRKGCKSLNECKLQKGGYNEFNECLSTTQSKILQCKASVKVVSKFSNSNKRKTRHTGEKHFKECGKSFQKFSHLTQHKVIHAGEKPYTCEECGKAFKWSLIFNEHKRIHTGEKPFTCEECGSIFTTSSHFAKHKIIHTGEKPYKCEECGKAFNRFTTLTKHKRIHAGEKPITCEECRKIFTSSSNFAKHKRIHTGEKPYKCEECGKAFNRSTTLTKHKRIHTGEKPYTCEECGKAFRQSSKLNEHKKVHTGERPYKCDECGKAFGRSRVLNEHKKIHTGEKPYKCEECGKAFRRSTDRSQHKKIHSADKPYKCKECDKAFKQFSLLSQHKKIHTVDKPYKCKDCDKAFKRFSHLNKHKKIHT

SEQ ID NO: 70319 - protein, 201 aa, Homo sapiens
MELLTFRDVAIEFSPEEWKCLDPDQQNLYRDVMLENYRNLVSLGVAISNPDLVTCLEQRKEPYNVKIHKIVARPPAMCSHFTQDHWPVQGIEDSFHKLILRRYEKCGHDNLQLRKGCKSLNECKLQKGGYNEFNECLSTTQSKILQCKASVKVVSKFSNSNKRKTRHTGEKHFKECGKSFQKFSHLTQHKNSSISMTTSPF

SEQ ID NO: 70320 - protein, 1687 aa, Homo sapiens
MTDPLLDSQPASSTGEMDGLCPELLLIPPPLSNRGILGPVQSPCPSRDPAPIPTEPGCLLVEATATEEGPGNMEIIVETVAGTLTPGAPGETPAPKLPPGEREPSQEAGTPLPGQETAEEENVEKEEKSDTQKDSQKAVDKGQGAQRLEGDVVSGTESLFKTHMCPECKRCFKKRTHLVEHLHLHFPDPSLQCPNCQKFFTSKSKLKTHLLRELGEKAHHCPLCHYSAVERNALNRHMASMHEDISNFYSDTYACPVCREEFRLSQALKEHLKSHTAAAAAEPLPLRCFQEGCSYAAPDRKAFIKHLKETHGVRAVECRHHSCPMLFATAEAMEAHHKSHYAFHCPHCDFACSNKHLFRKHKKQGHPGSEELRCTFCPFATFNPVAYQDHVGKMHAHEKIHQCPECNFATAHKRVLIRHMLLHTGEKPHKCELCDFTCRDVSYLSKHMLTHSNTKDYMCTECGYVTKWKHYLRVHMRKHAGDLRYQCNQCSYRCHRADQLSSHKLRHQGKSLMCEVCAFACKRKYELQKHMASQHHPGTPAPLYPCHYCSYQSRHKQAVLSHENCKHTRLREFHCALCDYRTFSNTTLLFHKRKAHGYVPGDQAWQLRYASQEPEGAMQGPTPPPDSEPSNQLSARPEGPGHEPGTVVDPSLDQALPEMSEEVNTGRQEGSEAPHGGDLGGSPSPAEVEEGSCTLHLEALGVELESVTEPPLEEVTETAPMEFRPLGLEGPDGLEGPELSSFEGIGTSDLSAEENPLLEKPVSEPSTNPPSLEEAPNNWVGTFKTTPPAETAPLPPLPESESLLKALRRQDKEQAEALVLEGRVQMVVIQGEGRAFRCPHCPFITRREKALNLHSRTGCQGRREPLLCPECGASFKQQRGLSTHLLKKCPVLLRKNKGLPRPDSPIPLQPVLPGTQASEDTESGKPPPASQEAELLLPKDAPLELPREPEETEEPLATVSGSPVPPAGNSLPTEAPKKHCFDPVPPAGNSSPTEAPKKHHLDPVPPAGNSSPTEALKKHRFEQGKFHCNSCPFLCSRLSSITSHVAEGCRGGRGGGGKRGTPQTQPDVSPLSNGDSAPPKNGSTESSSGDGDTVLVQKQKGARFSCPTCPFSCQQERALRTHQIRGCPLEESGELHCSLCPFTAPAATALRLHQKRRHPTAAPARGPRPHLQCGDCGFTCKQSRCMQQHRRLKHEGVKPHQCPFCDFSTTRRYRLEAHQSRHTGIGRIPCSSCPQTFGTNSKLRLHRLRVHDKTPTHFCPLCDYSGYLRHDITRHVNSCHQGTPAFACSQCEAQFSSETALKQHALRRHPEPAQPAPGSPAETTEGPLHCSRCGLLCPSPASLRGHTRKQHPRLECGACQEAFPSRLALDEHRRQQHFSHRCQLCDFAARERVGLVKHYLEQHEETSAAVAASDGDGDAGQPPLHCPFCDFTCRHQLVLDHHVKGHGGTRLYKCTDCAYSTKNRQKITWHSRIHTGEKPYHCHLCPYACADPSRLKYHMRIHKEERKYLCPECGYKCKWVNQLKYHMTKHTGLKPYQCPECEYCTNRADALRVHQETRHREARAFMCEQCGKAFKTRFLLRTHLRKHSEAKPYVCNVCHRAFRWAAGLRHHALTHTDRHPFFCRLCNYKAKQKFQVVKHVRRHHPDQADPNQGVGKDPTTPTVHLHDVQLEDPSPPAPAAPHTGPEG

SEQ ID NO: 70321 - protein, 14 aa, Homo sapiens
MTDPLLDSQPASST

SEQ ID NO: 70322 - protein, 1687 aa, Homo sapiens; identical to SEQ ID NO: 70320

SEQ ID NO: 70323 - protein, 26 aa, Homo sapiens
MTDPLLDSQPASSTGEMDGLCPELLL

SEQ ID NO: 70324 - protein, 607 aa, Homo sapiens
MLLAQINRDSQGMTEFPGGGMEAQHVTLCLTEAVTVADAKLIDGQVIQLEDGSAAYVQHVPIPKSTGDSLRLEDGQAVQLEDGTTAFIHHTSKDSYDQSALQAVQLEDGTTAYIHHAVQVPQSDTILAIQADGTVAGLHTGDATIDPDTISALEQYAAKVSIDGSESVAGTGMIGENEQEKKMQIVLQGHATRVTAKSQQSGEKAFRCEYDGCGKLYTTAHHLKVHERSHTGDRPYQCEHAGCGKAFATGYGLKSHVRTHTGEKPYRCSEDNCTKSFKTSGDLQKHIRTHTGERPFKCPFEGCGRSFTTSNIRKVHVRTHTGERPYYCTEPGCGRAFASATNYKNHVRIHTGEKPYVCTVPGCDKRFTEYSSLYKHHVVHTHSKPYNCNHCGKTYKQISTLAMHKRTAHNDTEPIEEEQEAFFEPPPGQGEDVLKGSQITYVTGVEGDDVVSTQVATVTQSGLSQQVTLISQDGTQHVNISQADMQAIGNTITMVTQDGTPITVPAHDAVISSAGTHSVAMVTAEGTEGEQVAIVAQDLAAFHTASSEMGHQQHSHHLVTTETRPLTLVATSNGTQIAVQLGEQPSLEEAIRIASRIQQGETPGLDD

SEQ ID NO: 70325 - protein, 638 aa, Homo sapiens
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSTGDSLRLEDGQAVQLEDGTTAFIHHTSKDSYDQSALQAVQLEDGTTAYIHHAVQVPQSDTILAIQADGTVAGLHTGDATIDPDTISALEQYAAKVSIDGSESVAGTGMIGENEQEKKMQIVLQGHATRVTAKSQQSGEKAFRCEYDGCGKLYTTAHHLKVHERSHTGDRPYQCEHAGCGKAFATGYGLKSHVRTHTGEKPYRCSEDNCTKSFKTSGDLQKHIRTHTGERPFKCPFEGCGRSFTTSNIRKVHVRTHTGERPYYCTEPGCGRAFASATNYKNHVRIHTGEKPYVCTVPGCDKRFTEYSSLYKHHVVHTHSKPYNCNHCGKTYKQISTLAMHKRTAHNDTEPIEEEQEAFFEPPPGQGEDVLKGSQITYVTGVEGDDVVSTQVATVTQSGLSQQVTLISQDGTQHVNISQADMQAIGNTITMVTQDGTPITVPAHDAVISSAGTHSVAMVTAEGTEGEQVAIVAQDLAAFHTASSEMGHQQHSHHLVTTETRPLTLVATSNGTQIAVQLGEQPSLEEAIRIASRIQQGETPGLDD

SEQ ID NO: 70326 - protein, 142 aa, Homo sapiens
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSRDSLRLEDGQAVQLEDGTTAFIHHTSKDSYDQSALQAVQLEDGTTA

SEQ ID NO: 70327 - protein, 84 aa, Homo sapiens
MLLAQINRDSQGMTEFPGGGMEAQHVTLCLTEAVTVADGDNLENMEGVSLQAVTLADGSTAYIQHNSKDAKLIDGQVIQLEDGS

SEQ ID NO: 70328 - protein, 73 aa, Homo sapiens
MLLAQINRDSQGMTEFPGGGMEAQHVTLCLTEAVTVADGDNLENMEGVSLQAVTLADGSTAYIQHNSKDAKLI

SEQ ID NO: 70329 - protein, 190 aa, Homo sapiens
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSTGDSLRLEDGQAVQLEDGTTAFIHHTSKDSYDQSALQAVQLEDGTTAYIHHAVQVPQSDTILAIQADGTVAGLHTGDATIDPDTISALEQYAAK

SEQ ID NO: 70330 - protein, 136 aa, Homo sapiens
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSTGDSLRLEDGQAVQLEDGTTAFIHHTSKDSYDQSALQAVQ

SEQ ID NO: 70331 - protein, 175 aa, Homo sapiens
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSTGDSLRLEDGQAVQLEDGTTAFIHHTSKDSYDQSALQAVQLEDGTTAYIHHAVQVPQSDTILAIQADGTVAGLHTGDAT

SEQ ID NO: 70332 - protein, 292 aa, Homo sapiens
MSHLSQQRIYSGENPFACKVCGKVFSHKSNLTEHEHFHTREKPFECNECGKAFSQKQYVIKHQNTHTGEKLFECNECGKSFSQKENLLTHQKIHTGEKPFECKDCGKAFIQKSNLIRHQRTHTGEKPFVCKECGKTFSGKSNLTEHEKIHIGEKPFKCSECGTAFGQKKYLIKHQNIHTGEKPYECNECGKAFSQRTSLIVHVRIHSGDKPYECNVCGKAFSQSSSLTVHVRSHTGEKPYGCNECGKAFSQFSTLALHLRIHTGKKPYQCSECGKAFSQKSHHIRHQKIHTH

SEQ ID NO: 70333 - protein, 292 aa, Homo sapiens; identical to SEQ ID NO: 70332

SEQ ID NO: 70334 - protein, 794 aa, Homo sapiens
MNIDDKLEGLFLKCGGIDEMQSSRTMVVMGGVSGQSTVSGELQDSVLQDRSMPHQEILAADEVLQESEMRQQDMISHDELMVHEETVKNDEEQMETHERLPQGLQYALNVPISVKQEITFTDVSEQLMRDKKQIREPVDLQKKKKRKQRSPAKILTINEDGSLGLKTPKSHVCEHCNAAFRTNYHLQRHVFIHTGEKPFQCSQCDMRFIQKYLLQRHEKIHTGEKPFRCDECGMRFIQKYHMERHKRTHSGEKPYQCEYCLQYFSRTDRVLKHKRMCHENHDKKLNRCAIKGGLLTSEEDSGFSTSPKDNSLPKKKRQKTEKKSSGMDKESALDKSDLKKDKNDYLPLYSSSTKVKDEYMVAEYAVEMPHSSVGGSHLEDASGEIHPPKLVLKKINSKRSLKQPLEQNQTISPLSTYEESKVSKYAFELVDKQALLDSEGNADIDQVDNLQEGPSKPVHSSTNYDDAMQFLKKKRYLQAASNNSREYALNVGTIASQPSVTQAAVASVIDESTTASILESQALNVEIKSNHDKNVIPDEVLQTLLDHYSHKANGQHEISFSVADTEVTSSISINSSEVPEVTPSENVGSSSQASSSDKANMLQEYSKFLQQALDRTSQNDAYLNSPSLNFVTDNQTLPNQPAFSSIDKQVYATMPINSFRSGMNSPLRTTPDKSHFGLIVGDSQHSFPFSGDETNHASATSTQDFLDQVTSQKKAEAQPVHQAYQMSSFEQPFRAPYHGSRAGIATQFSTANGQVNLRGPGTSAEFSEFPLVNVNDNRAGMTSSPDATTGQTFG

SEQ ID NO: 70335 - protein, 83 aa, Homo sapiens
MNIDDKLEGLFLKCGGIDEMQSSRTMVVMGGVSGQSTVSGELQDSVLQDRSMPHQEILAADEVLQESEMRQQDMISHDELMVH

SEQ ID NO: 70336 - protein, 144 aa, Homo sapiens
MKGEKPFQCSQCDMRFIQKYLLQRHEKIHTGEKPFRCDECGDETNHASATSTQDFLDQVTSQKKAEAQPVHQAYQMSSFEQPFRAPYHGSRAGIATQFSTANGQVNLRGPGTSAEFSEFPLVNVNDNRAGMTSSPDATTGQTFG

SEQ ID NO: 70337 - protein, 25 aa, Homo sapiens
MNIDDKLEGLFLKCGGIDEMQSSRT

SEQ ID NO: 70338 - protein, 794 aa, Homo sapiens; identical to SEQ ID NO: 70334

SEQ ID NO: 70339 - protein, 794 aa, Homo sapiens; identical to SEQ ID NO: 70334

SEQ ID NO: 70340 - protein, 794 aa, Homo sapiens; identical to SEQ ID NO: 70334

SEQ ID NO: 70341 - protein, 75 aa, Homo sapiens
MNIDDKLEGLFLKCGGIDEMQSSRTMVVMGGVSGQSTVSGELQDSVLQDRSMPHQEILAADEVLQESEMRQQDMI

SEQ ID NO: 70342 - protein, 454 aa, Homo sapiens
MNIDDKLEGLFLKCGGIDEMQSSRTMVVMGGVSGQSTVSGELQDSVLQDRSMPHQEILAADEVLQESEMRQQDMISHDELMVHEETVKNDEEQMETHERLPQGLQYALNVPISVKQEITFTDVSEQLMRDKKQIREPVDLQKKKKRKQRSPAKILTINEDGSLGLKTPKSHVCEHCNAAFRTNYHLQRHVFIHTGEKPFQCSQCDMRFIQKYLLQRHEKIHTGEKPFRCDECGMRFIQKYHMERHKRTHSGEKPYQCEYCLQYFSRTDRVLKHKRMCHENHDKKLNRCAIKGGLLTSEEDSGFSTSPKDNSLPKKKRQKTEKKSSGMDKESALDKSDLKKDKNDYLPLYSSSTKVKDEYMVAEYAVEMPHSSVGGSHLEDASGEIHPPKLVLKKINSKRSLKQPLEQNQTISPLSTYEESKFQSMLLNLWINRLYWTQKAMLTLIRLIICRRAQ

SEQ ID NO: 70343 - protein, 131 aa, Homo sapiens
MRFIQKYLLQRHEKIHTGEKPFRCDECGDETNHASATSTQDFLDQVTSQKKAEAQPVHQAYQMSSFEQPFRAPYHGSRAGIATQFSTANGQVNLRGPGTSAEFSEFPLVNVNDNRAGMTSSPDATTGQTFG

SEQ ID NO: 70344 - protein, 143 aa, Homo sapiens
KTHYNCGEHTKAFSGKHTLVQQQRTLTTERCYICSECGKSFSNKSNLIKHRRVHTGERPYECSECGKSFSQRSALLQHRGVHTGERPYECSECGKFFTYHSSLIKHQKVHSGSRPYECSECGKSFSQNSSLIEHHRVHTGERP

SEQ ID NO: 70345 - protein, 437 aa, Homo sapiens
MAAATLRTPTQGTVTFEDVAVHFSWEEWGLLDEAQRCLYRDVMLENLALLTSLDVHHQKQHLGEKHFRSNVGRALFVKTCTFHVSGEPSTCREVGKDFLAKLGFLHQQAAHTGEQSNSKSDGGAISHRGKTHYNCGEHTKAFSGKHTLVQQQRTLTTERCYICSECGKSFSKSYSLNDHWRLHTGEKPYECRECGKSFRQSSSLIQHRRVHTAVRPHECDECGKLFSNKSNLIKHRRVHTGERPYECSECGKSFSQRSALLQHRGVHTGERPYECSECGKFFTYHSSLIKHQKVHSGSRPYECSECGKSFSQNSSLIEHHRVHTGERPYKCSECGKSFSQRSALLQHRGVHTGERPYECSECGKFFPYSSSLRKHQRVHTGSRPYECSECGKSFTQNSGLIKHRRVHTGEKPYECTECGKSFSHNSSLIKHQRIHSR

SEQ ID NO: 70346 - protein, 437 aa, Homo sapiens; identical to SEQ ID NO: 70345

SEQ ID NO: 70347 - protein, 538 aa, Homo sapiens
MTTFKEAVTFKDVAVVFTEEELGLLDPAQRKLYRDVMLENFRNLLSVGHQPFHQDTCHFLREEKFWMMGTATQREGNSGGKIQTELESVPEAGAHEEWSCQQIWEQIAKDLTRSQDSIINNSQFFENGDVPSQVEAGLPTIHTGQKPSQGGKCKQSISDVPIFDLPQQLYSEEKSYTCDECGKSICYISALHVHQRVHVGEKLFMCDVCGKEFSQSSHLQTHQRVHTGEKPFKCEQCGKGFSRRSALNVHRKLHTGEKPYICEACGKAFIHDSQLKEHKRIHTGEKPFKCDICGKTFYFRSRLKSHSMVHTGEKPFRCDTCDKSFHQRSALNRHCMVHTGEKPYRCEQCGKGFIGRLDFYKHQVVHTGEKPYNCKECGKSFRWSSCLLNHQRVHSGEKSFKCEECGKGFYTNSQLSSHQRSHSGEKPYKCEECGKGYVTKFNLDLHQRVHTGERPYNCKECGKNFSRASSILNHKRLHCQKKPFKCEDCGKRLVHRTYRKDQPRDYSGENPSKCEDCGRRYKRRLNLDILLSLFLNDT

SEQ ID NO: 70348 - protein, 549 aa, Homo sapiens
MIKRSKVLVFCSKIMEEAVTFKDVAVVFTEEELGLLDPAQRKLYRDVMLENFRNLLSVGHQPFHQDTCHFLREEKFWMMGTATQREGNSGGKIQTELESVPEAGAHEEWSCQQIWEQIAKDLTRSQDSIINNSQFFENGDVPSQVEAGLPTIHTGQKPSQGGKCKQSISDVPIFDLPQQLYSEEKSYTCDECGKSICYISALHVHQRVHVGEKLFMCDVCGKEFSQSSHLQTHQRVHTGEKPFKCEQCGKGFSRRSALNVHRKLHTGEKPYICEACGKAFIHDSQLKEHKRIHTGEKPFKCDICGKTFYFRSRLKSHSMVHTGEKPFRCDTCDKSFHQRSALNRHCMVHTGEKPYRCEQCGKGFIGRLDFYKHQVVHTGEKPYNCKECGKSFRWSSCLLNHQRVHSGEKSFKCEECGKGFYTNSQLSSHQRSHSGEKPYKCEECGKGYVTKFNLDLHQRVHTGERPYNCKECGKNFSRASSILNHKRLHCQKKPFKCEDCGKRLVHRTYRKDQPRDYSGENPSKCEDCGRRYKRRLNLDILLSLFLNDT

SEQ ID NO: 70349 - protein, 230 aa, Homo sapiens
MVMSPPRLKQDYPQFIQDRNLPRVGSVNSPSVMFPSLIFLSSYTQKRSLIHVMSVEKASVTSQLFMFIRESTWERNSLCVMCVARNLVKAHICKLIRESTLERNHSNVSNVGKVSVVDQHLMFIVNYTQERNLTFVRHVGRPSFMIPSLRNIRESILGRNHSNVIYVVRPSILGQDLRAIPWFTQEKNHLGVIHVIRAFIRDQHLIGIAWSTQERNRTDVSSVEKALLVG

SEQ ID NO: 70350 - protein, 506 aa, Homo sapiens
MPANGTSPQRFPALIPGEPGRSFEGSVSFEDVAVDFTRQEWHRLDPAQRTMHKDVMLETYSNLASVGLCVAKPEMIFKLERGEELWILEEESSGHGYSGSLSLLCGNGSVGDNALRHDNDLLHHQKIQTLDQNVEYNGCRKAFHEKTGFVRRKRTPRGDKNFECHECGKAYCRKSNLVEHLRIHTGERPYECGECAKTFSARSYLIAHQKTHTGERPFECNECGKSFGRKSQLILHTRTHTGERPYECTECGKTFSEKATLTIHQRTHTGEKPYECSECGKTFRVKISLTQHHRTHTGEKPYECGECGKNFRAKKSLNQHQRIHTGEKPYECGECGKFFRMKMTLNNHQRTHTGEKPYQCNECGKSFRVHSSLGIHQRIHTGEKPYECNECGNAFYVKARLIEHQRMHSGEKPYECSECGKIFSMKKSLCQHRRTHTGEKPYECSECGNAFYVKVRLIEHQRIHTGERPFECQECGKAFCRKAHLTEHQRTHIGWSWRCTMKKASH

SEQ ID NO: 70351 - protein, 682 aa, Homo sapiens
MPSLRTRREEAEMELSVPGPSPWTPAAQARVRDAPAVTHPGSAACGTPCCSDTELEAICPHYQQPDCDTRTEDKEFLHKEDIHEDLESQAEISENYAGDVSQVPELGDLCDDVSERDWGVPEGRRLPQSLSQEGDFTPAAMGLLRGPLGEKDLDCNGFDSRFSLSPNLMACQEIPTEERPHPYDMGGQSFQHSVDLTGHEGVPTAESPLICNECGKTFQGNPDLIQRQIVHTGEASFMCDDCGKTFSQNSVLKNRHRSHMSEKAYQCSECGKAFRGHSDFSRHQSHHSSERPYMCNECGKAFSQNSSLKKHQKSHMSEKPYECNECGKAFRRSSNLIQHQRIHSGEKPYVCSECGKAFRRSSNLIKHHRTHTGEKPFECGECGKAFSQSAHLRKHQRVHTGEKPYECNDCGKPFSRVSNLIKHHRVHTGEKPYKCSDCGKAFSQSSSLIQHRRIHTGEKPHVCNVCGKAFSYSSVLRKHQIIHTGEKPYRCSVCGKAFSHSSALIQHQGVHTGDKPYACHECGKTFGRSSNLILHQRVHTGEKPYECTECGKTFSQSSTLIQHQRIHNGLKPHECNQCGKAFNRSSNLIHHQKVHTGEKPYTCVECGKGFSQSSHLIQHQIIHTGERPYKCSECGKAFSQRSVLIQHQRIHTGVKPYDCAACGKAFSQRSKLIKHQLIHTRE

SEQ ID NO: 70352 - protein, 682 aa, Homo sapiens; identical to SEQ ID NO: 70351

SEQ ID NO: 70353 - protein, 147 aa, Homo sapiens
MALTQVRLTFRDVAIEFSQEEWKCLDPAQRILYRDVMLENYWNLVSLGLCHFDMNIISMLEEGKEPWTVKSCVKIARKPRTPECVKGVVTDLLRRWKHWLLLLGICCPKPHGRVSSRLRLSRSLGHFFHSAFATFMGVCDKRVGSIF

SEQ ID NO: 70354 - protein, 818 aa, Homo sapiens
MALTQVRLTFRDVAIEFSQEEWKCLDPAQRILYRDVMLENYWNLVSLGLCHFDMNIISMLEEGKEPWTVKSCVKIARKPRTPECVKGVVTDIPPKCTIKDLLPKEKSSTEAVFHTVVLERHESPDIEDFSFKEPQKNVHDFECQWRDDTGNYKGVLMAQKEGKRDQRDRRDIENKLMNNQLGVSFHSHLPELQLFQGEGKMYECNQVEKSTNNGSSVSPLQQIPSSVQTHRSKKYHELNHFSLLTQRRKANSCGKPYKCNECGKAFTQNSNLTSHRRIHSGEKPYKCSECGKTFTVRSNLTIHQVIHTGEKPYKCHECGKVFRHNSYLATHRRIHTGEKPYKCNECGKAFRGHSNLTTHQLIHTGEKPFKCNECGKLFTQNSHLISHWRIHTGEKPYKCNECGKAFSVRSSLAIHQTIHTGEKPYKCNECGKVFRYNSYLGRHRRVHTGEKPYKCNECGKAFSMHSNLATHQVIHTGTKPFKCNECSKVFTQNSQLANHRRIHTGEKPYKCNECGKAFSVRSSLTTHQAIHSGEKPYKCIECGKSFTQKSHLRSHRGIHSGEKPYKCNECGKVFAQTSQLARHWRVHTGEKPYKCNDCGRAFSDRSSLTFHQAIHTGEKPYKCHECGKVFRHNSYLATHRRIHTGEKPYKCNECGKAFSMHSNLTTHKVIHTGEKPYKCNQCGKVFTQNSHLANHQRTHTGEKPYRCNECGKAFSVRSSLTTHQAIHTGKKPYKCNECGKVFTQNAHLANHRRIHTGEKPYRCTECGKAFRVRSSLTTHMAIHTGEKRYKCNECGKVFRQSSNLASHHRMHTGEKPYK

SEQ ID NO: 70355 - protein, 818 aa, Homo sapiens; identical to SEQ ID NO: 70354

SEQ ID NO: 70356 - protein, 818 aa, Homo sapiens; identical to SEQ ID NO: 70354

SEQ ID NO: 70357 - protein, 449 aa, Homo sapiens
MEFFISMSETIKYNDDDHKTLFLKTLNEQRLEGEFCDIAIVVEDVKFRAHRCVLAACSTYFKKLFKKLEVDSSSVIEIDFLRSDIFEEVLNYMYTAKISVKKEDVNLMMSSGQILGIRFLDKLCSQKRDVSSPDENNGQSKSKYCLKINRPIGDAADTQDDDVEEIGDQDDSPSDDTVEGTPPSQEDGKSPTTTLRVQEAILKELGSEEVRKVNCYGQEVESMETPESKDLGSQTPQALTFNDGMSEVKDEQTPGWTTAASDMKFEYLLYGHHREQIACQACGKTFSDEGRLRKHEKLHTADRPFVCEMCTKGFTTQAHLKEHLKIHTGYKPYSCEVCGKSFIRAPDLKKHERVHSNERPFACHMCDKAFKHKSHLKDHERRHRGEKPFVCGSCTKAFAKASDLKRHENNMHSERKQVTPSAIQSETEQLQAAAMAAEAEQQLETIACS

SEQ ID NO: 70358 - protein, 449 aa, Homo sapiens; identical to SEQ ID NO: 70357

SEQ ID NO: 70359 - protein, 485 aa, Homo sapiens
MATEPKKAAAQNSPEDEGLLIVKIEEEEFIHGQDTCLQRSELLKQELCRQLFRQFCYQDSPGPREALSRLRELCCQWLKPEIHTKEQILELLVLEQFLTILPGDLQAWVHEHYPESGEEAVTILEDLERGTDEAVLQVQAHEHGQEIFQKKVSPPGPALNVKLQPVETKAHFDSSEPQLLWDCDNESENSRSMPKLEIFEKIESQRIISGRISGYISEASGESQDICKSAGRVKRQWEKESGESQRLSSAQDEGFGKILTHKNTVRGEIISHDGCERRLNLNSNEFTHQKSCKHGTCDQSFKWNSDFINHQIIYAGEKNHQYGKSFKSPKLAKHAAVFSGDKTHQCNECGKAFRHSSKLARHQRIHTGERCYECNECGKSFAESSDLTRHRRIHTGERPFGCKECGRAFNLNSHLIRHQRIHTREKPYECSECGKTFRVSSHLIRHFRIHTGEKPYECSECGRAFSQSSNLSQHQRIHMRENLLM

SEQ ID NO: 70360 - protein, 412 aa, Homo sapiens
MSLGGSDTMLKGADTSESGAVIRGNYRLGLSKKSSLFSHQKHHVCPECGRGFCQRSDLIKHQRTHTGEKPYLCPECGRRFSQKASLSIHQRKHSGEKPYVCRECGRHFRYTSSLTNHKRIHSGERPFVCQECGRGFRQKIALLLHQRTHLEEKPFVCPECGRGFCQKASLLQHQSSHTGERPFLCLECGRSFRQQSLLLSHQVTHSGEKPYVCAECGHSFRQKVTLIRHQRTHTGEKPYLCPQCGRGFSQKVTLIGHQRTHTGEKPYLCPDCGRGFGQKVTLIRHQRTHTGEKPYLCPKCGRAFGFKSLLTRHQRTHSEEELYVDRVCGQGLGQKSHLISDQRTHSGEKPCICDECGRGFGFKSALIRHQRTHSGEKPYVCRECGRGFSQKSHLHRHRRTKSGHQLLPQEVF

SEQ ID NO: 70361 - protein, 96 aa, Homo sapiens
MSPGLLTTRKEALMAFRDVAVAFTQKEWKLLSSAQRTLYREVMLENYSHLVSLGIAFSKPKLIEQLEQGDEPWREENEHLLDLCPGRRITRSGVRD

SEQ ID NO: 70362 - protein, 603 aa, Homo sapiens
MSPGLLTTRKEALMAFRDVAVAFTQKEWKLLSSAQRTLYREVMLENYSHLVSLGIAFSKPKLIEQLEQGDEPWREENEHLLDLCPEPRTEFQPSFPHLVAFSSSQLLRQYALSGHPTQIFPSSSAGGDFQLEAPRCSSEKGESGETEGPDSSLRKRPSRISRTFFSPHQGDPVEWVEGNREGGTDLRLAQRMSLGGSDTMLKGADTSESGAVIRGNYRLGLSKKSSLFSHQKHHVCPECGRGFCQRSDLIKHQRTHTGEKPYLCPECGRRFSQKASLSIHQRKHSGEKPYVCRECGRHFRYTSSLTNHKRIHSGERPFVCQECGRGFRQKIALLLHQRTHLEEKPFVCPECGRGFCQKASLLQHQSSHTGERPFLCLECGRSFRQQSLLLSHQVTHSGEKPYVCAECGHSFRQKVTLIRHQRTHTGEKPYLCPQCGRGFSQKVTLIGHQRTHTGEKPYLCPDCGRGFGQKVTLIRHQRTHTGEKPYLCPKCGRAFGFKSLLTRHQRTHSEEELYVDRVCGQGLGQKSHLISDQRTHSGEKPCICDECGRGFGFKSALIRHQRTHSGEKPYVCRECGRGFSQKSHLHRHRRTKSGHQLLPQEVF

SEQ ID NO: 70363 - protein, 407 aa, Homo sapiens
MAAKMEITLSSNTEASSKQERHIIAKLEEKRGPPLQKNCPDPELCRQSFRRFCYQEVSGPQEALSQLRQLCRQWLQPELHTKEQILELLVMEQFLTILPPEIQARVRHRCPMSSKEIVTLVEDFHRASKKPKQWVAVCMQGQKVLLEKTGSQLGEQELPDFQPQTPRRDLRESSPAEPSQAGAYDRLSPHHWEKSPLLQEPTPKLAGTEAPRMRSDNKENPQQEGAKGAKPCAVSAGRSKGNGLQNPEPRGANMSEPRLSRRQVSSPNAQKPFAHYQRHCRVEYISSPLKSHPLRELKKSKGGKRSLSNRLQHLGHQPTRSAKKPYKCDDCGKSFTWNSELKRHKRVHTGERPYTCGECGNCFGRQSTLKLHQRIHTGEKPYQCGQCGKSFRQSSNLHQHHRLHHGD

SEQ ID NO: 70364 - protein, 234 aa, Homo sapiens
MAAKMEITLSSNTEASSKQERHIIAKLEEKRGPPLQKNCPDPELCRQSFRRFCYQEVSGPQEALSQLRQLCRQWLQPELHTKEQILELLVMEQFLTILPPEIQARVRHRCPMSSKEIVTLVEDFHRASKKPKQWVAVCMQGQKVLLEKTGSQLGEQELPDFQPQTPRRDLRESSPAEPSQAGAYDRLSPHHWEKSPLLQEPTPKLAGTELLIEKTDPNMATDELPCKLWLSFIA

SEQ ID NO: 70365 - protein, 711 aa, Homo sapiens
MPADVNLSQKPQVLGPEKQDGSCEASVSFEDVTVDFSREEWQQLDPAQRCLYRDVMLELYSHLFAVGYHIPNPEVIFRMLKEKEPRVEEAEVSHQRCQEREFGLEIPQKEISKKASFQKDMVGEFTRDGSWCSILEELRLDADRTKKDEQNQIQPMSHSAFFNKKTLNTESNCEYKDPGKMIRTRPHLASSQKQPQKCCLFTESLKLNLEVNGQNESNDTEQLDDVVGSGQLFSHSSSDACSKNIHTGETFCKGNQCRKVCGHKQSLKQHQIHTQKKPDGCSECGGSFTQKSHLFAQQRIHSVGNLHECGKCGKAFMPQLKLSVYLTDHTGDIPCICKECGKVFIQRSELLTHQKTHTRKKPYKCHDCGKAFFQMLSLFRHQRTHSREKLYECSECGKGFSQNSTLIIHQKIHTGERQYACSECGKAFTQKSTLSLHQRIHSGQKSYVCIECGQAFIQKAHLIVHQRSHTGEKPYQCHNCGKSFISKSQLDIHHRIHTGEKPYECSDCGKTFTQKSHLNIHQKIHTGERHHVCSECGKAFNQKSILSMHQRIHTGEKPYKCSECGKAFTSKSQFKEHQRIHTGEKPYVCTECGKAFNGRSNFHKHQITHTRERPFVCYKCGKAFVQKSELITHQRTHMGEKPYECLDCGKSFSKKPQLKVHQRIHTGERPYVCSECGKAFNNRSNFNKHQTTHTRDKSYKCSYSVKGFTKQ

SEQ ID NO: 70366 - protein, 321 aa, Homo sapiens
MAAGWLTTWSQNSVTFQEVAVDFSQEEWALLDPAQKNLYKDVMLENFRNLASVGYQLCRHSLISKVDQEQLKTDERGILQGDCADWETQLKPKDTIAMQNIPGGKTSNGINTNCVRTHSGEMPYECSDCGKAFIFQSSLKKHMRSHTGEKPYECDHCGKSFSQSSHLNVHKRTHTGEKPYDCKECGKAFTVPSSLQKHVRTHTGEKPYECSDCGKAFIDQSSLKKHTRSHTGEKPYECNQCGKSFSTGSYLIVHKRTHTGEKTYECKECGKAFRNSSCLRVHVRTHTGEKPYKCIQCEKAFSTSTNLIMHKRIHNGQKLHE

SEQ ID NO: 70367 - protein, 481 aa, Homo sapiens
MAAGWLTTWSQNSVTFQEVAVDFSQEEWALLDPAQKNLYKDVMLENFRNLASVGYQLCRHSLISKVDQEQLKTDERGILQGDCADWETQLKPKDTIAMQNIPGGKTSNGINTAENQPGEHSLECNHCGKFRKNTRFICTRYCKGEKCYKYIKYSKVFNHPSTLRSHVSIHIGEKTLEFTDCRKAFNQESSLRKHLRTPTGQKFQEYEQCDMSFSLHSSCSVREQIPTGEKGDECSDYGKISPLSVHTKTGSVEEGLECNEHEKTFTDPLSLQNCVRTHSGEMPYECSDCGKAFIFQSSLKKHMRSHTGEKPYECDHCGKSFSQSSHLNVHKRTHTGEKPYDCKECGKAFTVPSSLQKHVRTHTGEKPYECSDCGKAFIDQSSLKKHTRSHTGEKPYECNQCGKSFSTGSYLIVHKRTHTGEKTYECKECGKAFRNSSCLRVHVRTHTGEKPYKCIQCEKAFSTSTNLIMHKRIHNGQKLHE

SEQ ID NO: 70368 - protein, 120 aa, Homo sapiens
MAAGWLTTWSQNSVTFQEVAVDFSQEEWALLDPAQKNLYKDVMLENFRNLASVGYQLCRHSLISKVDQEQLKTDERGILQGDCADWETQLKPKDTIAMQNIPGGKTSNGINTNPHGREFL

SEQ ID NO: 70369 - protein, 321 aa, Homo sapiens; identical to SEQ ID NO: 70366

SEQ ID NO: 70370 - protein, 549 aa, Homo sapiens
MPVDLGQALGLLPSLAKAEDSQFSESDAALQEELSSPETARQLFRQFRYQVMSGPHETLKQLRKLCFQWLQPEVHTKEQILEILMLEQFLTILPGEIQMWVRKQCPGSGEEAVTLVESLKGDPQRLWQWISIQVLGQDILSEKMESPSCQVGEVEPHLEVVPQELGLENSSSGPGELLSHIVKEESDTEAELALAASQPARLEERLIRDQDLGASLLPAAPQEQWRQLDSTQKEQYWDLMLETYGKMVSGAGISHPKSDLTNSIEFGEELAGIYLHVNEKIPRPTCIGDRQENDKENLNLENHRDQELLHASCQASGEVPSQASLRGFFTEDEPGCFGEGENLPEALQNIQDEGTGEQLSPQERISEKQLGQHLPNPHSGEMSTMWLEEKRETSQKGQPRAPMAQKLPTCRECGKTFYRNSQLIFHQRTHTGETYFQCTICKKAFLRSSDFVKHQRTHTGEKPCKCDYCGKGFSDFSGLRHHEKIHTGEKPYKCPICEKSFIQRSNFNRHQRVHTGEKPYKCSHCGKSFSWSSSLDKHQRSHLGKKPFQ

SEQ ID NO: 70371 - protein, 549 aa, Homo sapiens; identical to SEQ ID NO: 70370

SEQ ID NO: 70372 - protein, 692 aa, Homo sapiens
MRACAGSTREAGSGAQDLSTLLCLEESMEEQDEKPPEPPKACAQDSFLPQEIIIKVEGEDTGSLTIPSQEGVNFKIVTVDFTREEQGTWNPAQRTLDRDVILENHRDLVSWDLATAVGKKDSTSKQRIFDEEPANGVKIERFTRDDPWLSSCEEVDDCKDQLEKQQEKQEILLQEVAFTQRKAVIHERVCKSDETGEKSGLNSSLFSSPVIPIRNHFHKHVSHAKKWHLNAAVNSHQKINENETLYENNECGKPPQSIHLIQFTRTQTKDKCYGFSDRIQSFCHGTPLHIHEKIHGGGKTFDFKECGQVLNPKISHNEQQRIPFEESQYKCSETSHSSSLTQNMRNNSEEKPFECNQCGKSFSWSSHLVAHQRTHTGEKPYECSECGKSFSRSSHLVSHQRTHTGEKPYRCNQCGKSFSQSYVLVVHQRTHTGEKPYECNQCGKSFRQSYKLIAHQRTHTGEKPYECNQCGKSFIQSYKLIAHQRIHTGEKPYECNQCGKSFSQSYKLVAHQRTHTGEKPFECNQCGKSFSWSSQLVAHQRTHTGEKPYECSECGKSFNRSSHLVMHQRIHTGEKPYECNQCGKSFSQSYVLVVHQRTHTGEKPYECSQCGKSFRQSSCLTQHQRTHTGEKPFECNQCGKTFSLSARLIVHQRTHTGEKPFTCIQCGKAFINSYKLIRHQATHTEEKLYECN

SEQ ID NO: 70373 - protein, 667 aa, Homo sapiens
MRACAGSTREAGSGAQDLSTLLCLEESMEEQDEKPPEPPKACAQEGVNFKIVTVDFTREEQGTWNPAQRTLDRDVILENHRDLVSWDLATAVGKKDSTSKQRIFDEEPANGVKIERFTRDDPWLSSCEEVDDCKDQLEKQQEKQEILLQEVAFTQRKAVIHERVCKSDETGEKSGLNSSLFSSPVIPIRNHFHKHVSHAKKWHLNAAVNSHQKINENETLYENNECGKPPQSIHLIQFTRTQTKDKCYGFSDRIQSFCHGTPLHIHEKIHGGGKTFDFKECGQVLNPKISHNEQQRIPFEESQYKCSETSHSSSLTQNMRNNSEEKPFECNQCGKSFSWSSHLVAHQRTHTGEKPYECSECGKSFSRSSHLVSHQRTHTGEKPYRCNQCGKSFSQSYVLVVHQRTHTGEKPYECNQCGKSFRQSYKLIAHQRTHTGEKPYECNQCGKSFIQSYKLIAHQRIHTGEKPYECNQCGKSFSQSYKLVAHQRTHTGEKPFECNQCGKSFSWSSQLVAHQRTHTGEKPYECSECGKSFNRSSHLVMHQRIHTGEKPYECNQCGKSFSQSYVLVVHQRTHTGEKPYECSQCGKSFRQSSCLTQHQRTHTGEKPFECNQCGKTFSLSARLIVHQRTHTGEKPFTCIQCGKAFINSYKLIRHQATHTEEKLYECN

SEQ ID NO: 70374 - protein, 615 aa, Homo sapiens
MPQLQYPEGYLAPNRCLVSNCGVNKMSNDELVGQNHGMEGEACIGGDVTFNDVAIDFTHEEWGWLSSAQRDLYKDVMVQNYENLVSVAGLSVTKPYVITLLEDGKEPWMMEKKLSKGMIPDWESRWENKELSTKKDNYDEDSPQTVIIEKVVKQSYEFSNSKKNLEYIEKLEGKHGSQVDHFRPAILTSRESPTADSVYKYNIFRSTFHSKSTLSEPQKISAEGNSHKYDILKKNLPKKSVIKNEKVNGGKKLLNSNKSGAAFSQGKSLTLPQTCNREKIYTCSECGKAFGKQSILNRHWRIHTGEKPYECRECGKTFSHGSSLTRHLISHSGEKPYKCIECGKAFSHVSSLTNHQSTHTGEKPYECMNCGKSFSRVSHLIEHLRIHTQEKLYECRICGKAFIHRSSLIHHQKIHTGEKPYECRECGKAFCCSSHLTRHQRIHTMEKQYECNKCLKVFSSLSFLVQHQSIHTEEKPFECQKCRKSFNQLESLNMHLRNHIRLKPYECSICGKAFSHRSSLLQHHRIHTGEKPYECIKCGKTFSCSSNLTVHQRIHTGEKPYKCNECGKAFSKGSNLTAHQRVHNGEKPNSVVSVEKPLDYMNHYTCEKSYRRETV

SEQ ID NO: 70375 - protein, 467 aa, Homo sapiens
MPQVTFNDVAIDFTHEEWGWLSSAQRDLYKDVMVQNYENLVSVGLSVTKPYVITLLEDGKEPWMMEKKLSKGMIPDWESRWENKELSTKKDNYDEDSPQTVIIEKVVKQSYEFSNSKKNLEYIEKLEGKHGSQVDHFRPAILTSRESPTADSVYKYNIFRSTFHSKSTLSEPQKISAEGNSHKYDILKKNLPKKSVIKNEKVNGGKKLLNSNKSGAAFSQGKSLTLPQTCNREKIYTCSECGKAFGKQSILNRHWRIHTGEKPYECRECGKTFSHGSSLTRHLISHSGEKPYKCIECGKAFSHVSSLTNHQSTHTGEKPYECMNCGKSFSRVSHLIEHLRIHTQEKLYECRICGKAFIHRSSLIHHQKIHTGEKPYECRECGKAFCCSSHLTRHQRIHTMEKQYECNKCLKVFSSLSFLVQHQSIHTEEKPFECQKCRKSFNQLESLNMHLRNHIETLRMQYMWESL

SEQ ID NO: 70376 - protein, 570 aa, Homo sapiens
MPQVTFNDVAIDFTHEEWGWLSSAQRDLYKDVMVQNYENLVSVGLSVTKPYVITLLEDGKEPWMMEKKLSKGMIPDWESRWENKELSTKKDNYDEDSPQTVIIEKVVKQSYEFSNSKKNLEYIEKLEGKHGSQVDHFRPAILTSRESPTADSVYKYNIFRSTFHSKSTLSEPQKISAEGNSHKYDILKKNLPKKSVIKNEKVNGGKKLLNSNKSGAAFSQGKSLTLPQTCNREKIYTCSECGKAFGKQSILNRHWRIHTGEKPYECRECGKTFSHGSSLTRHLISHSGEKPYKCIECGKAFSHVSSLTNHQSTHTGEKPYECMNCGKSFSRVSHLIEHLRIHTQEKLYECRICGKAFIHRSSLIHHQKIHTGEKPYECRECGKAFCCSSHLTRHQRIHTMEKQYECNKCLKVFSSLSFLVQHQSIHTEEKPFECQKCRKSFNQLESLNMHLRNHIRLKPYECSICGKAFSHRSSLLQHHRIHTGEKPYECIKCGKTFSCSSNLTVHQRIHTGEKPYKCNECGKAFSKGSNLTAHQRVHNGEKPNSVVSVEKPLDYMNHYTCEKSYRRETV

SEQ ID NO: 70377 - protein, 571 aa, Homo sapiens
MPQVTFNDVAIDFTHEEWGWLSSAQRDLYKDVMVQNYENLVSVAGLSVTKPYVITLLEDGKEPWMMEKKLSKGMIPDWESRWENKELSTKKDNYDEDSPQTVIIEKVVKQSYEFSNSKKNLEYIEKLEGKHGSQVDHFRPAILTSRESPTADSVYKYNIFRSTFHSKSTLSEPQKISAEGNSHKYDILKKNLPKKSVIKNEKVNGGKKLLNSNKSGAAFSQGKSLTLPQTCNREKIYTCSECGKAFGKQSILNRHWRIHTGEKPYECRECGKTFSHGSSLTRHLISHSGEKPYKCIECGKAFSHVSSLTNHQSTHTGEKPYECMNCGKSFSRVSHLIEHLRIHTQEKLYECRICGKAFIHRSSLIHHQKIHTGEKPYECRECGKAFCCSSHLTRHQRIHTMEKQYECNKCLKVFSSLSFLVQHQSIHTEEKPFECQKCRKSFNQLESLNMHLRNHIRLKPYECSICGKAFSHRSSLLQHHRIHTGEKPYECIKCGKTFSCSSNLTVHQRIHTGEKPYKCNECGKAFSKGSNLTAHQRVHNGEKPNSVVSVEKPLDYMNHYTCEKSYRRETV

SEQ ID NO: 70378 - protein, 639 aa, Homo sapiens
MTPASASGEDSGSFYSWQKAKREQGLVTFEDVAVDFTQEEWQYLNPPQRTLYRDVMLETYSNLVFVGQQVTKPNLILKLEVEECPAEGKIPFWNFPEVCQVDEQIERQHQDDQDKCLLMQVGFSDKKTIITKSARDCHEFGNILHLSTNLVASIQRPDKHESFGNNMVDNLDLFSRSSAENKYDNGCAKLFFHTEYEKTNPGMKPYGYKECGKGLRRKKGLSLHQRIKNGEKPFECTACRKTFSKKSHLIVHWRTHTGEKPFGCTECGKAFSQKSQLIIHLRTHTGERPFECPECGKAFREKSTVIIHYRTHTGEKPYECNECGKAFTQKSNLIVHQKTHTGEKTYECTKCGESFIQKLDLIIHHSTHTGKKPHECNECKKTFSDKSTLIIHQRTHTGEKPHKCTECGKSFNEKSTLIVHQRTHTGEKPYECDVCGKTFTQKSNLGVHQRTHSGEKPFECNECEKAFSQKSYLMLHQRGHTGEKPYECNECEKAFSQKSYLIIHQRTHTEEKPYKCNECGKAFREKSKLIIHQRIHTGEKPYECPVCWKAFSQKSQLIIHQRTHTGEKPYACTECGKAFREKSTFTVHQRTHTGEKPYKCTECGKAFTQKSNLIVHQRTHAGKKAHGRGHTRKSKFMAH

SEQ ID NO: 70379 - protein, 620 aa, Homo sapiens
MAKPQGLVTFEDVAVDFTQEEWQYLNPPQRTLYRDVMLETYSNLVFVGQQVTKPNLILKLEVEECPAEGKIPFWNFPEVCQVDEQIERQHQDDQDKCLLMQVGFSDKKTIITKSARDCHEFGNILHLSTNLVASIQRPDKHESFGNNMVDNLDLFSRSSAENKYDNGCAKLFFHTEYEKTNPGMKPYGYKECGKGLRRKKGLSLHQRIKNGEKPFECTACRKTFSKKSHLIVHWRTHTGEKPFGCTECGKAFSQKSQLIIHLRTHTGERPFECPECGKAFREKSTVIIHYRTHTGEKPYECNECGKAFTQKSNLIVHQKTHTGEKTYECTKCGESFIQKLDLIIHHSTHTGKKPHECNECKKTFSDKSTLIIHQRTHTGEKPHKCTECGKSFNEKSTLIVHQRTHTGEKPYECDVCGKTFTQKSNLGVHQRTHSGEKPFECNECEKAFSQKSYLMLHQRGHTGEKPYECNECEKAFSQKSYLIIHQRTHTEEKPYKCNECGKAFREKSKLIIHQRIHTGEKPYECPVCWKAFSQKSQLIIHQRTHTGEKPYACTECGKAFREKSTFTVHQRTHTGEKPYKCTECGKAFTQKSNLIVHQRTHAGKKAHGRGHTRKSKFMAH

SEQ ID NO: 70380 - protein, 639 aa, Homo sapiens; identical to SEQ ID NO: 70378

SEQ ID NO: 70381 - protein, 751 aa, Homo sapiens
MEDLSSPDSTLLQGGHNLLSSASFQEAVTFKDVIVDFTQEEWKQLDPGQRDLFRDVTLENYTHLVSIGLQVSKPDVISQLEQGTEPWIMEPSIPVGTCADWETRLENSVSAPEPDISEEELSPEVIVEKHKRDDSWSSNLLESWEYEGSLERQQANQQTLPKEIKVTEKTIPSWEKGPVNNEFGKSVNVSSNLVTQEPSPEETSTKRSIKQNSNPVKKEKSCKCNECGKAFSYCSALIRHQRTHTGEKPYKCNECEKAFSRSENLINHQRIHTGDKPYKCDQCGKGFIEGPSLTQHQRIHTGEKPYKCDECGKAFSQRTHLVQHQRIHTGEKPYTCNECGKAFSQRGHFMEHQKIHTGEKPFKCDECDKTFTRSTHLTQHQKIHTGEKTYKCNECGKAFNGPSTFIRHHMIHTGEKPYECNECGKAFSQHSNLTQHQKTHTGEKPYDCAECGKSFSYWSSLAQHLKIHTGEKPYKCNECGKAFSYCSSLTQHRRIHTREKPFECSECGKAFSYLSNLNQHQKTHTQEKAYECKECGKAFIRSSSLAKHERIHTGEKPYQCHECGKTFSYGSSLIQHRKIHTGERPYKCNECGRAFNQNIHLTQHKRIHTGAKPYECAECGKAFRHCSSLAQHQKTHTEEKPYQCNKCEKTFSQSSHLTQHQRIHTGEKPYKCNECDKAFSRSTHLTEHQNTHTGEKPYNCNECRKTFSQSTYLIQHQRIHSGEKPFGCNDCGKSFRYRSALNKHQRLHPGI

SEQ ID NO: 70382 - protein, 667 aa, Homo sapiens
MEDLSSPDSTLLQGGHNLLSSASFQEAVTFKDVIVDFTQEEWKQLDPGQRDLFRDVTLENYTHLVSIGLQVSKPDVISQLEQGTEPWIMEPSIPVGTCADWETRLENSVSAPEPDISEEELSPEVIVEKHKRDDSWSSNLLESWEYEGSLERQQANQQTLPKEIKVTEKTIPSWEKGPVNNEFGKSVNVSSNLVTQEPSPEETSTKRSIKQNSNPVKKEKSCKCNECGKAFSYCSALIRHQRTHTGEKPYKCNECEKAFSRSENLINHQRIHTGDKPYKCDQCGKGFIEGPSLTQHQRIHTGEKPYKCDECGKAFSQRTHLVQHQRIHTGEKPYTCNECGKAFSQRGHFMEHQKIHTGEKPFKCDECDKTFTRSTHLTQHQKIHTGEKTYKCNECGKAFNGPSTFIRHHMIHTGEKPYECNECGKAFSQHSNLTQHQKTHTQEKAYECKECGKAFIRSSSLAKHERIHTGEKPYQCHECGKTFSYGSSLIQHRKIHTGERPYKCNECGRAFNQNIHLTQHKRIHTGAKPYECAECGKAFRHCSSLAQHQKTHTEEKPYQCNKCEKTFSQSSHLTQHQRIHTGEKPYKCNECDKAFSRSTHLTEHQNTHTGEKPYNCNECRKTFSQSTYLIQHQRIHSGEKPFGCNDCGKSFRYRSALNKHQRLHPGI

SEQ ID NO: 70383 - protein, 751 aa, Homo sapiens; identical to SEQ ID NO: 70381

SEQ ID NO: 70384 - protein, 77 aa, Homo sapiens
KAFSQRTHLVQHQRIHTGEKPYTCNECGKAFSQRGHFMEHQKIHTGEKPFKCDECDKTFTRSTHLTTSKNSYWRKNL

SEQ ID NO: 70385 - protein, 584 aa, Homo sapiens
MMENYGNLVSLDVLNRDKDEEPTVKQEIEEIEEEVEPQGVIVTRIKSEIDQDPMGRETFELVGRLDKQRGIFLWEIPRESLTQEQRMFRENTNIIRKRPNSEEKCHKCEECGKGFVRKAHFIQHQRVHTGEKPFQCNECGKSFSRSSFVIEHQRIHTGERPYECNYCGKTFSVSSTLIRHQRIHTGERPYQCNQCKQSFSQRRSLVKHQRIHTGEKPHKCSDCGKAFSWKSHLIEHQRTHTGEKPYHCTKCKKSFSRNSLLVEHQRIHTGERPHKCGECGKAFRLSTYLIQHQKIHTGEKPFLCIECGKSFSRSSFLIEHQRIHTGERPYQCKECGKSFSQLCNLTRHQRIHTGDKPHKCEECGKAFSRSSGLIQHQRIHTREKTYPYNETKESFDPNCSLVIQQEVYPKEKSYKCDECGKTFSVSAHLVQHQRIHTGEKPYLCTVCGKSFSRSSFLIEHQRIHTGERPYLCRQCGKSFSQLCNLIRHQGVHTGNKPHKCDECGKAFSRNSGLIQHQRIHTGEKPYKCEKCDKSFSQQRSLVNHQKIHAEVKTQETHECDACGEAFNCRISLIQHQKLHTAWMQ

SEQ ID NO: 70386 - protein, 626 aa, Homo sapiens
MASPSPPPESKGLLTFEDVAVFFTQEEWDYLDPAQRSLYKDVMMENYGNLVSLDVLNRDKDEEPTVKQEIEEIEEEVEPQGVIVTRIKSEIDQDPMGRETFELVGRLDKQRGIFLWEIPRESLTQEQRMFRENTNIIRKRPNSEEKCHKCEECGKGFVRKAHFIQHQRVHTGEKPFQCNECGKSFSRSSFVIEHQRIHTGERPYECNYCGKTFSVSSTLIRHQRIHTGERPYQCNQCKQSFSQRRSLVKHQRIHTGEKPHKCSDCGKAFSWKSHLIEHQRTHTGEKPYHCTKCKKSFSRNSLLVEHQRIHTGERPHKCGECGKAFRLSTYLIQHQKIHTGEKPFLCIECGKSFSRSSFLIEHQRIHTGERPYQCKECGKSFSQLCNLTRHQRIHTGDKPHKCEECGKAFSRSSGLIQHQRIHTREKTYPYNETKESFDPNCSLVIQQEVYPKEKSYKCDECGKTFSVSAHLVQHQRIHTGEKPYLCTVCGKSFSRSSFLIEHQRIHTGERPYLCRQCGKSFSQLCNLIRHQGVHTGNKPHKCDECGKAFSRNSGLIQHQRIHTGEKPYKCEKCDKSFSQQRSLVNHQKIHAEVKTQETHECDACGEAFNCRISLIQHQKLHTAWMQ

SEQ ID NO: 70387 - protein, 612 aa, Homo sapiens
MASPSPPPESKEEWDYLDPAQRSLYKDVMMENYGNLVSLDVLNRDKDEEPTVKQEIEEIEEEVEPQGVIVTRIKSEIDQDPMGRETFELVGRLDKQRGIFLWEIPRESLTQEQRMFRENTNIIRKRPNSEEKCHKCEECGKGFVRKAHFIQHQRVHTGEKPFQCNECGKSFSRSSFVIEHQRIHTGERPYECNYCGKTFSVSSTLIRHQRIHTGERPYQCNQCKQSFSQRRSLVKHQRIHTGEKPHKCSDCGKAFSWKSHLIEHQRTHTGEKPYHCTKCKKSFSRNSLLVEHQRIHTGERPHKCGECGKAFRLSTYLIQHQKIHTGEKPFLCIECGKSFSRSSFLIEHQRIHTGERPYQCKECGKSFSQLCNLTRHQRIHTGDKPHKCEECGKAFSRSSGLIQHQRIHTREKTYPYNETKESFDPNCSLVIQQEVYPKEKSYKCDECGKTFSVSAHLVQHQRIHTGEKPYLCTVCGKSFSRSSFLIEHQRIHTGERPYLCRQCGKSFSQLCNLIRHQGVHTGNKPHKCDECGKAFSRNSGLIQHQRIHTGEKPYKCEKCDKSFSQQRSLVNHQKIHAEVKTQETHECDACGEAFNCRISLIQHQKLHTAWMQ

SEQ ID NO: 70388 - protein, 458 aa, Homo sapiens
MAAMPLKAQYQEMVTFEDVAVHFTKTEWTGLSPAQRALYRSVMLENFGNLTALGYPVPKPALISLLERGDMAWGLEAQDDPPAERTKNVCKDVETNIDSESTLIQGISEERDGMMSHGQLKSVPQRTDFPETRNVEKHQDIPTVKNIQGKVPRIPCARKPFICEECGKSFSYFSYYARHQRIHTGEKPFECSECGKAFNGNSSLIRHQRIHTGERPYQCEECGRAFNDNANLIRHQRIHSGDRPYYCTECGNSFTSSSEFVIHQRIHTGEKPYECNECGKAFVGNSPLLRHQKIHTGEKPYECNECGKSFGRTSHLSQHQRIHTGEKPYSCKVCGQAFNFHTKLTRHQRIHSEEKPFDCVDCGKAFSAQEQLKRHLRIHTQESSYVCDECGKALTSKRNLHQHQRIHTGEKPYECSKYEKAFGTSSQLGHLEHVYSGEKPVLDICRFGLPEFFTPFYW

SEQ ID NO: 70389 - protein, 578 aa, Homo sapiens
MAEESRKPSAPSPPDQTPEEDLVIVKVEEDHGWDQESSLHESNPLGQEVFRLRFRQLRYQETLGPREALIQLRALCHQWLRPDLNTKEQILELLVLEQFLTILPEELQTLVKEHQLENGEEVVTLLEDLERQIDILGRPVSARVHGHRVLWEEVVHSASAPEPPNTQLQSEATQHKSPVPQESQERAMSTSQSPTRSQKGSSGDQEMTATLLTAGFQTLEKIEDMAVSLIREEWLLDPSQKDLCRDNRPENFRNMFSLGGETRSENRELASKQVISTGIQPHGETAAKCNGDVIRGLEHEEARDLLGRLERQRGNPTQERRHKCDECGKSFAQSSGLVRHWRIHTGEKPYQCNVCGKAFSYRSALLSHQDIHNKVKRYHCKECGKAFSQNTGLILHQRIHTGEKPYQCNQCGKAFSQSAGLILHQRIHSGERPYECNECGKAFSHSSHLIGHQRIHTGEKPYECDECGKTFRRSSHLIGHQRSHTGEKPYKCNECGRAFSQKSGLIEHQRIHTGERPYKCKECGKAFNGNTGLIQHLRIHTGEKPYQCNECGKAFIQRSSLIRHQRIHSGEKSESISV

SEQ ID NO: 70390 - protein, 578 aa, Homo sapiens; identical to SEQ ID NO: 70389

SEQ ID NO: 70391 - protein, 158 aa, Homo sapiens
MAEESRKPSAPSPPDQTPEEDLVIVKVEEDHGWDQESSLHESNPLGQEVFRLRFRQLRYQETLGPREALIQLRALCHQWLRPDLNTKEQILELLVLEQFLTILPEELQTLVKEHQLENGEEVVTLLEDLERQIDILGRPVSRRRSQLAYMDIGYSGRR

SEQ ID NO: 70392 - protein, 394 aa, Homo sapiens
MNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHEMVAHRHRQEVLCKEMVPLAEQTPLTLQSQPKEPQLTCDSAQKCHSIGETDEVTKTEDRELVLRKDCPKIVEPHGKMFNEQTWEVSQQDPSHGEVGEHKDRIERQWGNLLGEGQHKCDECGKSFTQSSGLIRHQRIHTGERPYECNECGKAFSRSSGLFNHRGIHNIQKRYHCKECGKVFSQSAGLIQHQRIHKGEKPYQCSQCSKSYSRRSFLIEHQRSHTGERPHQCIECGKSFNRHCNLIRHQKIHTVAELV

SEQ ID NO: 70393 - protein, 41 aa, Homo sapiens
MNTNSKEVLSLGVQVPEAWEELLTMKVEAKSHLQWQESRLK

SEQ ID NO: 70394 - protein, 394 aa, Homo sapiens; identical to SEQ ID NO: 70392

SEQ ID NO: 70395 - protein, 445 aa, Homo sapiens
MNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHEMVAHRHRQEVLCKEMVPLAEQTPLTLQSQPKEPQLTCDSAQKCHSIGETDLIRSLRRRAVLIPLGAHLFSTDTFLFSKPVVIPQLKGGGETWPNNRGVLRDEVTKTEDRELVLRKDCPKIVEPHGKMFNEQTWEVSQQDPSHGEVGEHKDRIERQWGNLLGEGQHKCDECGKSFTQSSGLIRHQRIHTGERPYECNECGKAFSRSSGLFNHRGIHNIQKRYHCKECGKVFSQSAGLIQHQRIHKGEKPYQCSQCSKSYSRRSFLIEHQRSHTGERPHQCIECGKSFNRHCNLIRHQKIHTVAELV

SEQ ID NO: 70396 - protein, 606 aa, Homo sapiens
MTLLTFRDVAIEFSLEEWKCLDLAQQNLYRDVMLENYRNLFSVGLTVCKPGLITCLEQRKEPWNVKRQEAADGHPEMGFHHATQACLELLGSSDLPASASQSAGITGVNHRAQPGLNVSVDKFTAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAGGEHYRCEEFGKVFNQCSHLTEHEHGTEEKPCKYEECSSVFISCSSLSNQQMILAGEKLSKCETWYKGFNHSPNPSKHQRNEIGGKPFKCEECDSIFKWFSDLTKHKRIHTGEKPYKCDECGKAYTQSSHLSEHRRIHTGEKPYQCEECGKVFRTCSSLSNHKRTHSEEKPYTCEECGNIFKQLSDLTKHKKTHTGEKPYKCDECGKNFTQSSNLIVHKRIHTGEKPYKCEECGRVFMWFSDITKHKKTHTGEKPYKCDECGKNFTQSSNLIVHKRIHTGEKPYKCEKCGKAFTQFSHLTVHESIHT

SEQ ID NO: 70397 - protein, 561 aa, Homo sapiens
MAGAQTLLTFRDVAIEFSLEEWKCLDLAQQNLYRDVMLENYRNLFSVGLTVCKPGLITCLEQRKEPWNVKRQEAADGHPAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAGGEHYRCEEFGKVFNQCSHLTEHEHGTEEKPCKYEECSSVFISCSSLSNQQMILAGEKLSKCETWYKGFNHSPNPSKHQRNEIGGKPFKCEECDSIFKWFSDLTKHKRIHTGEKPYKCDECGKAYTQSSHLSEHRRIHTGEKPYQCEECGKVFRTCSSLSNHKRTHSEEKPYTCEECGNIFKQLSDLTKHKKTHTGEKPYKCDECGKNFTQSSNLIVHKRIHTGEKPYKCEECGRVFMWFSDITKHKKTHTGEKPYKCDECGKNFTQSSNLIVHKRIHTGEKPYKCEKCGKAFTQFSHLTVHESIHT

SEQ ID NO: 70398 - protein, 557 aa, Homo sapiens
MTLLTFRDVAIEFSLEEWKCLDLAQQNLYRDVMLENYRNLFSVGLTVCKPGLITCLEQRKEPWNVKRQEAADGHPAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAGGEHYRCEEFGKVFNQCSHLTEHEHGTEEKPCKYEECSSVFISCSSLSNQQMILAGEKLSKCETWYKGFNHSPNPSKHQRNEIGGKPFKCEECDSIFKWFSDLTKHKRIHTGEKPYKCDECGKAYTQSSHLSEHRRIHTGEKPYQCEECGKVFRTCSSLSNHKRTHSEEKPYTCEECGNIFKQLSDLTKHKKTHTGEKPYKCDECGKNFTQSSNLIVHKRIHTGEKPYKCEECGRVFMWFSDITKHKKTHTGEKPYKCDECGKNFTQSSNLIVHKRIHTGEKPYKCEKCGKAFTQFSHLTVHESIHT

SEQ ID NO: 70399 - protein, 629 aa, Homo sapiens
MTLLTFRDVAIEFSLEEWKCLDLAQQNLYRDVMLENYRNLFSVGLTVCKPGLITCLEQRKEPWNVKRQEAADGHPEMGFHHATQACLELLGSSDLPASASQSAGITGVNHRAQPGLNVSVDKFTALCSPGVLQTVKWFLEFRCIFSLAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAGGEHYRCEEFGKVFNQCSHLTEHEHGTEEKPCKYEECSSVFISCSSLSNQQMILAGEKLSKCETWYKGFNHSPNPSKHQRNEIGGKPFKCEECDSIFKWFSDLTKHKRIHTGEKPYKCDECGKAYTQSSHLSEHRRIHTGEKPYQCEECGKVFRTCSSLSNHKRTHSEEKPYTCEECGNIFKQLSDLTKHKKTHTGEKPYKCDECGKNFTQSSNLIVHKRIHTGEKPYKCEECGRVFMWFSDITKHKKTHTGEKPYKCDECGKNFTQSSNLIVHKRIHTGEKPYKCEKCGKAFTQFSHLTVHESIHT

SEQ ID NO: 70400 - protein, 561 aa, Homo sapiens; identical to SEQ ID NO: 70397

SEQ ID NO: 70401 - protein, 610 aa, Homo sapiens
MAGAQTLLTFRDVAIEFSLEEWKCLDLAQQNLYRDVMLENYRNLFSVGLTVCKPGLITCLEQRKEPWNVKRQEAADGHPEMGFHHATQACLELLGSSDLPASASQSAGITGVNHRAQPGLNVSVDKFTAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAGGEHYRCEEFGKVFNQCSHLTEHEHGTEEKPCKYEECSSVFISCSSLSNQQMILAGEKLSKCETWYKGFNHSPNPSKHQRNEIGGKPFKCEECDSIFKWFSDLTKHKRIHTGEKPYKCDECGKAYTQSSHLSEHRRIHTGEKPYQCEECGKVFRTCSSLSNHKRTHSEEKPYTCEECGNIFKQLSDLTKHKKTHTGEKPYKCDECGKNFTQSSNLIVHKRIHTGEKPYKCEECGRVFMWFSDITKHKKTHTGEKPYKCDECGKNFTQSSNLIVHKRIHTGEKPYKCEKCGKAFTQFSHLTVHESIHT

SEQ ID NO: 70402 - protein, 131 aa, Homo sapiens
MAGAQTLLTFRDVAIEFSLEEWKCLDLAQQNLYRDVMLENYRNLFSVGLTVCKPGLITCLEQRKEPWNVKRQEAADGHPAMSSHFTQDLLPEQGIQDAFPKRILRGYGNCGLDNLYLRKDWESLDECKLQK

SEQ ID NO: 70403 - protein, 115 aa, Homo sapiens
MAGAQTLLTFRDVAIEFSLEEWKCLDLAQQNLYRDVMLENYRNLFSVGLTVCKPGLITCLEQRKEPWNVKRQEAADGHPEMGFHHATQACLELLGSSDLPASASQSAGITGVNHR

SEQ ID NO: 70404 - protein, 426 aa, Homo sapiens
MAAVSPTTRCQESVTFEDVAVVFTDEEWSRLVPIQRDLYKEVMLENYNSIVSLGLPVPQPDVIFQLKRGDKPWMVDLHGSEEREWPESVSLDWETKPEIHDASDKKSEGSLRECLGRQSPLCPKFEVHTPNGRMGTEKQSPSGETRKKSLSRDKGLRRRRSALSREILTKERHQECSDCGKTFFDHSSLTRHQRTHTGEKPYDCRECGKAFSHRSSLSRHLMSHTGESPYECSVCSKAFFDRSSLTVHQRIHTGEKPFQCNECGKAFFDRSSLTRHQRIHTGESPYECHQCGKAFSQKSILTRHQLIHTGRKPYECNECGKAFYGVSSLNRHQKAHAGDPRYQCNECGKAFFDRSSLTQHQKIHTGDKPYECSECGKAFSQRCRLTRHQRVHTGEKPFECTVCGKVFSSKSSVIQHQRRYAKQGID

SEQ ID NO: 70405 - protein, 384 aa, Homo sapiens
MLENYNSIVSLGLPVPQPDVIFQLKRGDKPWMVDLHGSEEREWPESVSLDWETKPEIHDASDKKSEGSLRECLGRQSPLCPKFEVHTPNGRMGTEKQSPSGETRKKSLSRDKGLRRRRSALSREILTKERHQECSDCGKTFFDHSSLTRHQRTHTGEKPYDCRECGKAFSHRSSLSRHLMSHTGESPYECSVCSKAFFDRSSLTVHQRIHTGEKPFQCNECGKAFFDRSSLTRHQRIHTGESPYECHQCGKAFSQKSILTRHQLIHTGRKPYECNECGKAFYGVSSLNRHQKAHAGDPRYQCNECGKAFFDRSSLTQHQKIHTGDKPYECSECGKAFSQRCRLTRHQRVHTGEKPFECTVCGKVFSSKSSVIQHQRRYAKQGID

SEQ ID NO: 70406 - protein, 346 aa, Homo sapiens
MLENYNSIVSLDWETKPEIHDASDKKSEGSLRECLGRQSPLCPKFEVHTPNGRMGTEKQSPSGETRKKSLSRDKGLRRRRSALSREILTKERHQECSDCGKTFFDHSSLTRHQRTHTGEKPYDCRECGKAFSHRSSLSRHLMSHTGESPYECSVCSKAFFDRSSLTVHQRIHTGEKPFQCNECGKAFFDRSSLTRHQRIHTGESPYECHQCGKAFSQKSILTRHQLIHTGRKPYECNECGKAFYGVSSLNRHQKAHAGDPRYQCNECGKAFFDRSSLTQHQKIHTGDKPYECSECGKAFSQRCRLTRHQRVHTGEKPFECTVCGKVFSSKSSVIQHQRRYAKQGID

SEQ ID NO: 70407 - protein, 439 aa, Homo sapiens
MAAVSPTTRCQESVTFEDVAVVFTDEEWSRLVPIQRDLYKEVMLENYNSIVSLGLPVPQPDVIFQLKRGDKPWMVDLHGSEEREWPESVSLAQEKNCICFLFVPDWETKPEIHDASDKKSEGSLRECLGRQSPLCPKFEVHTPNGRMGTEKQSPSGETRKKSLSRDKGLRRRRSALSREILTKERHQECSDCGKTFFDHSSLTRHQRTHTGEKPYDCRECGKAFSHRSSLSRHLMSHTGESPYECSVCSKAFFDRSSLTVHQRIHTGEKPFQCNECGKAFFDRSSLTRHQRIHTGESPYECHQCGKAFSQKSILTRHQLIHTGRKPYECNECGKAFYGVSSLNRHQKAHAGDPRYQCNECGKAFFDRSSLTQHQKIHTGDKPYECSECGKAFSQRCRLTRHQRVHTGEKPFECTVCGKVFSSKSSVIQHQRRYAKQGID

SEQ ID NO: 70408 - protein, 536 aa, Homo sapiens
MMFQDSVAFEDVAVSFTQEEWALLDPSQKNLYRDVMQETFKNLTSVGKTWKVQNIEDEYKNPRRNLSLMREKLCESKESHHCGESFNQIADDMLNRKTLPGITPCESSVCGEVGTGHSSLNTHIRADTGHKSSEYQEYGENPYRNKECKKAFSYLDSFQSHDKACTKEKPYDGKECTETFISHSCIQRHRVMHSGDGPYKCKFCGKAFYFLNLCLIHERIHTGVKPYKCKQCGKAFTRSTTLPVHERTHTGVNADECKECGNAFSFPSEIRRHKRSHTGEKPYECKQCGKVFISFSSIQYHKMTHTGEKPYECKQCGKAFRCGSHLQKHGRTHTGEKPYECRQCGKAFRCTSDLQRHEKTHTEDKPYGCKQCGKGFRCASQLQIHERTHSGEKPHECKECGKVFKYFSSLRIHERTHTGEKPHECKQCGKAFRYFSSLHIHERTHTGDKPYECKVCGKAFTCSSSIRYHERTHTGEKPYECKHCGKAFISNYIRYHERTHTGEKPYQCKQCGKAFIVPVHVENMKELIPLIDEKSF

SEQ ID NO: 70409 - protein, 532 aa, Homo sapiens
MMFQDSVAFEDVAVSFTQEEWALLDPSQKNLYRDVMQETFKNLTSVGKTWKVQNIEDEYKNPRRNLSLMREKLCESKESHHCGESFNQIADDMLNRKTLPGITPCESSVCGEVGTGHSSLNTHIRADTGHKSSEYQEYGENPYRNKECKKAFSYLDSFQSHDKACTKEKPYDGKECTETFISHSCIQRHRVMHSGDGPYKCKFCGKAFYFLNLCLIHERIHTGVKPYKCKQCGKAFTRSTTLPVHERTHTGVNADECKECGNAFSFPSEIRRHKRSHTGEKPYECKQCGKVFISFSSIQYHKMTHTGEKPYECKQCGKAFRCGSHLQKHGRTHTGEKPYECRQCGKAFRCTSDLQRHEKTHTEDKPYGCKQCGKGFRCASQLQIHERTHSGEKPHECKECGKVFKYFSSLRIHERTHTGEKPHECKQCGKAFRYFSSLHIHERTHTGDKPYECKVCGKAFTCSSSIRYHERTHTGEKPYECKHCGKAFISNYIRYHERTHTGEKPYQCKQCGKAFIRASSCREHERTHTINR

SEQ ID NO: 70410 - protein, 394 aa, Homo sapiens
MMAAKVVPMPPKPKQSFILRVPPDSKLGQDLLRDATNGPKTIHQLVLEHFLTFLPKPSLVQPSQKVKETLVIMKDVSSSLQNRVHPRPLVKLLPKGVQKEQETVSLYLKANPELVVFEDLNVFHCQEECVSLDPTQQLTSEKEDDSSVGEMMLLAVNGSNPEGEDPEREPVENEDYREKSSDDDEMDSSLVSQQPPDNQEKERLNTSIPQKRKMRNLLVTIENDTPLEELSKYVDISIIALTRNRRTRRWYTCPLCGKQFNESSYLISHQRTHTGEKPYDCNHCGKSFNHKTNLNKHERIHTGEKPYSCSQCGKNFRQNSHRSRHEGIHIREKIFKCPECGKTFPKNEEFVLHLQSHEAERPYGCKKCGRRFGRLSNCTRHEKTHSACKTRKQK

SEQ ID NO: 70411 - protein, 395 aa, Homo sapiens
MMAAKVVPMPPKPKQSFILRVPPDSKLGQDLLRDATNGPKTIHQLVLEHFLTFLPKPSLVQPSQKVKETLVIMKDVSSSLQNRVHPRPLVKLLPKGVQKEQETVSLYLKANPEELVVFEDLNVFHCQEECVSLDPTQQLTSEKEDDSSVGEMMLLAVNGSNPEGEDPEREPVENEDYREKSSDDDEMDSSLVSQQPPDNQEKERLNTSIPQKRKMRNLLVTIENDTPLEELSKYVDISIIALTRNRRTRRWYTCPLCGKQFNESSYLISHQRTHTGEKPYDCNHCGKSFNHKTNLNKHERIHTGEKPYSCSQCGKNFRQNSHRSRHEGIHIREKIFKCPECGKTFPKNEEFVLHLQSHEAERPYGCKKCGRRFGRLSNCTRHEKTHSACKTRKQK

SEQ ID NO: 70412 - protein, 394 aa, Homo sapiens
MMAAKVVPMPPKPKQSFILRVPPDSKLGQDLLRDATNGPKTIHQLVLEHFLTFLPKPSLVQPSQKVKETLVIMKDVSSSLQNRVHPRPLVKLLPKGVQKEQETVSLYLKANPEELVVFEDLNVFHCQEECVSLDPTQQLTSEKEDDSSVGEMMLLVNGSNPEGEDPEREPVENEDYREKSSDDDEMDSSLVSQQPPDNQEKERLNTSIPQKRKMRNLLVTIENDTPLEELSKYVDISIIALTRNRRTRRWYTCPLCGKQFNESSYLISHQRTHTGEKPYDCNHCGKSFNHKTNLNKHERIHTGEKPYSCSQCGKNFRQNSHRSRHEGIHIREKIFKCPECGKTFPKNEEFVLHLQSHEAERPYGCKKCGRRFGRLSNCTRHEKTHSACKTRKQK

SEQ ID NO: 70413 - protein, 394 aa, Homo sapiens; identical to SEQ ID NO: 70412

SEQ ID NO: 70414 - protein, 395 aa, Homo sapiens; identical to SEQ ID NO: 70411

SEQ ID NO: 70415 - protein, 648 aa, Homo sapiens
MATAVEPEDQDLWEEEGILMVKLEDDFTCRPESVLQRDDPVLETSHQNFRRFRYQEAASPREALIRLRELCHQWLRPERRTKEQILELLVLEQFLTVLPGELQSWVRGQRPESGEEAVTLVEGLQKQPRRPRRWVTVHVHGQEVLSEETVHLGVEPESPNELQDPVQSSTPEQSPEETTQSPDLGAPAEQRPHQEEELQTLQESEVPVPEDPDLPAERSSGDSEMVALLTALSQGLVTFKDVAVCFSQDQWSDLDPTQKEFYGEYVLEEDCGIVVSLSFPIPRPDEISQVREEEPWVPDIQEPQETQEPEILSFTYTGDRSKDEEECLEQEDLSLEDIHRPVLGEPEIHQTPDWEIVFEDNPGRLNERRFGTNISQVNSFVNLRETTPVHPLLGRHHDCSVCGKSFTCNSHLVRHLRTHTGEKPYKCMECGKSYTRSSHLARHQKVHKMNAPYKYPLNRKNLEETSPVTQAERTPSVEKPYRCDDCGKHFRWTSDLVRHQRTHTGEKPFFCTICGKSFSQKSVLTTHQRIHLGGKPYLCGECGEDFSEHRRYLAHRKTHAAEELYLCSECGRCFTHSAAFAKHLRGHASVRPCRCNECGKSFSRRDHLVRHQRTHTGEKPFTCPTCGKSFSRGYHLIRHQRTHSEKTS

SEQ ID NO: 70416 - protein, 648 aa, Homo sapiens; identical to SEQ ID NO: 70415

SEQ ID NO: 70417 - protein, 648 aa, Homo sapiens; identical to SEQ ID NO: 70415

SEQ ID NO: 70418 - protein, 554 aa, Homo sapiens
MSADGGGIQDTQDKETPPEVPDRGHPHQEMPSKLGEAVPSGDTQESLHIKMEPEEPHSEGASQEDGAQGAWGWAPLSHGSKEKALFLPGGALPSPRIPVLSREGRTRDRQMAAALLTAWSQMPVTFEDVALYLSREEWGRLDHTQQNFYRDVLQKKNGLSLGFPFSRPFWAPQAHGKGEASGSSRQAGDEKEWRGACTGAVEVGQRVQTSSVAALGNVKPFRTRAGRVQWGVPQCAQEAACGRSSGPAKDSGQPAEPDRTPDAAPPDPSPTEPQEYRVPEKPNEEEKGAPESGEEGLAPDSEVGRKSYRCEQCGKGFSWHSHLVTHRRTHTGEKPYACTDCGKRFGRSSHLIQHQIIHTGEKPYTCPACRKSFSHHSTLIQHQRIHTGEKPYVCDRCAKRFTRRSDLVTHQGTHTGAKPHKCPICAKCFTQSSALVTHQRTHTGVKPYPCPECGKCFSQRSNLIAHNRTHTGEKPYHCLDCGKSFSHSSHLTAHQRTHRGVRPYACPLCGKSFSRRSNLHRHEKIHTTGPKALAMLMLGAAAAGALATPPPAPT

SEQ ID NO: 70419 - protein, 554 aa, Homo sapiens; identical to SEQ ID NO: 70418

SEQ ID NO: 70420 - protein, 279 aa, Homo sapiens
MSADGGGIQDTQDKETPPEVPDRGHPHQEMPSKLGEAVPSGDTQESLHIKMEPEEPHSEGASQEDGAQGAWGWAPLSHGSKEKALFLPGGALPSPRIPVLSREGRTRDRQMAAALLTAWSQMPVTFEDVALYLSREEWGRLDHTQQNFYRDVLQKKNGLSLGFPFSRPFWAPQAHGKGEASGSSRQAGDEKEWRGACTGAVEVGQRVQTSSVAALGNVKPFRTRAGRVQWGVPQCAQEAACGRSSGPAKDSGQPAEPDRTPDAAPPDPSPTEPQEYRVP

SEQ ID NO: 70421 - protein, 118 aa, Homo sapiens
MSADGGGIQDTQDKETPPEVPDRGHPHQEMPSKLGEAVPSGDTQESLHIKMEPEEPHSEGASQEDGAQGAWGWAPLSHGSKEKALFLPGGALPSPRIPVLSREGRTRDRQMAAALLTA

SEQ ID NO: 70422 - protein, 463 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 70423 - protein, 395 aa, Homo sapiens
MGRKKKKQLKPWCWYCNRDFDDEKILIQHQKAKHFKCHICHKKLYTGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 70424 - protein, 478 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 70425 - protein, 494 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 70426 - protein, 447 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGMMPMGGMMPPGPGIPPLMPGMPPGMPPPVPRPGIPPMTQAQAVSAPGILNRPPAPTATVPAPQPPVTKPLFPSAGQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 70427 - protein, 496 aa, Homo sapiens
NTVMGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGLP

SEQ ID NO: 70428 - protein, 1280 aa, Homo sapiens
MGSLTFRDVAIEFSLEEWQCLDTAQQNLYRNVMLENYRNLVFLGIAAFKPDLIIFLEEGKESWNMKRHEMVEESPVICSHFAQDLWPEQGIEDSFQKVILRRYEKCGHENLHLKIGYTNVDECKVHKEGYNKLNQSLTTTQSKVFQRGKYANVFHKCSNSNRHKIRHTGKKHLQCKEYVRSFCMLSHLSQHKRIYTRENSYKCEEGGKAFNWSSTLTYYKSAHTGEKPYRCKECGKAFSKFSILTKHKVIHTGEKSYKCEECGKAFNQSAILTKHKIIHTGEKPNKCEECGKAFSKVSTLTTHKAIHAGEKPYKCKECGKAFSKVSTLITHKAIHAGEKPYKCKECGKAFSKFSILTKHKVIHTGEKPYKCEECGKAYKWPSTLSYHKKIHTGEKPYKCEECGKGFSMFSILTKHEVIHTGEKPYKCEECGKAFNWSSNLMEHKKIHTGETPYKCEECGKGFSMFSILTKHKVIHNGEKPYKCEECDKATHAGEKPYKCEECGKAFNWSSNLMEHKRIHTGEKPYKCEECGKSFSTFSILTKHKVIHTGEKPYKCEECGKAYKWSSTLSYHKKIHTVEKPYKCEECGKAFNQSAILIKHKRIHTGEKPYKCEECGKTFSKVSTLTTHKAIHAGEKPYKCKECGKTFIKVSTLTTHKAIHAGEKPYKCKECGKAFSKFSILTKHKVIHTGEKPYKCEECGKAFNWSSNLMEHKRIHTGEKPYKCEECGKSFSTFSVLTKHKVIHTGEKPYKCEECGKAYKWSSTLSYHKKIHTVEKPYKCEECGKAFNRSAILIKHKRIHTDEKPYKCEECGKTFSKVSTLTTHKAIHAGEKPYKCKECGKAFSKFSILTKHKVIHTGEKPYKCEECGKAYKWPSTLSYHKKIHTGEKPYKCEECGKGFSMFSILTKHEVIHTGEKPYKCEECGKAFSWLSVFSKHKKTHAGEKFYKCEACGKAYKSSSTLSYHKKIHTEEKPYKYEECGKGFSTFSILTKHKVIHTGEKPYKCEECGKAFNWSSNLMEHKKIHTGETPYKCEECDKAFSWPSSLTEHKATHAGEKPYKCEECGKAFSWPSRLTEHKATHAGEEPYKCEECGKAFNWSSNLMEHKRIHTGEKPYKCEECGKSFSTFSILTKHKVIHTGEKPYKCEECGKAYKWSSTLSYHKKIHTVEKPYKCEECGKGFVMFSILAKHKVIHTGEKLYKCEECGKAYKWPSTLRYHKKIHTGEKPYKCEECGKAFSTFSILTKHKVIHTGEKPYKCEECGKAFSWLSVFSKHKKIHTGEKL

SEQ ID NO: 70429 - protein, 40 aa, Homo sapiens
GKGFSMFSILTKHKATHAGEKPYKCEECGKAFNWSSNLME

SEQ ID NO: 70430 - protein, 1167 aa, Homo sapiens [sequence omitted]

SEQ ID NO: 70431 - protein, 495 aa, Homo sapiens
MAESAPARHRRKRRSTPLTSSTLPSQATEKSSYFQTTEISLWTVVAAIQAVEKKMESQAARLQSLEGRTGTAEKKLADCEKMAVEFGNQLEGKWAVLGTLLQEYGLLQRRLENVENLLRNRNFWILRLPPGSKGEAPKVSRSLENDGVCFTEQEWENLEDWQKELYRNVMESNYETLVSLKVLGQTEGEAELGTEMLGDLEEEGPGGAHPAGGVMIKQELQYTQEGPADLPGEFSCIAEEQAFLSPEQTELWGGQGSSVLLETGPGDSTLEEPVGSRVPSSSRTVGCPKQKSHRQVQLDQECGQGLKLKKDTSRPYECSECEITFRYKQQLATHLRSHSGWGSCTPEEPEESLRPRPRLKPQTKKAKLHQCDVCLRSFSCKVSLVTHQRCHLQEGPSAGQHVQERFSPNSLVALPGHIPWRKSRSSLICGYCGKSFSHPSDLVRHQRIHTGERPYSCTECEKSFVQKQHLLQHQKIHQRERGGLALEPGRPNGLL

SEQ ID NO: 70432 - protein, 459 aa, Homo sapiens
MAAPLEAQDQAPGEGEGLLIVKVEDSSWEQESAQHEDGRDSEACRQRFRQFCYGDVHGPHEAFSQLWELCCRWLRPELRTKEQILELLVLEQFLTVLPGEIQGWVREQHPGSGEEAVALVEDLQKQPVKAWRQDVPSEEAEPEAAGRGSQATGPPPTVGARRRPSVPQEQHSHSAQPPALLKEGRPGETTDTCFVSGVHGPVALGDIPFYFSREEWGTLDPAQRDLFWDIKRENSRNTTLGFGLKGQSEKSLLQEMVPVVPGQTGSDVTVSWSPEEAEAWESENRPRAALGPVVGARRGRPPTRRRQFRDLAAEKPHSCGQCGKRFRWGSDLARHQRTHTGEKPHKCPECDKSFRSSSDLVRHQGVHTGEKPFSCSECGKSFSRSAYLADHQRIHTGEKPFGCSDCGKSFSLRSYLLDHRRVHTGERPFGCGECDKSFKQRAHLIAHQSLHAKMAQPVG

SEQ ID NO: 70433 - protein, 301 aa, Homo sapiens
MCPRRRRNPRLQAGDPRPRGLPRRWGHGGGRLFPRSSTAIAGPVALGDIPFYFSREEWGTLDPAQRDLFWDIKRENSRNTTLGFGLKGQSEKSLLQEMVPVVPGQTGSDVTVSWSPEEAEAWESENRPRAALGPVVGARRGRPPTRRRQFRDLAAEKPHSCGQCGKRFRWGSDLARHQRTHTGEKPHKCPECDKSFRSSSDLVRHQGVHTGEKPFSCSECGKSFSRSAYLADHQRIHTGEKPFGCSDCGKSFSLRSYLLDHRRVHTGERPFGCGECDKSFKQRAHLIAHQSLHAKMAQPVG

SEQ ID NO: 70434 - protein, 606 aa, Homo sapiens
MAVTFEDVTIIFTWEEWKFLDSSQKRLYREVMWENYTNVMSVENWNESYKSQEEKFRYLEYENFSYWQGWWNAGAQMYENQNYGETVQGTDSKDLTQQDRSQCQEWLILSTQVPGYGNYELTFESKSLRNLKYKNFMPWQSLETKTTQDYGREIYMSGSHGFQGGRYRLGISRKNLSMEKEQKLIVQHSYIPVEEALPQYVGVICQEDLLRDSMEEKYCGCNKCKGIYYWNSRCVFHKRNQPGENLCQCSICKACFSQRSDLYRHPRNHIGKKLYGCDEVDGNFHQSSGVHFHQRVHIGEVPYSCNACGKSFSQISSLHNHQRVHTEEKFYKIECDKDLSRNSLLHIHQRLHIGEKPFKCNQCGKSFNRSSVLHVHQRVHTGEKPYKCDECGKGFSQSSNLRIHQLVHTGEKSYKCEDCGKGFTQRSNLQIHQRVHTGEKPYKCDDCGKDFSHSSDLRIHQRVHTGEKPYTCPECGKGFSKSSKLHTHQRVHTGEKPYKCEECGKGFSQRSHLLIHQRVHTGEKPYKCHDCGKGFSHSSNLHIHQRVHTGEKPYQCAKCGKGFSHSSALRIHQRVHAGEKPYKCREYYKGFDHNSHLHNNHRRGNL

SEQ ID NO: 70435 - protein, 606 aa, Homo sapiens; identical to SEQ ID NO: 70434

SEQ ID NO: 70436 - protein, 517 aa, Homo sapiens
MQPLSKLMAISKPRNLSLREQREVLRADMSWQQETNPVVETHDSEASRQKFRHFQYLKVSGPHEALSQLWELCLQWLRPEIHTKKQIIELLVLEQFLAILPEEVRTWVNLQHPNNSKDMVTLIEDVIEMLEDEDMPCKDSALQMGSIKEKMKAGSRTGKPQEPVTFKDVVVEFSKEEWGQLDSAVKNLYRNVMLENFRNLNSLRKAHLLSKPFESLKLESKKKRWIMEKEIPRKTIFDMKSISGEESSHGVIMTRLTESGHPSSDAWKGENWLYRNQKKWDINLPQEAFIPETIYTEEEDFECSENKKSFDINSVSSICAIQVGIPSRKGSPKCDKFKTYFKFNLDSVGKQHSEYEYGNDLSLSTDIRHQKSHTTMNSYECYQCGKAFCRSSSLIRHQIIHTGEKPYKCSECGRFFNRRTNLTKHQKLHAEAKACTSNKCGKAFSKSEDSNNPTLHFGNNFYQCVNCGKSFNRSSSLIRHQMIHTGEKPFKCKECSKAFNRSSNLVKHQKLHTRDKS

SEQ ID NO: 70437 - protein, 517 aa, Homo sapiens; identical to SEQ ID NO: 70436

SEQ ID NO: 70438 - protein, 304 aa, Homo sapiens
MQPLSKLMAISKPRNLSLREQREVLRADMSWQQETNPVVETHDSEASRQKFRHFQYLKVSGPHEALSQLWELCLQWLRPEIHTKKQIIELLVLEQFLAILPEEVRTWVNLQHPNNSKDMVTLIEDVIEMLEDEDMPCKDSALQMGSIKEKMKAGSRTGKPQEPVTFKDVVVEFSKEEWGQLDSAVKNLYRNVMLENFRNLNSLRKAHLLSKPFESLKLESKKKRWIMEKEIPRKTIFDMKSISGEESSHGVIMTRLTESGHPSSDAWKDGVSLLLPRLEYNDAVSAHCNLHLWVQVILLPQPPE

SEQ ID NO: 70439 - protein, 1048 aa, Homo sapiens
MQSKVTGNMPTQSLLMYMDGPEVIGSSLGSPMEMEDALSMKGTAVVPFRATQEKNVIQIEGYMPLDCMFCSQTFTHSEDLNKHVLMQHRPTLCEPAVLRVEAEYLSPLDKSQVRTEPPKEKNCKENEFSCEVCGQTFRVAFDVEIHMRTHKDSFTYGCNMCGRRFKEPWFLKNHMRTHNGKSGARSKLQQGLESSPATINEVVQVHAAESISSPYKICMVCGFLFPNKESLIEHRKVHTKKTAFGTSSAQTDSPQGGMPSSREDFLQLFNLRPKSHPETGKKPVRCIPQLDPFTTFQAWQLATKGKVAICQEVKESGQEGSTDNDDSSSEKELGETNKGSCAGLSQEKEKCKHSHGEAPSVDADPKLPSSKEKPTHCSECGKAFRTYHQLVLHSRVHKKDRRAGAESPTMSVDGRQPGTCSPDLAAPLDENGAVDRGEGGSEDGSEDGLPEGIHLDKNDDGGKIKHLTSSRECSYCGKFFRSNYYLNIHLRTHTGEKPYKCEFCEYAAAQKTSLRYHLERHHKEKQTDVAAEVKNDGKNQDTEDALLTADSAQTKNLKRFFDGAKDVTGSPPAKQLKEMPSVFQNVLGSAVLSPAHKDTQDFHKNAADDSADKVNKNPTPAYLDLLKKRSAVETQANNLICRTKADVTPPPDGSTTHNLEVSPKEKQTETAADCRYRPSVDCHEKPLNLSVGALHNCPAISLSKSLIPSITCPFCTFKTFYPEVLMMHQRLEHKYNPDVHKNCRNKSLLRSRRTGCPPALLGKDVPPLSSFCKPKPKSAFPAQSKSLPSAKGKQSPPGPGKAPLTSGIDSSTLAPSNLKSHRPQQNVGVQGAATRQQQSEMFPKTSVSPAPDKTKRPETKLKPLPVAPSQPTLGSSNINGSIDYPAKNDSPWAPPGRDYFCNRSASNTAAEFGEPLPKRLKSSVVALDVDQPGANYRRGYDLPKYHMVRGITSLLPQDCVYPSQALPPKPRFLSSSEVDSPNVLTVQKPYGGSGPLYTCVPAGSPASSSTLEGKRPVSYQHLSNSMAQKRNYENFIGNAHYRPNDKKT

SEQ ID NO: 70440 - protein, 1048 aa, Homo sapiens; identical to SEQ ID NO: 70439

SEQ ID NO: 70441 - protein, 221 aa, Homo sapiens
MFPKTSVSPAPDKTKRPETKLKPLPVAPSQPTLGSSNINGSIDYPAKNDSPWAPPGRDYFCNRSASNTAAEFGEPLPKRLKSSVVALDVDQPGANYRRGYDLPKYHMVRGITSLLPQDCVYPSQALPPKPRFLSSSEVDSPNVLTVQKPYGGSGPLYTCVPAGSPASSSTLEGLGGCQCLLPMKLNFTSSFEKRMVKATEISCDCTVHKTYEESARNTTVV

SEQ ID NO: 70442 - protein, 95 aa, Homo sapiens
MQSKVTGNMPTQSLLMYMDGPEVIGSSLGSPMEMEDALSMKGTAVVPFRATQEKNVIQIEGYMPLDCMFCSQTFTHSEDLNKHVLMQHRPTLCEP

SEQ ID NO: 70443 - protein, 722 aa, Homo sapiens
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPERPRSPAARLLLELEERALLREARLGRARSSGGMQATPATEGLARPQAPSSSAFRCPYCKGKFRTSAERERHLHILHRPWKCGLCSFGSSQEEELLHHSLTAHGAPERPLAATSAAPPPQPQPQPPPQPEPRSVPQPEPEPEPEREATPTPAPAAPEEPPAPPEFRCQVCGQSFTQSWFLKGHMRKHKASFDHACPVCGRCFKEPWFLKNHMKVHASKLGPLRAPGPASGPARAPQPPDLGLLAYEPLGPALLLAPAPTPAERREPPSLLGYLSLRAGEGRPNGEGAEPGPGRSFGGFRPLSSALPARARRHRAEEPEEEEEVVEAEEETWARGRSLGSLASLHPRPGEGPGHSASAAGAQARSTATQEENGLLVGGTRPEGGRGATGKDCPFCGKSFRSAHHLKVHLRVHTGERPYKCPHCDYAGTQSGSLKYHLQRHHREQRSGAGPGPPPEPPPPSQRGSAPQSGAKPSPQPATWVEGASSPRPPSSGAGPGSRRKPASPGRTLRNGRGGEAEPLDLSLRAGPGGEAGPGGALHRCLFCPFATGAPELMALHLQVHHSRRARGRRPPQADASPPYARVPSGETPPSPSQEGEEGSGLSRPGEAGLGGQER

SEQ ID NO: 70444 - protein, 722 aa, Homo sapiens; identical to SEQ ID NO: 70443

SEQ ID NO: 70445 - protein, 722 aa, Homo sapiens; identical to SEQ ID NO: 70443

SEQ ID NO: 70446 - protein, 107 aa, Homo sapiens
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTH

SEQ ID NO: 70447 - protein, 211 aa, Homo sapiens
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPERPRSPAARLLLELEERALLREARLGRARSSGGMQATPATEGLARPQAPSSSAFRCPYCKGKFRTSAERERHLHILHRPWKCGLCSFGSSQEEELLHHSLTA

SEQ ID NO: 70448 - protein, 31 aa, Homo sapiens
MEGSRPRAPSGHLAPSPPAFDGELDLQRYSN

SEQ ID NO: 70449 - protein, 111 aa, Homo sapiens
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPER

SEQ ID NO: 70450 - protein, 224 aa, Homo sapiens
MRLAKPKAGISRSSSQGKAYENKRKTGRQRQKWGMTIRFDSSFSRLRRSLDDKPYKCTECEKSFSQSSTLFQHQKIHTGKKSHKCADCGKSFFQSSNLIQHRRIHTGEKPYKCDECGESFKQSSNLIQHQRIHTGEKPYQCDECGRCFSQSSHLIQHQRTHTGEKPYQCSECGKCFSQSSHLRQHMKVHKEEKPRKTRGKNIRVKTHLPSWKAGTGRKSVAGLR

SEQ ID NO: 70451 - protein, 78 aa, Homo sapiens
MTTFKEAMTFKDVAVVFTEEELGLLDLAQRKLYRDVMLENFRNLLSVGHQAFHRDTFHFLREEKIWMMKTAIQREGNS

SEQ ID NO: 70452 - protein, 707 aa, Homo sapiens
MTTFKEAMTFKDVAVVFTEEELGLLDLAQRKLYRDVMLENFRNLLSVGHQAFHRDTFHFLREEKIWMMKTAIQREGNSGDKIQTEMETVSEAGTHQEWSFQQIWEKIASDLTRSQDLMINSSQFSKEGDFPCQTEAGLSVIHTRQKSSQGNGYKPSFSDVSHFDFHQQLHSGEKSHTCDECGKNFCYISALRIHQRVHMGEKCYKCDVCGKEFSQSSHLQTHQRVHTGEKPFKCVECGKGFSRRSALNVHHKLHTGEKPYNCEECGKAFIHDSQLQEHQRIHTGEKPFKCDICGKSFCGRSRLNRHSMVHTAEKPFRCDTCDKSFRQRSALNSHRMIHTGEKPYKCEECGKGFICRRDLYTHHMVHTGEKPYNCKECGKSFRWASCLLKHQRVHSGEKPFKCEECGKGFYTNSQCYSHQRSHSGEKPYKCVECGKGYKRRLDLDFHQRVHTGEKLYNCKECGKSFSRAPCLLKHERLHSGEKPFQCEECGKRFTQNSHLHSHQRVHTGEKPYKCEKCGKGYNSKFNLDMHQKVHTGERPYNCKECGKSFGWASCLLKHQRLHSGEKPFKCEECGKRFTQNSQLHSHQRVHTGEKPYKCDECGKGFSWSSTRLTHQRRHSRETPLKCEQHGKNIVQNSFSKVQEKVHSVEKPYKCEDCGKGYNRRLNLDMHQRVHMGEKTWKCRECDMCFSQASSLRLHQNVHVGEKP

SEQ ID NO: 70453 - protein, 643 aa, Homo sapiens
MLENYGNVASLGFPLLKPAVISQLEGGSELGGSSPLAAGTGLQGLQTDIQTDNDLTKEMYEGKENVSFELQRDFSQETDFSEASLLEKQQEVHSAGNIKKEKSNTIDGTVKDETSPVEECFFSQSSNSYQCHTITGEQPSGCTGLGKSISFDTKLVKHEIINSEERPFKCEELVEPFRCDSQLIQHQENNTEEKPYQCSECGKAFSINEKLIWHQRLHSGEKPFKCVECGKSFSYSSHYITHQTIHSGEKPYQCKMCGKAFSVNGSLSRHQRIHTGEKPYQCKECGNGFSCSSAYITHQRVHTGEKPYECNDCGKAFNVNAKLIQHQRIHTGEKPYECNECGKGFRCSSQLRQHQSIHTGEKPYQCKECGKGFNNNTKLIQHQRIHTGEKPYECTECGKAFSVKGKLIQHQRIHTGEKPYECNECGKAFRCNSQFRQHLRIHTGEKPYECNECGKAFSVNGKLMRHQRIHTGEKPFECNECGRCFTSKRNLLDHHRIHTGEKPYQCKECGKAFSINAKLTRHQRIHTGEKPFKCMECEKAFSCSSNYIVHQRIHTGEKPFQCKECGKAFHVNAHLIRHQRSHTGEKPFRCVECGKGFSFSSDYIIHQTVHTWKKPYMCSVCGKAFRFSFQLSQHQSVHSEGKS

SEQ ID NO: 70454 - protein, 415 aa, Homo sapiens
CGKAFSINEKLIWHQRLHSGEKPFKCVECGKSFSYSSHYITHQTIHSGEKPYQCKMCGKAFSVNGSLSRHQRIHTGEKPYQCKECGNGFSCSSAYITHQRVHTGEKPYECNDCGKAFNVNAKLIQHQRIHTGEKPYECNECGKGFRCSSQLRQHQSIHTGEKPYQCKECGKGFNNNTKLIQHQRIHTGEKPYECNECGKAFRCNSQFRQHLRIHTGEKPYECNECGKAFSVNGKLMRHQRIHTGEKPFECNECGRCFTSKRNLLDHHRIHTGEKPYQCKECGKAFSINAKLTRHQRIHTGEKPFKCMECEKAFSCSSNYIVHQRIHTGEKPFQCKECGKAFHVNAHLIRHQRSHTGEKPFRCVECGKGFSFSSDYIIHQTVHTWKKPYMCSVCGKAFRFSFQLSQHQSVHSEGKS

SEQ ID NO: 70455 - protein, 643 aa, Homo sapiens; identical to SEQ ID NO: 70453

SEQ ID NO: 70456 - protein, 643 aa, Homo sapiens; identical to SEQ ID NO: 70453

SEQ ID NO: 70457 - protein, 585 aa, Homo sapiens
MYEGKENVSFELQRDFSQETDFSEASLLEKQQEVHSAGNIKKEKSNTIDGTVKDETSPVEECFFSQSSNSYQCHTITGEQPSGCTGLGKSISFDTKLVKHEIINSEERPFKCEELVEPFRCDSQLIQHQENNTEEKPYQCSECGKAFSINEKLIWHQRLHSGEKPFKCVECGKSFSYSSHYITHQTIHSGEKPYQCKMCGKAFSVNGSLSRHQRIHTGEKPYQCKECGNGFSCSSAYITHQRVHTGEKPYECNDCGKAFNVNAKLIQHQRIHTGEKPYECNECGKGFRCSSQLRQHQSIHTGEKPYQCKECGKGFNNNTKLIQHQRIHTGEKPYECTECGKAFSVKGKLIQHQRIHTGEKPYECNECGKAFRCNSQFRQHLRIHTGEKPYECNECGKAFSVNGKLMRHQRIHTGEKPFECNECGRCFTSKRNLLDHHRIHTGEKPYQCKECGKAFSINAKLTRHQRIHTGEKPFKCMECEKAFSCSSNYIVHQRIHTGEKPFQCKECGKAFHVNAHLIRHQRSHTGEKPFRCVECGKGFSFSSDYIIHQTVHTWKKPYMCSVCGKAFRFSFQLSQHQSVHSEGKS

SEQ ID NO: 70458 - protein, 585 aa, Homo sapiens; identical to SEQ ID NO: 70457

SEQ ID NO: 70459 - protein, 1845 aa, Homo sapiens
MGLCGLLERCWLHHDPDGVLTLNAENTNYAYQVPNFHKCEICLLSFPKESQFQRHMRDHERNDKPHRCDQCPQTFNVEFNLTLHKCTHSGEDPTCPVCNKKFSRVASLKAHIMLHEKEENLICSECGDEFTLQSQLAVHMEEHRQELAGTRQHACKACKKEFETSSELKEHMKTHYKIRVSSTRSYNRNIDRSGFTYSCPHCGKTFQKPSQLTRHIRIHTGERPFKCSECGKAFNQKGALQTHMIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGVRPFACPHCDKKFRTSGHRKTHIASHFKHTELRKMRHQRKPAKVRVGKTNIPVPDIPLQEPILITDLGLIQPIPKNQFFQSYFNNNFVNEADRPYKCFYCHRAYKKSCHLKQHIRSHTGEKPFKCSQCGRGFVSAGVLKAHIRTHTGLKSFKCLICNGAFTTGGSLRRHMGIHNDLRPYMCPYCQKTFKTSLNCKKHMKTHRYELAQQLQQHQQAASIDDSTVDQQSMQASTQMQVEIESDELPQTAEVVAANPEAMLDLEPQHVVGTEEAGLGQQLADQPLEADEDGFVAPQDPLRGHVDQFEEQSPAQQSFEPAGLPQGFTVTDTYHQQPQFPPVQQLQDSSTLESQALSTSFHQQSLLQAPSSDGMNVTTRLIQESSQEELDLQAQGSQFLEDNEDQSRRSYRCDYCNKGFKKSSHLKQHVRSHTGEKPYKCKLCGRGFVSSGVLKSHEKTHTGVKAFSCSVCNASFTTNGSLTRHMATHMSMKPYKCPFCEEGFRTTVHCKKHMKRHQTVPSAVSATGETEGGDICMEEEEEHSDRNASRKSRPEVITFTEEETAQLAKIRPQESATVSEKVLVQSAAEKDRISELRDKQAELQDEPKHANCCTYCPKSFKKPSDLVRHVRIHTGEKPYKCDECGKSFTVKSTLDCHVKTHTGQKLFSCHVCSNAFSTKGSLKVHMRLHTGAKPFKCPHCELRFRTSGRRKTHMQFHYKPDPKKARKPMTRSSSEGLQPVNLLNSSSTDPNVFIMNNSVLTGQFDQNLLQPGLVGQAILPASVSAGGDLTVSLTDGSLATLEGIQLQLAANLVGPNVQISGIDAASINNITLQIDPSILQQTLQQGNLLAQQLTGEPGLAPQNSSLQTSDSTVPASVVIQPISGLSLQPTVTSANLTIGPLSEQDSVLTTNSSGTQDLTQVMTSQGLVSPSGGPHEITLTINNSSLSQVLAQAAGPTATSSSGSPQEITLTISELNTTSGSLPSTTPMSPSAISTQNLVMSSSGVGGDASVTLTLADTQGMLSGGLDTVTLNITSQGQQFPALLTDPSLSGQGGAGSPQVILVSHTPQSASAACEEIAYQVAGVSGNLAPGNQPEKEGRAHQCLECDRAFSSAAVLMHHSKEVHGRERIHGCPVCRKAFKRATHLKEHMQTHQAGPSLSSQKPRVFKCDTCEKAFAKPSQLERHSRIHTGERPFHCTLCEKAFNQKSALQVHMKKHTGERPYKCAYCVMGFTQKSNMKLHMKRAHSYAGALQESAGHPEQDGEELSRTLHLEEVVQEAAGEWQALTHVF

SEQ ID NO: 70460 - protein, 1558 aa, Homo sapiens
MGLCGLLERCWLHHDPDGVLTLNAENTNYAYQVPNFHKCEICLLSFPKESQFQRHMRDHERNDKPHRCDQCPQTFNVEFNLTLHKCTHSGEDPTCPVCNKKFSRVASLKAHIMLHEKEENLICSECGDEFTLQSQLAVHMEEHRQELAGTRQHACKACKKEFETSSELKEHMKTHYKIRVSSTRSYNRNIDRSGFTYSCPHCGKTFQKPSQLTRHIRIHTGERPFKCSECGKAFNQKGALQTHMIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGVRPFACPHCDKKFRTSGHRKTHIASHFKHTELRKMRHQRKPAKVRVGKTNIPVPDIPLQEPILITDLGLIQPIPKNQFFQSYFNNNFVNEADRPYKCFYCHRAYKKSCHLKQHIRSHTGEKPFKCSQCGRGFVSAGVLKAHIRTHTGLKSFKCLICNGAFTTGGSLRRHMGIHNDLRPYMCPYCQKTFKTSLNCKKHMKTHRYELAQQLQQHQQAASIDDSTVDQQSMQASTQMQVEIESDELPQTAEVVAANPEAMLDLEPQHVVGTEEAGLGQQLADQPLEADEDGFVAPQDPLRGHVDQFEEQSPAQQSFEPAGLPQGFTVTDTYHQQPQFPPVQQLQDSSTLESQALSTSFHQQSLLQAPSSDGMNVTTRLIQESSQEELDLQAQGSQFLEDNEDQSRRSYRCDYCNKGFKKSSHLKQHVRSHTGEKPYKCKLCGRGFVSSGVLKSHEKTHTGVKAFSCSVCNASFTTNGSLTRHMATHMSMKPYKCPFCEEGFRTTVHCKKHMKRHQTVPSAVSATGETEGGDICMEEEEEHSDRNASRKSRPEVITFTEEETAQLAKIRPQESATVSEKVLVQSAAEKDRISELRDKQAELQDEPKHANCCTYCPKSFKKPSDLVRHVRIHTGEKPYKCDECGKSFTVKSTLDCHVKTHTGQKLFSCHVCSNAFSTKGSLKVHMRLHTGAKPFKCPHCELRFRTSGRRKTHMQFHYKPDPKKARKPMTRSSSEGLQPVNLLNSSSTDPNVFIMNNSVLTGQFDQNLLQPGLVGQAILPASVSAGGDLTVSLTDGSLATLEGIQLQLAANLVGPNVQISGIDAASINNITLQIDPSILQQTLQQGNLLAQQLTGEPGLAPQNSSLQTSDSTVPASVVIQPISGLSLQPTVTSANLTIGPLSEQDSVLTTNSSGTQDLTQVMTSQGLVSPSGGPHEITLTINNSSLSQVLAQAAGPTATSSSGSPQEITLTISGSRSVQHSVGPQECGSVEALYLENSSDKT

SEQ ID NO: 70461 - protein, 1558 aa, Homo sapiens; identical to SEQ ID NO: 70460

SEQ ID NO: 70462 - protein, 531 aa, Homo sapiens
MCPKGYEDSMEFPDHSRHLLQCLSEQRHQGFLCDCTVLVGDAQFRAHRAVLASCSMYFHLFYKDQLDKRDIVHLNSDIVTAPAFALLLEFMYEGKLQFKDLPIEDVLAAASYLHMYDIVKVCKKKLKEKATTEADSTKKEEDASSCSDKVESLSDGSSHIAGDLPSDEDEGEDEKLNILPSKRDLAAEPGNMWMRLPSDSAGIPQAGGEAEPHATAAGKTVASPCSSTESLSQRSVTSVRDSADVDCVLDLSVKSSLSGVENLNSSYFSSQDVLRSNLVQVKVEKEASCDESDVGTNDYDMEHSTVKESVSTNNRVQYEPAHLAPLREDSVLRELDREDKASDDEMMTPESERVQVEGGMESSLLPYVSNILSPAGQIFMCPLCNKVFPSPHILQIHLSTHFREQDGIRSKPAADVNVPTCSLCGKTFSCMYTLKRHERTHSGEKPYTCTQCGKSFQYSHNLSRHAVVHTREKPHACKWCERRFTQSGDLYRHIRKFHCELVNSLSVKSEALSLPTVRDWTLEDSSQELWK

SEQ ID NO: 70463 - protein, 487 aa, Homo sapiens
MCPKGYEDSMEFPDHSRHLLQCLSEQRHQGFLCDCTVLVGDAQFRAHRAVLASCSMYFHLFYKDQLDKRDIVHLNSDIVTAPAFALLLEFMYEGKLQFKDLPIEDVLAAASYLHMYDIVKVCKKKLKEKATTEADSTKKEEDASSCSDKVESLSDGSSHIAGDLPSDEDEGEDEKLNILPSKRDLAAEPGNMWMRLPSDSAGIPQAGGEAEPHATAAGKTVASPCSSTESLSQRSVTSVRDSADVDCVLDLSVKSSLSGVENLNSSYFSSQDVLRSNLVQVKVEKEASCDESDVGTNDYDMEHSTVKESVSTNNRVQYEPAHLAPLREDSVLRELDREDKASDDEMMTPESERVQVEGGMESSLLPYVSNILSPAGQIFMCPLCNKVFPSPHILQIHLSTHFREQDGIRSKPAADVNVPTCSLCGKTFSCMYTLKRHERTHSGEKPYTCTQCGKSFQYSHNLSRLQVVRAQVHAVRGPVQTHSQVPL

SEQ ID NO: 70464 - protein, 458 aa, Homo sapiens
MASTITGSQDCIVNHRGEVDGEPELDISPCQQWGEASSPISRNRDSVMTLQSGCFENIESETYLPLKVSSQIDTQDSSVKFCKNEPQDHQESRRLFVMEESTERKVIKGESCSENLQVKLVSDGQELASPLLNGEATCQNGQLKESLDPIDCNCKDIHGWKSQVVSCSQQRAHTEEKPCDHNNCGKILNTSPDGHPYEKIHTAEKQYECSQCGKNFSQSSELLLHQRDHTEEKPYKCEQCGKGFTRSSSLLIHQAVHTDEKPYKCDKCGKGFTRSSSLLIHHAVHTGEKPYKCDKCGKGFSQSSKLHIHQRVHTGEKPYECEECGMSFSQRSNLHIHQRVHTGERPYKCGECGKGFSQSSNLHIHRCIHTGEKPYQCYECGKGFSQSSDLRIHLRVHTGEKPYHCGKCGKGFSQSSKLLIHQRVHTGEKPYECSKCGKGFSQSSNLHIHQRVHKKDPR

SEQ ID NO: 70465 - protein, 458 aa, Homo sapiens; identical to SEQ ID NO: 70464

SEQ ID NO: 70466 - protein, 458 aa, Homo sapiens; identical to SEQ ID NO: 70464

SEQ ID NO: 70467 - protein, 458 aa, Homo sapiens; identical to SEQ ID NO: 70464

SEQ ID NO: 70468 - protein, 458 aa, Homo sapiens; identical to SEQ ID NO: 70464

SEQ ID NO: 70469 - protein, 368 aa, Homo sapiens
MSAQSVEEDSILIIPTPDEEEKILRVKLEEDPDGEEGSSIPWNHLPDPEIFRQRFRQFGYQDSPGPREAVSQLRELCRLWLRPETHTKEQILELVVLEQFVAILPKELQTWVRDHHPENGEEAVTVLEDLESELDDPGQPVSLRRRKREVLVEDMVSQEEAQGLPSSELDAVENQLKWASWELHSLRHCDDDGRTENGALAPKQELPSALESHEVPGTLNMGVPQIFKYGETCFPKGRFERKRNPSRKKQHICDECGKHFSQGSALILHQRIHSGEKPYGCVECGKAFSRSSILVQHQRVHTGEKPYKCLECGKAFSQNSGLINHQRIHTGEKPYECVQCGKSYSQSSNLFRHQRRHNAEKLLNVVKV

SEQ ID NO: 70470 - protein, 368 aa, Homo sapiens; identical to SEQ ID NO: 70469

SEQ ID NO: 70471 - protein, 456 aa, Homo sapiens
MNKFQGPVTLKDVIVEFTKEEWKLLTPAQRTLYKDVMLENYSHLVSVGYHVNKPNAVFKLKQGKEPWILEVEFPHRGFPEDLWSIHDLEARYQESQAGNSRNGELTKHQKTHTTEKACECKECGKFFCQKSALIVHQHTHSKGKSYDCDKCGKSFSKNEDLIRHQKIHTRDKTYECKECKKIFYHLSSLSRHLRTHAGEKPYECNQCEKSFYQKPHLTEHQKTHTGEKPFECTECGKFFYVKAYLMVHQKTHTGEKPYECKECGKAFSQKSHLTVHQRMHTGEKPYKCKECGKFFSRNSHLKTHQRSHTGEKPYECKECRKCFYQKSALTVHQRTHTGEKPFECNKCGKTFYYKSDLTKHQRKHTGEKPYECTECGKSFAVNSVLRLHQRTHTGEKPYACKECGKSFSQKSHFIIHQRKHTGEKPYECQECGETFIQKSQLTAHQKTHTKKRNAEK

SEQ ID NO: 70472 - protein, 420 aa, Homo sapiens
MLENYSHLVSVGYHVNKPNAVFKLKQGKEPWILEVEFPHRGFPEDLWSIHDLEARYQESQAGNSRNGELTKHQKTHTTEKACECKECGKFFCQKSALIVHQHTHSKGKSYDCDKCGKSFSKNEDLIRHQKIHTRDKTYECKECKKIFYHLSSLSRHLRTHAGEKPYECNQCEKSFYQKPHLTEHQKTHTGEKPFECTECGKFFYVKAYLMVHQKTHTGEKPYECKECGKAFSQKSHLTVHQRMHTGEKPYKCKECGKFFSRNSHLKTHQRSHTGEKPYECKECRKCFYQKSALTVHQRTHTGEKPFECNKCGKTFYYKSDLTKHQRKHTGEKPYECTECGKSFAVNSVLRLHQRTHTGEKPYACKECGKSFSQKSHFIIHQRKHTGEKPYECQECGETFIQKSQLTAHQKTHTKKRNAEK

SEQ ID NO: 70473 - protein, 499 aa, Homo sapiens
MGPLQFRDVAIEFSLEEWHCLDTAQRNLYRDVMLENYRNLVFLGIVVSKPDLVTCLEQGKKPLTMERHEMIAKPPVMSSHFAQDLWPENIQNSFQIGMLRRYEECRHDNLQLKKGCKSVGEHKVHKGGYNGLNQCLTTTQKEIFQCDKYGKVFHKFSNSNTYKTRHTGINLFKCIICGKAFKRSSTLTTHKKIHTGEKPYRCEECGKAFNQSANLTTHKRIHTGEKPYRCEECGKAFKQSSNLTTHKKIHTGEKPYKCEECGKAFNRSTDLTTHKIVHTGEKPYKCEECGKAFKHPSHVTTHKKIHTRGKPYNCEECGKSFKHCSNLTIHKRIHTGEKPYKCEECGKAFHLSSHLTTHKILHTGEKPYRCRECGKAFNHSTTLFSHEKIHTGEKPYKCDECGKTFTWPSILSKHKRTHTGEKPYKCEECGKSFTASSTLTTHKRIHTGEKPYKCEECGKAFNWSSDLNKHKKIHIERKPYIVKNVTDLLNVPPLLISIR

SEQ ID NO: 70474 - protein, 499 aa, Homo sapiens; identical to SEQ ID NO: 70473

SEQ ID NO: 70475 - protein, 91 aa, Homo sapiens
MPGPPRSLEMGLLTFRDVAIEFSLEEWQHLDIAQQNLYRNVMLENYRNLAFLGIAVSKPDLITCLEQGKEPWNMKRHEMVDEPPGLDFSLL

SEQ ID NO: 70476 - protein, 574 aa, Homo sapiens
MCPHFAQDLWPEQGMEDSFQKAILRRYGKYGHENLQLRKGCKSVDEYKVNKEGYNGLNQCFTTAQSKVFQCDKYLKVFYKFLNSNRPKIRHTEKKSFKCKKRVKLFCMLSHKTQHKSIYHREKSYKCKECGKTFNWSSTLTNHRKIYTEEKPYKCEEYNKSPKQLSTLTTHEIIHAGEKLYKCEECGEAFNRSSNLTTHKIIHTGEKPYKCEECGKAFIWSSTLTEHKKIHTRKKPYKCEECGKAFIWSSTLTRHKRMHTGEKPYKCEECGKAFSQSSTLTTHKIIHTGEKRYKCLECGKAFKQLSTLTTHKIIHVGEKLYKCEECGKGFNRSSNLTTHKIIHTGEKPYKCEECGKAFIWSSTLTKHKRIHTREKPYKCEECGKAFIWSSTLTRHKRMHTGEKPYKCEECGKSFSQSSTLTTHKIIHTGEKPYKCEECGKAFNWSSTLTKHKIIHTEEKPYKCEKCGKAFKQSSILTNHKRIHTGEKPYKCEECGKSFNRSSTFTKHKVIHTGVKPYKCEECGKAFFWSSTLTKHKRIHTGEQPYKWEKFGKAFNRSSHLTTDKITHWREILQV

SEQ ID NO: 70477 - protein, 659 aa, Homo sapiens
MPGPPRSLEMGLLTFRDVAIEFSLEEWQHLDIAQQNLYRNVMLENYRNLAFLGIAVSKPDLITCLEQGKEPWNMKRHEMVDEPPGMCPHFAQDLWPEQGMEDSFQKAILRRYGKYGHENLQLRKGCKSVDEYKVNKEGYNGLNQCFTTAQSKVFQCDKYLKVFYKFLNSNRPKIRHTEKKSFKCKKRVKLFCMLSHKTQHKSIYHREKSYKCKECGKTFNWSSTLTNHRKIYTEEKPYKCEEYNKSPKQLSTLTTHEIIHAGEKLYKCEECGEAFNRSSNLTTHKIIHTGEKPYKCEECGKAFIWSSTLTEHKKIHTRKKPYKCEECGKAFIWSSTLTRHKRMHTGEKPYKCEECGKAFSQSSTLTTHKIIHTGEKRYKCLECGKAFKQLSTLTTHKIIHVGEKLYKCEECGKGFNRSSNLTTHKIIHTGEKPYKCEECGKAFIWSSTLTKHKRIHTREKPYKCEECGKAFIWSSTLTRHKRMHTGEKPYKCEECGKSFSQSSTLTTHKIIHTGEKPYKCEECGKAFNWSSTLTKHKIIHTEEKPYKCEKCGKAFKQSSILTNHKRIHTGEKPYKCEECGKSFNRSSTFTKHKVIHTGVKPYKCEECGKAFFWSSTLTKHKRIHTGEQPYKWEKFGKAFNRSSHLTTDKITHWREILQV

SEQ ID NO: 70478 - protein, 351 aa, Homo sapiens
MPGPPRSLEMGLLTFRDVAIEFSLEEWQHLDIAQQNLYRNVMLENYRNLAFLGIAVSKPDLITCLEQGKEPWNMKRHEMVDEPPGMCPHFAQDLWPEQGMEDSFQKAILRRYGKYGHENLQLRKGCKSVDEYKVNKEGYNGLNQCFTTAQSKVFQCDKYLKVFYKFLNSNRPKIRHTEKKSFKCKKRVKLFCMLSHKTQHKSIYHREKSYKCKECGKTFNWSSTLTNHRKIYTEEKPYKCEEYNKSPKQLSTLTTHEIIHAGEKLYKCEECGEAFNRSSTFTKHKVIHTGVKPYKCEECGKAFFWSSTLTKHKRIHTGEQPYKWEKFGKAFNRSSHLTTDKITHWREILQV

SEQ ID NO: 70479 - protein, 627 aa, Homo sapiens
MAAAELTAPAQGIVTFEDVAVYFSWKEWGLLDEAQKCLYHDVMLENLTLTTSLGGSGAGDEEAPYQQSTSPQRVSQVRIPKALPSPQKTNPCEICGPVLRQILHLVEHQGTHHGQKLYTDGACRKQLQFTAYLHQHQKQHVGQKHFRSNGGRDMFLSSCTFEVSGKPFTCKEVGKDFLVRSRFLQQQAAHTRKKSNRTKSAVAFHSVKNHYNWGECVKAFSYKHVRVQHQGDLIRERSYMCSECGKSFSTSCSLSDHLRVHTSEKPYTCGECGKSYRQSSSLITHRRIHTGVRPHQCDECGKLFNRKYDLLIHQRVHTGERPYKCSECGKSFSHSSSLITHQRIHTGMRPYECSECGKSFIHSSSLITHQRVHTGTRPYMCSECGKSFSQSCHLIKHRRLHIGEGPYECSECGKLFTYRSRFFQHQRVHTGVRSHECHECGKLFSRKFDLIVHERVHTGERPYECSECGKSFTCKSYLISHWKVHTGARPYECGECGKSFTHSSTLLQHQRVHTGERPYECNECGKFFSQSSSLIRHRRSHTGERPYECSECWKSFSNHSSLVKHRRVHTGERPYECSECGKSFSQSSNLTNHQRIHSGERPYECSDCGKFFTFNSNLLKHQNVHKG

SEQ ID NO: 70480 - protein, 535 aa, Homo sapiens
MGPLTIRDVTVEFSLEEWHCLDTAQQNLYRDVMLENYRNLVFLGIAVSKPDLITCLEQGKEPCNMKRHEMVAKPPVMCSHIAEDLCPERDIKYFFQKVILRRYDKCEHENLQLRKGCKSVDECKVCKGGYNGLNQCLITTQSKMYQCDKYVKVFYKFSNSDRHKIRHTEKKTCKCKECGKAFNQSSALTRHKMTHTGEKPYKCEECGKAFNRSSHLTQHKVIHTREKPYKCEECGKAFNRSSHITQHKRIHNREKPFKYDECCKAFKWSSALTTLTQHKRIHTGEKPYKCEECGKAFNQSSALTRHKMIHTGEKPFQCEECGKAFNRSSHLTQHKIIHTKEKPYKCEECGKAFNRSSHLTKHKRIHTREKAYKCDEYCKAFNWSSALTTLTQHKIIHTGEKPYKCEECGKAFNRSSYLIRHKIIHTGEKPYKCEECGKAFNQSSHLTQHKIIHTGEKPYKCEECGKAFNRSSHLSQHKIIHTGEKPYKCEECGKPFNRFSYLTVHKRIHAGENPNKYEECGKACNHSSNLTKHNS

SEQ ID NO: 70481 - protein, 563 aa, Homo sapiens
MGPLTIRDVTVEFSLEEWHCLDTAQQNLYRDVMLENYRNLVFLGIAVSKPDLITCLEQGKEPCNMKRHEMVAKPPVMCSHIAEDLCPERDIKYFFQKVILRRYDKCEHENLQLRKGCKSVDECKVCKGGYNGLNQCLITTQSKMYQCDKYVKVFYKFSNSDRHKIRHTEKKTCKCKECGKSFCMLSQLTRHKRIHIRENSHKCEECGKAFNQSSALTRHKMTHTGEKPYKCEECGKAFNRSSHLTQHKVIHTREKPYKCEECGKAFNRSSHITQHKRIHNREKPFKYDECCKAFKWSSALTTLTQHKRIHTGEKPYKCEECGKAFNQSSALTRHKMIHTGEKPFQCEECGKAFNRSSHLTQHKIIHTKEKPYKCEECGKAFNRSSHLTKHKRIHTREKAYKCDEYCKAFNWSSALTTLTQHKIIHTGEKPYKCEECGKAFNRSSYLIRHKIIHTGEKPYKCEECGKAFNQSSHLTQHKIIHTGEKPYKCEECGKAFNRSSHLSQHKIIHTGEKPYKCEECGKPFNRFSYLTVHKRIHAGENPNKYEECGKACNHSSNLTKHNS

SEQ ID NO: 70482 - protein, 563 aa, Homo sapiens; identical to SEQ ID NO: 70481

SEQ ID NO: 70483 - protein, 533 aa, Homo sapiens
MATSFRTASCWGLLSFKDISMEFTWDEWQLLDSTQKYLYRDVILENYHNLISVGYHGTKPDLIFKLEQGEDPWIINAKISRQSCPDGWEEWYQNNQDELESIERSYACSVLGRLNLSKTHDSSRQRLYNTRGKSLTQNSAPSRSYLRKNPDKFHGYEEPYFLKHQRAHSIEKNCVCSECGKAFRCKSQLIVHLRIHTGERPYECSKCERAFSAKSNLNAHQRVHTGEKPYSCSECEKVFSFRSQLIVHQEIHTGGKPYGCSECGKAYSWKSQLLLHQRSHTGVKPYECSECGKAFSLKSPFVVHQRTHTGVKPHKCSECGKAFRSKSYLLVHIRMHTGEKPYQCSDCGKAFNMKTQLIVHQGVHTGNNPYQCGECGKAFGRKEQLTAHLRAHAGEKPYGCSECGKAFSSKSYLVIHRRTHTGERPYECSLCERAFCGKSQLIIHQRTHSTEKPYECNECEKAYPRKASLQIHQKTHSGEKPFKCSECGKAFTQKSSLSEHQRVHTGEKPWKCSECGKSFCWNSGLRIHRKTHK

SEQ ID NO: 70484 - protein, 513 aa, Homo sapiens
MEFTWDEWQLLDSTQKYLYRDVILENYHNLISVGYHGTKPDLIFKLEQGEDPWIINAKISRQSCPDGWEEWYQNNQDELESIERSYACSVLGRLNLSKTHDSSRQRLYNTRGKSLTQNSAPSRSYLRKNPDKFHGYEEPYFLKHQRAHSIEKNCVCSECGKAFRCKSQLIVHLRIHTGERPYECSKCERAFSAKSNLNAHQRVHTGEKPYSCSECEKVFSFRSQLIVHQEIHTGGKPYGCSECGKAYSWKSQLLLHQRSHTGVKPYECSECGKAFSLKSPFVVHQRTHTGVKPHKCSECGKAFRSKSYLLVHIRMHTGEKPYQCSDCGKAFNMKTQLIVHQGVHTGNNPYQCGECGKAFGRKEQLTAHLRAHAGEKPYGCSECGKAFSSKSYLVIHRRTHTGERPYECSLCERAFCGKSQLIIHQRTHSTEKPYECNECEKAYPRKASLQIHQKTHSGEKPFKCSECGKAFTQKSSLSEHQRVHTGEKPWKCSECGKSFCWNSGLRIHRKTHK

SEQ ID NO: 70485 - protein, 412 aa, Homo sapiens
MIGMLESLQHESDLLQHDQIHTGEKPYECNECRKTFSLKQNLVEHKKMHTGEKSHECTECGKVCSRVSSLTLHLRSHTGKKAYKCNKCGKAFSQKENFLSHQKHHTGEKPYECEKVSIQMPTIIRHQKNHTGTKPYACKECGKAFNGKAYLTEHEKIHTGEKPFECNQCGRAFSQKQYLIKHQNIHTGKKPFKCSECGKAFSQKENLIIHQRIHTGEKPYECKGCGKAFIQKSSLIRHQRSHTGEKPYTCKECGKAFSGKSNLTEHEKIHIGEKPYKCNECGTIFRQKQYLIKHHNIHTGEKPYECNKCGKAFSRITSLIVHVRIHTGDKPYECKVCGKAFCQSSSLTVHMRSHTGEKPYGCNECGKAFSQFSTLALHMRIHTGEKPYQCSECGKAFSQKSHHIRHQRIHTH

SEQ ID NO: 70486 - protein, 412 aa, Homo sapiens; identical to SEQ ID NO: 70485

SEQ ID NO: 70487 - protein, 627 aa, Homo sapiens
MAAAVLTDRAQVSVTFDDVAVTFTKEEWGQLDLAQRTLYQEVMLENCGLLVSLGCPVPKAELICHLEHGQEPWTRKEDLSQDTCPGDKGKPKTTEPTTCEPALSEGISLQGQVTQGNSVDSQLGQAEDQDGLSEMQEGHFRPGIDPQEKSPGKMSPECDGLGTADGVCSRIGQEQVSPGDRVRSHNSCESGKDPMIQEEENNFKCSECGKVFNKKHLLAGHEKIHSGVKPYECTECGKTFIKSTHLLQHHMIHTGERPYECMECGKAFNRKSYLTQHQRIHSGEKPYKCNECGKAFTHRSNFVLHNRRHTGEKSFVCTECGQVFRHRPGFLRHYVVHSGENPYECLECGKVFKHRSYLMWHQQTHTGEKPYECSECGKVFLESAALIHHYVIHTGEKPFECLECGKAFNHRSYLKRHQRIHTGEKPFVCSECGKAFTHCSTFILHKRAHTGEKPFECKECGKAFSNRKDLIRHFSIHTGEKPYECVECGKAFTRMSGLTRHKRIHSGEKPYECVECGKSFCWSTNLIRHAIIHTGEKPYKCSECGKAFSRSSSLTQHQRMHTGKNPISVTDVGRPFTSGQTSVTLRELLLGKDFLNVTTEANILPEETSSSASDQPYQRETPQVSSL

SEQ ID NO: 70488 - protein, 627 aa, Homo sapiens; identical to SEQ ID NO: 70487

SEQ ID NO: 70489 - protein, 549 aa, Homo sapiens
MLENYKNLATVGYQLFKPSLISWLEQEESRTVQRGDFQASEWKVQLKTKELALQQDVLGEPTSSGIQMIGSHNGGEVSDVKQCGDVSSEHSCLKTHVRTQNSENTFECYLYGVDFLTLHKKTSTGEQRSVFSQCGKAFSLNPDVVCQRTCTGEKAFDCSDSGKSFINHSHLQGHLRTHNGESLHEWKECGRGFIHSTDLAVRIQTHRSEKPYKCKECGKGFRYSAYLNIHMGTHTGDNPYECKECGKAFTRSCQLTQHRKTHTGEKPYKCKDCGRAFTVSSCLSQHMKIHVGEKPYECKECGIAFTRSSQLTEHLKTHTAKDPFECKICGKSFRNSSCLSDHFRIHTGIKPYKCKDCGKAFTQNSDLTKHARTHSGERPYECKECGKAFARSSRLSEHTRTHTGEKPFECVKCGKAFAISSNLSGHLRIHTGEKPFECLECGKAFTHSSSLNNHMRTHSAKKPFTCMECGKAFKFPTCVNLHMRIHTGEKPYKCKQCGKSFSYSNSFQLHERTHTGEKPYECKECGKAFSSSSSFRNHERRHADERLSA

SEQ ID NO: 70490 - protein, 549 aa, Homo sapiens; identical to SEQ ID NO: 70489

SEQ ID NO: 70491 - protein, 549 aa, Homo sapiens; identical to SEQ ID NO: 70489

SEQ ID NO: 70492 - protein, 743 aa, Homo sapiens
MGLLTFRDVAVEFSLEEWEHLEPAQKNLYQDVMLENYRNLVSLGLVVSKPDLITFLEQRKEPWNVKSEETVAIQPDVFSHYNKDLLTEHCTEASFQKVISRRHGSCDLENLHLRKRWKREECEGHNGCYDEKTFKYDQFDESSVESLFHQQILSSCAKSYNFDQYRKVFTHSSLLNQQEEIDIWGKHHIYDKTSVLFRQVSTLNSYRNVFIGEKNYHCNNSEKTLNQSSSPKNHQENYFLEKQYKCKEFEEVFLQSMHGQEKQEQSYKCNKCVEVCTQSLKHIQHQTIHIRENSYSYNKYDKDLSQSSNLRKQIIHNEEKPYKCEKCGDSLNHSLHLTQHQIIPTEEKPCKWKECGKVFNLNCSLYLTKQQQIDTGENLYKCKACSKSFTRSSNLIVHQRIHTGEKPYKCKECGKAFRCSSYLTKHKRIHTGEKPYKCKECGKAFNRSSCLTQHQTTHTGEKLYKCKVCSKSYARSSNLIMHQRVHTGEKPYKCKECGKVFSRSSCLTQHRKIHTGENLYKCKVCAKPFTCFSNLIVHERIHTGEKPYKCKECGKAFPYSSHLIRHHRIHTGEKPYKCKACSKSFSDSSGLTVHRRTHTGEKPYTCKECGKAFSYSSDVIQHRRIHTGQRPYKCEECGKAFNYRSYLTTHQRSHTGERPYKCEECGKAFNSRSYLTTHRRRHTGERPYKCDECGKAFSYRSYLTTHRRSHSGERPYKCEECGKAFNSRSYLIAHQRSHTREKL

SEQ ID NO: 70493 - protein, 279 aa, Homo sapiens
MGLLTFRDVAVEFSLEEWEHLEPAQKNLYQDVMLENYRNLVSLGLVVSKPDLLTEHCTEASFQKVISRRHGSCDLENLHLRKRWKREECEGHNGCYDEKTFKYDQFDESSVESLFHQQILSSCAKSYNFDQYRKVFTHSSLLNQQEEIDIWGKHHIYDKTSVLFRQVSTLNSYRNVFIGEKNYHCNNSEKTLNQSSSPKNHQENYFLEKQYKCKEFEEVFLQSMHGQEKQEQSYKCNKCVEVCTQSLKHIQHQTIHIRENSYSYNKYDKDLSQSSNLRK

SEQ ID NO: 70494 - protein, 947 aa, Homo sapiens
MATRVRTASIWVPPLQERNSSWDRIRKLQGQESILGQGTPGLQPLPGTPRQKQKSRRIEKVLEWLFISQEQPKITKSWGPLSFMDVFVDFTWEEWQLLDPAQKCLYRSVMLENYSNLVSLGYQHTKPDIIFKLEQGEELCMVQAQVPNQTCPNTVWKIDDLMDWHQENKDKLGSTAKSFECTTFGKLCLLSTKYLSRQKPHKCGTHGKSLKYIDFTSDYARNNPNGFQVHGKSFFHSKHEQTVIGIKYCESIESGKTVNKKSQLMCQQMYMGEKPFGCSCCEKAFSSKSYLLVHQQTHAEEKPYGCNECGKDFSSKSYLIVHQRIHTGEKLHECSECRKTFSFHSQLVIHQRIHTGENPYECCECGKVFSRKDQLVSHQKTHSGQKPYVCNECGKAFGLKSQLIIHERIHTGEKPYECNECQKAFNTKSNLMVHQRTHTGEKPYVCSDCGKAFTFKSQLIVHQGIHTGVKPYGCIQCGKGFSLKSQLIVHQRSHTGMKPYVCNECGKAFRSKSYLIIHTRTHTGEKLHECNNCGKAFSFKSQLIIHQRIHTGENPYECHECGKAFSRKYQLISHQRTHAGEKPYECTDCGKAFGLKSQLIIHQRTHTGEKPFECSECQKAFNTKSNLIVHQRTHTGEKPYSCNECGKAFTFKSQLIVHKGVHTGVKPYGCSQCAKTFSLKSQLIVHQRSHTGVKPYGCSECGKAFRSKSYLIIHMRTHTGEKPHECRECGKSFSFNSQLIVHQRIHTGENPYECSECGKAFNRKDQLISHQRTHAGEKPYGCSECGKAFSSKSYLIIHMRTHSGEKPYECNECGKAFIWKSLLIVHERTHAGVNPYKCSQCEKSFSGKLRLLVHQRMHTREKPYECSECGKAFIRNSQLIVHQRTHSGEKPYGCNECGKTFSQKSILSAHQRTHTGEKPCKCTECGKAFCWKSQLIMHQRTHVDDKH

SEQ ID NO: 70495 - protein, 358 aa, Homo sapiens
MDAKSLTAWSRTLVTFKDVFVDFTREEWKLLDTAQQIVYRNVMLENYKNLVSLGYQLTKPDVILRLEKGEEPWLVEREIHQETHPDSETAFEIKSSVSSRSIFKDKQSCDIKMEGMARNDLWYLSLEEVWKCRDQLDKYQENPERHLSIPRVLSLPARHTKLTVGMATRVRTASIWVPPLQERNSSWDRIRKLQGQESILGQGTPGLQPLPGTPRQKQKSRRIEKVLEWLFISQEQPKITKSWGPLSFMDVFVDFTWEEWQLLDPAQKCLYRSVMLENYSNLVSLGYQHTKPDIIFKLEQGEELCMVQAQVPNQTCPILKAGKSKAKVLAGLVSGEGLLCASKMTPCCCILWRHSLEN

SEQ ID NO: 70496 - protein, 167 aa, Homo sapiens
MATRVRTASIWVPPLQERNSSWDRIRKLQGQESILGQGTPGLQPLPGTPRQKQKSRRIEKVLEWLFISQEQPKITKSWGTNTPNLISSSSWNKEKSCVWCRPKFQIRPVQTQSGKLMILWIGIRKIKTSWEVRQKALNALHLENYVFLVQSIFQDKNLINVARMERV

SEQ ID NO: 70497 - protein, 786 aa, Homo sapiens
MDWHQENKDKLGSTAKSFECTTFGKLCLLSTKYLSRQKPHKCGTHGKSLKYIDFTSDYARNNPNGFQVHGKSFFHSKHEQTVIGIKYCESIESGKTVNKKSQLMCQQMYMGEKPFGCSCCEKAFSSKSYLLVHQQTHAEEKPYGCNECGKDFSSKSYLIVHQRIHTGEKLHECSECRKTFSFHSQLVIHQRIHTGENPYECCECGKVFSRKDQLVSHQKTHSGQKPYVCNECGKAFGLKSQLIIHERIHTGEKPYECNECQKAFNTKSNLMVHQRTHTGEKPYVCSDCGKAFTFKSQLIVHQGIHTGVKPYGCIQCGKGFSLKSQLIVHQRSHTGMKPYVCNECGKAFRSKSYLIIHTRTHTGEKLHECNNCGKAFSFKSQLIIHQRIHTGENPYECHECGKAFSRKYQLISHQRTHAGEKPYECTDCGKAFGLKSQLIIHQRTHTGEKPFECSECQKAFNTKSNLIVHQRTHTGEKPYSCNECGKAFTFKSQLIVHKGVHTGVKPYGCSQCAKTFSLKSQLIVHQRSHTGVKPYGCSECGKAFRSKSYLIIHMRTHTGEKPHECRECGKSFSFNSQLIVHQRIHTGENPYECSECGKAFNRKDQLISHQRTHAGEKPYGCSECGKAFSSKSYLIIHMRTHSGEKPYECNECGKAFIWKSLLIVHERTHAGVNPYKCSQCEKSFSGKLRLLVHQRMHTREKPYECSECGKAFIRNSQLIVHQRTHSGEKPYGCNECGKTFSQKSILSAHQRTHTGEKPCKCTECGKAFCWKSQLIMHQRTHVDDKH

SEQ ID NO: 70498 - protein, 947 aa, Homo sapiens; identical to SEQ ID NO: 70494

SEQ ID NO: 70499 - protein, 730 aa, Homo sapiens
MDWHQENKDKLGSTAKSFECTTFGKLCLLSTKYLSRQKPHKCGTHGKSLKYIDFTSDYARNNPNGFQVHGKSFFHSKHEQTVIGIKYCESIESGKTVNKKSQLMCQQMYMGEKPFGCSCCEKAFSSKSYLLVHQQTHAEEKPYGCNECGKDFSSKSYLIVHQRIHTGEKLHECSECRKTFSFHSQLVIHQRIHTGENPYECCECGKVFSRKDQLVSHQKTHSGQKPYVCNECGKAFGLKSQLIIHERIHTGEKPYECNECQKAFNTKSNLMVHQRTHTGEKPYVCSDCGKAFTFKSQLIVHQGIHTGVKPYGCIQCGKGFSLKSQLIVHQRSHTGMKPYVCNECGKAFRSKSYLIIHTRTHTGEKLHECNNCGKAFSFKSQLIIHQRIHTGENPYECHECGKAFSRKYQLISHQRTHAGEKPYECTDCGKAFGLKSQLIIHQRTHTGEKPFECSECQKAFNTKSNLIVHQRTHTGEKPYSCNECGKAFTFKSQLIVHKGVHTGVKPYGCSQCAKTFSLKSQLIVHQRSHTGVKPYGCSECGKAFRSKSYLIIHMRTHTGEKPHECRECGKSFSFNSQLIVHQRIHTGENPYECSECGKAFNRKDQLISHQRTHAGEKPYGCSECGKAFSSKSYLIIHMRTHSGEKPYECNECGKAFIWKSLLIVHERTHAGVNPYKCSQCEKSFSGKLRLLVHQRMHTREKPYECTECGKAFCWKSQLIMHQRTHVDDKH

SEQ ID NO: 70500 - protein, 100 aa, Homo sapiens
MATRVRTASIWGTNTPNLISSSSWNKEKSCVWCRPKFQIRPVQTQSGKLMILWIGIRKIKTSWEVRQKALNALHLENYVFLVQSIFQDKNLINVARMERV

SEQ ID NO: 70501 - protein, 126 aa, Homo sapiens
MATRVRTASIWGPLSFMDVFVDFTWEEWQLLDPAQKCLYRSVMLENYSNLVSLGYQHTKPDIIFKLEQGEELCMVQAQVPNQTCPILKAGKSKAKVLAGLVSGEGLLCASKMTPCCCILWRHSLEN

SEQ ID NO: 70502 - protein, 68 aa, Homo sapiens
MATRVRTASIWTQSGKLMILWIGIRKIKTSWEVRQKALNALHLENYVFLVQSIFQDKNLINVARMERV

SEQ ID NO: 70503 - protein, 167 aa, Homo sapiens; identical to SEQ ID NO: 70496

SEQ ID NO: 70504 - protein, 126 aa, Homo sapiens; identical to SEQ ID NO: 70501

SEQ ID NO: 70505 - protein, 652 aa, Homo sapiens
MASRLPTAWSCEPVTFEDVTLGFTPEEWGLLDLKQKSLYREVMLENYRNLVSVEHQLSKPDVVSQLEEAEDFWPVERGIPQDTIPEYPELQLDPKLDPLPAESPLMNIEVVEVLTLNQEVAGPRNAQIQALYAEDGSLSADAPSEQVQQQGKHPGDPEAARQRFRQFRYKDMTGPRELDQLRELCHQWLQPKARSKEQILELLVLEQFLGALPVKLRTWVESQHPENCQEVVALVEGVTWMSEEEVLPAGQPAEGTTCCLEVTAQQEEKQEDAAICPVTVLPEEPVTFQDVAVDFSREEWGLLGPTQRTEYRDVMLETFGHLVSVGWETTLENKELAPNSDIPEEEPAPSLKVQESSRDCALSSTLEDTLQGGVQEVQDTVLKQMESAQEKDLPQKKHFDNRESQANSGALDTNQVSLQKIDNPESQANSGALDTNQVLLHKIPPRKRLRKRDSQVKSMKHNSRVKIHQKSCERQKAKEGNGCRKTFSRSTKQITFIRIHKGSQVCRCSECGKIFRNPRYFSVHKKIHTGERPYVCQDCGKGFVQSSSLTQHQRVHSGERPFECQECGRTFNDRSAISQHLRTHTGAKPYKCQDCGKAFRQSSHLIRHQRTHTGERPYACNKCGKAFTQSSHLIGHQRTHNRTKRKKKQPTS

SEQ ID NO: 70506 - protein, 620 aa, Homo sapiens
MASRLPTAWSCEPVTFEDVTLGFTPEEWGLLDLKQKSLYREVMLENYRNLVSVEYPELQLDPKLDPLPAESPLMNIEVVEVLTLNQEVAGPRNAQIQALYAEDGSLSADAPSEQVQQQGKHPGDPEAARQRFRQFRYKDMTGPRELDQLRELCHQWLQPKARSKEQILELLVLEQFLGALPVKLRTWVESQHPENCQEVVALVEGVTWMSEEEVLPAGQPAEGTTCCLEVTAQQEEKQEDAAICPVTVLPEEPVTFQDVAVDFSREEWGLLGPTQRTEYRDVMLETFGHLVSVGWETTLENKELAPNSDIPEEEPAPSLKVQESSRDCALSSTLEDTLQGGVQEVQDTVLKQMESAQEKDLPQKKHFDNRESQANSGALDTNQVSLQKIDNPESQANSGALDTNQVLLHKIPPRKRLRKRDSQVKSMKHNSRVKIHQKSCERQKAKEGNGCRKTFSRSTKQITFIRIHKGSQVCRCSECGKIFRNPRYFSVHKKIHTGERPYVCQDCGKGFVQSSSLTQHQRVHSGERPFECQECGRTFNDRSAISQHLRTHTGAKPYKCQDCGKAFRQSSHLIRHQRTHTGERPYACNKCGKAFTQSSHLIGHQRTHNRTKRKKKQPTS

SEQ ID NO: 70507 - protein, 547 aa, Homo sapiens
MNIEVVEVLTLNQEVAGPRNAQIQALYAEDGSLSADAPSEQVQQQGKHPGDPEAARQRFRQFRYKDMTGPRELDQLRELCHQWLQPKARSKEQILELLVLEQFLGALPVKLRTWVESQHPENCQEVVALVEGVTWMSEEEVLPAGQPAEGTTCCLEVTAQQEEKQEDAAICPVTVLPEEPVTFQDVAVDFSREEWGLLGPTQRTEYRDVMLETFGHLVSVGWETTLENKELAPNSDIPEEEPAPSLKVQESSRDCALSSTLEDTLQGGVQEVQDTVLKQMESAQEKDLPQKKHFDNRESQANSGALDTNQVSLQKIDNPESQANSGALDTNQVLLHKIPPRKRLRKRDSQVKSMKHNSRVKIHQKSCERQKAKEGNGCRKTFSRSTKQITFIRIHKGSQVCRCSECGKIFRNPRYFSVHKKIHTGERPYVCQDCGKGFVQSSSLTQHQRVHSGERPFECQECGRTFNDRSAISQHLRTHTGAKPYKCQDCGKAFRQSSHLIRHQRTHTGERPYACNKCGKAFTQSSHLIGHQRTHNRTKRKKKQPTS

SEQ ID NO: 70508 - protein, 450 aa, Homo sapiens
MAASKTQGAVARMQEDRDGSCSTVGGVGYGDSKDCILEPLSLPESPGGTTTLEGSPSVPCIFCEEHFPVAEQDKLLKHMIIEHKIVIADVKLVADFQRYILYWRKRFTEQPITDFCSVIRINSTAPFEEQENYFLLCDVLPEDRILREELQKQRLREILEQQQQERNDTNFHGVCMFCNEEFLGNRSVILNHMAREHAFNIGLPDNIVNCNEFLCTLQKKLDNLQCLYCEKTFRDKNTLKDHMRKKQHRKINPKNREYDRFYVINYLELGKSWEEVQLEDDRELLDHQEDDWSDWEEHPASAVCLFCEKQAETIEKLYVHMEDAHEFDLLKIKSELGLNFYQQVKLVNFIRRQVHQCRCYGCHVKFKSKADLRTHMEETKHTSLLPDRKTWDQLEYYFPTYENDTLLCTLSDSESDLTAQEQNENVPIISEDTSKLYALKQSSILNQLLL

SEQ ID NO: 70509 - protein, 290 aa, Homo sapiens
MAASKTQGAVARMQEDRDGSCSTVGGVGYGDSKDCILEPLSLPESPGGTTTLEGSPSVPCIFCEEHFPVAEQDKLLKHMIIEHKIVIADVKLVADFQRYILYWRKRFTEQPITDFCSVIRINSTAPFEEQENYFLLCDVLPEDRILREELQKQRLREILEQQQQERNDTNFHGVCMFCNEEFLGNRSVILNHMAREHAFNIGLPDNIVNCNEFLCTLQKKLDNLQCLYCEKTFRDKNTLKDHMRKKQHRKINPKNREYDRFYVINYLVRLSFHNLKFDCSTANKIFLRTN

SEQ ID NO: 70510 - protein, 475 aa, Homo sapiens
MSRRKAGSAPRRVEPAPAANPDDEMEMQDLVIELKPEPDAQPQQAPRLGPFSPKEVSSAGRFGGEPHHSPGPMPAGAALLALGPRNPWTLWTPLTPNYPDRQPWTDKHPDLLTCGRCLQTFPLEAITAFMDHKKLGCQLFRGPSRGQGSEREELKALSCLRCGKQFTVAWKLLRHAQWDHGLSIYQTESEAPEAPLLGLAEVAAAVSAVVGPAAEAKSPRASGSGLTRRSPTCPVCKKTLSSFSNLKVHMRSHTGERPYACDQCPYACAQSSKLNRHKKTHRQVPPQSPLMADTSQEQASAAPPEPAVHAAAPTSTLPCSGGEGAGAAATAGVQEPGAPGSGAQAGPGGDTWGAITTEQRTDPANSQKASPKKMPKSGGKSRGPGGSCEFCGKHFTNSSNLTVHRRSHTGERPYTCEFCNYACAQSSKLNRHRRMHGMTPGSTRFECPHCHVPFGLRATLDKHLRQKHPEAAGEA

SEQ ID NO: 70511 - protein, 451 aa, Homo sapiens
MEMQDLVIELKPEPDAQPQQAPRLGPFSPKEVSSAGRFGGEPHHSPGPMPAGAALLALGPRNPWTLWTPLTPNYPDRQPWTDKHPDLLTCGRCLQTFPLEAITAFMDHKKLGCQLFRGPSRGQGSEREELKALSCLRCGKQFTVAWKLLRHAQWDHGLSIYQTESEAPEAPLLGLAEVAAAVSAVVGPAAEAKSPRASGSGLTRRSPTCPVCKKTLSSFSNLKVHMRSHTGERPYACDQCPYACAQSSKLNRHKKTHRQVPPQSPLMADTSQEQASAAPPEPAVHAAAPTSTLPCSGGEGAGAAATAGVQEPGAPGSGAQAGPGGDTWGAITTEQRTDPANSQKASPKKMPKSGGKSRGPGGSCEFCGKHFTNSSNLTVHRRSHTGERPYTCEFCNYACAQSSKLNRHRRMHGMTPGSTRFECPHCHVPFGLRATLDKHLRQKHPEAAGEA

SEQ ID NO: 70512 - protein, 446 aa, Homo sapiens
METQADLVSQEPQALLDSALPSKVPAFSDKDSLGDEMLAAALLKAKSQELVTFEDVAVYFIRKEWKRLEPAQRDLYRDVMLENYGNVFSLDRETRTENDQEISEDTRSHGVLLGRFQKDISQGLKFKEAYEREVSLKRPLGNSPGERLNRKMPDFGQVTVEEKLTPRGERSEKYNDFGNSFTVNSNLISHQRLPVGDRPHKCDECSKSFNRTSDLIQHQRIHTGEKPYECNECGKAFSQSSHLIQHQRIHTGEKPYECSDCGKTFSCSSALILHRRIHTGEKPYECNECGKTFSWSSTLTHHQRIHTGEKPYACNECGKAFSRSSTLIHHQRIHTGEKPYECNECGKAFSQSSHLYQHQRIHTGEKPYECMECGGKFTYSSGLIQHQRIHTGENPYECSECGKAFRYSSALVRHQRIHTGEKPLNGIGMSKSSLRVTTELNIREST

SEQ ID NO: 70513 - protein, 446 aa, Homo sapiens; identical to SEQ ID NO: 70512

SEQ ID NO: 70514 - protein, 131 aa, Homo sapiens
METQADLVSQEPQALLDSALPSKVPAFSDKDSLGDEMLAAALLKAKSQELVTFEDVAVYFIRKEWKRLEPAQRDLYRDVMLENYGNVFSLDWIHVCLTTQKVMLAWLTGTLSVAKGLCSSELASVEPPDTF

SEQ ID NO: 70515 - protein, 104 aa, Homo sapiens
METQADLVSQEPQALLDSALPSKVPAFSDKDSLGDEMLAAALLKAKSQELVTFEDVAVYFIRKEWKRLEPAQRDLYRDVMLENYGNVFSLDRETRTENDQEISE

SEQ ID NO: 70516 - protein, 446 aa, Homo sapiens; identical to SEQ ID NO: 70512

SEQ ID NO: 70517 - protein, 185 aa, Homo sapiens
METQADLVSQEPQALLDSALPSKVPAFSDKDSLGDEMLAAALLKAKSQELVTFEDVAVYFIRKEWKRLEPAQRDLYRDVMLENYGNVFSLDRETRTENDQEISEDTRSHGVLLGRFQKDISQGLKFKEAYEREVSLKRPLGNSPGERLNRKMPDFGQVTVEEKLTPRGERSEKYNDFGNSFTVNS

SEQ ID NO: 70518 - protein, 185 aa, Homo sapiens; identical to SEQ ID NO: 70517

SEQ ID NO: 70519 - protein, 502 aa, Homo sapiens
MGTENKEVIPKEEISEESEPHGSLLEKFPKVVYQGHEFGAGCEEDMLEGHSRESMEEVIEQMSPQERDFPSGLMIFKKSPSSEKDRENNESERGCSPSPNLVTHQGDTTEGVSAFATSGQNFLEILESNKTQRSSVGEKPHTCKECGKAFNQNSHLIQHMRVHSGEKPFECKECGKTFGTNSSLRRHLRIHAGEKPFACNECGKAFIQSSHLIHHHRIHTGERPYKCEECGKAFSQNSALILHQRIHTGEKPYECNECGKTFRVSSQLIQHQRIHTEERYHECNECGKAFKHSSGLIRHQKIHTGEKPYLCNECGKGFGQSSELIRHQRIHTGDKPYECNECGKTFGQNSEIIRHIRIHTGEKPYVCKECGKAFRGNSELLRHERIHTGEKPYECFECGKAFRRTSHLIVHQRIHTGEKPHQCNECARTFWDNSELLLHQKIHIGEKPYECSECEKTFSQHSQLIIHQRIHTGEKPYECQECQKTFSRSSHLLRHQSVHCME

SEQ ID NO: 70520 - protein, 604 aa, Homo sapiens
MMKSQGLVSFKDVAVDFTQEEWQQLDPSQRTLYRDVMLENYSHLVSMGYPVSKPDVISKLEQGEEPWIIKGDISNWIYPDEYQADGRQDRKSNLHNSQSCILGTVSFHHKILKGVTRDGSLCSILKVCQGDGQLQRFLENQDKLFRQVTFVNSKTVTEASGHKYNPLGKIFQECIETDISIQRFHKYDAFKKNLKPNIDLPSCYKSNSRKKPDQSFGGGKSSSQSEPNSNLEKIHNGVIPFDDNQCGNVFRNTQSLIQYQNVETKEKSCVCVTCGKAFAKKSQLIVHQRIHTGKKPYDCGACGKAFSEKFHLVVHQRTHTGEKPYDCSECGKAFSQKSSLIIHQRVHTGEKPYECSECGKAFSQKSPLIIHQRIHTGEKPYECRECGKAFSQKSQLIIHHRAHTGEKPYECTECGKAFCEKSHLIIHKRIHTGEKPYKCAQCEEAFSRKTELITHQLVHTGEKPYECTECGKTFSRKSQLIIHQRTHTGEKPYKCSECGKAFCQKSHLIGHQRIHTGEKPYICTECGKAFSQKSHLPGHQRIHTGEKPYICAECGKAFSQKSDLVLHQRIHTGERPYQCAICGKAFIQKSQLTVHQRIHTVVKS

SEQ ID NO: 70521 - protein, 604 aa, Homo sapiens [sequence omitted]

SEQ ID NO: 70522 - protein, 568 aa, Homo sapiens
MLENYSHLVSMGYPVSKPDVISKLEQGEEPWIIKGDISNWIYPDEYQADGRQDRKSNLHNSQSCILGTVSFHHKILKGVTRDGSLCSILKVCQGDGQLQRFLENQDKLFRQVTFVNSKTVTEASGHKYNPLGKIFQECIETDISIQRFHKYDAFKKNLKPNIDLPSCYKSNSRKKPDQSFGGGKSSSQSEPNSNLEKIHNGVIPFDDNQCGNVFRNTQSLIQYQNVETKEKSCVCVTCGKAFAKKSQLIVHQRIHTGKKPYDCGACGKAFSEKFHLVVHQRTHTGEKPYDCSECGKAFSQKSSLIIHQRVHTGEKPYECSECGKAFSQKSPLIIHQRIHTGEKPYECRECGKAFSQKSQLIIHHRAHTGEKPYECTECGKAFCEKSHLIIHKRIHTGEKPYKCAQCEEAFSRKTELITHQLVHTGEKPYECTECGKTFSRKSQLIIHQRTHTGEKPYKCSECGKAFCQKSHLIGHQRIHTGEKPYICTECGKAFSQKSHLPGHQRIHTGEKPYICAECGKAFSQKSDLVLHQRIHTGERPYQCAICGKAFIQKSQLTVHQRIHTVVKS

SEQ ID NO: 70523 - protein, 620 aa, Homo sapiens
MVPAETSSSGLLEEQKMMKSQGLVSFKDVAVDFTQEEWQQLDPSQRTLYRDVMLENYSHLVSMGYPVSKPDVISKLEQGEEPWIIKGDISNWIYPDEYQADGRQDRKSNLHNSQSCILGTVSFHHKILKGVTRDGSLCSILKVCQGDGQLQRFLENQDKLFRQVTFVNSKTVTEASGHKYNPLGKIFQECIETDISIQRFHKYDAFKKNLKPNIDLPSCYKSNSRKKPDQSFGGGKSSSQSEPNSNLEKIHNGVIPFDDNQCGNVFRNTQSLIQYQNVETKEKSCVCVTCGKAFAKKSQLIVHQRIHTGKKPYDCGACGKAFSEKFHLVVHQRTHTGEKPYDCSECGKAFSQKSSLIIHQRVHTGEKPYECSECGKAFSQKSPLIIHQRIHTGEKPYECRECGKAFSQKSQLIIHHRAHTGEKPYECTECGKAFCEKSHLIIHKRIHTGEKPYKCAQCEEAFSRKTELITHQLVHTGEKPYECTECGKTFSRKSQLIIHQRTHTGEKPYKCSECGKAFCQKSHLIGHQRIHTGEKPYICTECGKAFSQKSHLPGHQRIHTGEKPYICAECGKAFSQKSDLVLHQRIHTGERPYQCAICGKAFIQKSQLTVHQRIHTVVKS

SEQ ID NO: 70524 - protein, 659 aa, Homo sapiens
MAAAVLMDRVQSCVTFEDVFVYFSREEWELLEEAQRFLYRDVMLENFALVATLGFWCEAEHEAPSEQSVSVEGVSQVRTAESGLFQKAHPCEMCDPLLKDILHLAEHQGSHLTQKLCTRGLCRRRFSFSANFYQHQKQHNGENCFRGDDGGASFVKSCTVHMLGRSFTCREEGMDLPDSSGLFQHQTTYNRVSPCRRTECMESFPHSSSLRQHQGDYDGQMLFSCGDEGKAFLDTFTLLDSQMTHAEVRPFRCLPCGNVFKEKSALINHRKIHSGEISHVCKECGKAFIHLHHLKMHQKFHTGKRHYTCSECGKAFSRKDTLVQHQRVHTGERSYDCSECGKAYSRSSHLVQHQRIHTGERPYKCNKCGKAFSRKDTLVQHQRFHTGERPYECSECGKFFSQSSHLIEHWRIHTGARPYECIECGKFFSHNSSLIKHRRVHTGARSYVCSKCGKAFGCKDTLVQHQIIHTGARPYECSECGKAFSRKDTLVQHQKIHTGERPYECGECGKFFSHSSNLIVHQRIHTGAKPYECNECGKCFSHNSSLILHQRVHTGARPYVCSECGKAYISSSHLVQHKKVHTGARPYECSECGKFFSRNSGLILHQRVHTGEKPYVCSECGKAYSRSSHLVRHQKAHTGERAHECNSFGGPLAASLKLV

SEQ ID NO: 70525 - protein, 659 aa, Homo sapiens; identical to SEQ ID NO: 70524

SEQ ID NO: 70526 - protein, 706 aa, Homo sapiens
MAAAVLMDRVQSCVTFEDVFVYFSREEWELLEEAQRFLYRDVMLENFALVATLAFIFPVPCSCAVGGGRKPWVPDRADITAATVKETYRGHGPAEWELEEGFWCEAEHEAPSEQSVSVEGVSQVRTAESGLFQKAHPCEMCDPLLKDILHLAEHQGSHLTQKLCTRGLCRRRFSFSANFYQHQKQHNGENCFRGDDGGASFVKSCTVHMLGRSFTCREEGMDLPDSSGLFQHQTTYNRVSPCRRTECMESFPHSSSLRQHQGDYDGQMLFSCGDEGKAFLDTFTLLDSQMTHAEVRPFRCLPCGNVFKEKSALINHRKIHSGEISHVCKECGKAFIHLHHLKMHQKFHTGKRHYTCSECGKAFSRKDTLVQHQRVHTGERSYDCSECGKAYSRSSHLVQHQRIHTGERPYKCNKCGKAFSRKDTLVQHQRFHTGERPYECSECGKFFSQSSHLIEHWRIHTGARPYECIECGKFFSHNSSLIKHRRVHTGARSYVCSKCGKAFGCKDTLVQHQIIHTGARPYECSECGKAFSRKDTLVQHQKIHTGERPYECGECGKFFSHSSNLIVHQRIHTGAKPYECNECGKCFSHNSSLILHQRVHTGARPYVCSECGKAYISSSHLVQHKKVHTGARPYECSECGKFFSRNSGLILHQRVHTGEKPYVCSECGKAYSRSSHLVRHQKAHTGERAHECNSFGGPLAASLKLV

SEQ ID NO: 70527 - protein, 595 aa, Homo sapiens
MAALSPTFATSTQDSTCLQDSEFPVSSKDHSCPQNLDLFVCSGLEPHTPSVGSQESVTFQDVAVDFTEKEWPLLDSSQRKLYKDVMLENYSNLTSLGYQVGKPSLISHLEQEEEPRTEERGAHQGACADWETPSKTKWSLLMEDIFGKETPSGVTMERAGLGEKSTEYAHLFEVFGMDPHLTQPMGRHAGKRPYHRRDYGVAFKGRPHLTQHMSMYDGRKMHECHQCQKAFTTSASLTRHRRIHTGEKPYECSDCGKAFNDPSALRSHARTHLKEKPFDCSQCGNAFRTLSALKIHMRVHTGERPYKCDQCGKAYGRSCHLIAHKRTHTGERPYECHDCGKAFQHPSHLKEHVRNHTGEKPYACTQCGKAFRWKSNFNLHKKNHMVEKTYECKECGKSFGDLVSRRKHMRIHIVKKPVECRQCGKTFRNQSILKTHMNSHTGEKPYGCDLCGKAFSASSNLTAHRKIHTQERRYECAACGKVFGDYLSRRRHMSVHLVKKRVECRQCGKAFRNQSTLKTHMRSHTGEKPYECDHCGKAFSIGSNLNVHRRIHTGEKPYECLVCGKAFSDHSSLRSHVKTHRGEKLFVSSVWKRLQ

SEQ ID NO: 70528 - protein, 563 aa, Homo sapiens
MAALSPTFATSTQDSTCLQDSEFPVSSKDHSCPQNLDLFVCSGLEPHTPSVGSQESVTFQDVAVDFTEKEWPLLDSSQRKLYKDVMLENYSNLTSLDWETPSKTKWSLLMEDIFGKETPSGVTMERAGLGEKSTEYAHLFEVFGMDPHLTQPMGRHAGKRPYHRRDYGVAFKGRPHLTQHMSMYDGRKMHECHQCQKAFTTSASLTRHRRIHTGEKPYECSDCGKAFNDPSALRSHARTHLKEKPFDCSQCGNAFRTLSALKIHMRVHTGERPYKCDQCGKAYGRSCHLIAHKRTHTGERPYECHDCGKAFQHPSHLKEHVRNHTGEKPYACTQCGKAFRWKSNFNLHKKNHMVEKTYECKECGKSFGDLVSRRKHMRIHIVKKPVECRQCGKTFRNQSILKTHMNSHTGEKPYGCDLCGKAFSASSNLTAHRKIHTQERRYECAACGKVFGDYLSRRRHMSVHLVKKRVECRQCGKAFRNQSTLKTHMRSHTGEKPYECDHCGKAFSIGSNLNVHRRIHTGEKPYECLVCGKAFSDHSSLRSHVKTHRGEKLFVSSVWKRLQ

SEQ ID NO: 70529 - protein, 122 aa, Homo sapiens
MNFSSHRRRLPSPPLPRSYSQSSTSTQDSTCLQDSEFPVSSKDHSCPQNLDLFVCSGLEPHTPSVGSQESVTFQDVAVDFTEKEWPLLDSSQRKLYKDVMLENYSNLTSLGKASAISPLIHP

SEQ ID NO: 70530 - protein, 273 aa, Homo sapiens
MFGFPTATLLDCHGRYAQNVAFFNVMTEAHHKYDHSEATGSSSWDIQNSFRREKLEQKSPDSKTLQEDSPGVRQRVYECQECGKSFRQKGSLTLHERIHTGQKPFECTHCGKSFRAKGNLVTHQRIHTGEKPYQCKECGKSFSQRGSLAVHERLHTGQKPYECAICQRSFRNQSNLAVHRRVHSGEKPYRCDQCGKAFSQKGSLIVHIRVHTGLKPYACTQCRKSFHTRGNCILHGKIHTGETPYLCGQCGKSFTQRGSLAVHQRSCSQRLTL

SEQ ID NO: 70531 - protein, 273 aa, Homo sapiens; identical to SEQ ID NO: 70530

SEQ ID NO: 70532 - protein, 509 aa, Homo sapiens
MALSQGLLTFRDVAIEFSQEEWKCLDPAQRTLYRDVMLENYRNLVSLDISSKCMMNTLSSTGQGNTEVIHTGTLQRQASYHIGAFCSQEIEKDIHDFVFQWQEDETNDHEAPMTEIKKLTSSTDRYDQRHAGNKPIKGQLESRFHLHLRRHRRIHTGEKPYKCEECEKVFSCKSHLEIHRIIHTGEKPYKCKVCDKAFKHDSHLAKHTRIHRGDKHYTCNECGKVFDQKATLACHHRSHTGEKPYKCNECGKTFSQTSHLVYHHRLHTGEKPYKCNECGKTFARNSVLVIHKAVHTAEKPYKCNECGKVFKQRATLAGHRRVHTGEKPYRCEECDKVFSRKSHLERHRRIHTGEKPYKCKVCDKAFRSDSRLAEHQRVHTGERPYTCNECGKVFSTKAYLACHQKLHTGEKLYECEECDKVYIRKSHLERHRRIHTGEKPHKCGDCGKAFNSPSHLIRHQRIHTGQKSYKCHQCGKVFSLRSLLAEHQKIPFGDNCFKCNEYSKPSSIN

SEQ ID NO: 70533 - protein, 509 aa, Homo sapiens; identical to SEQ ID NO: 70532

SEQ ID NO: 70534 - protein, 402 aa, Homo sapiens
MYTSEEKCNQRTQKRKIYNVCPRKGKKIFIHMHEIIQIDGHIYQCLECKQNFCENLALIMCERTHTGEKPYKCDMCEKTFVQSSDLTSHQRIHNYEKPYKCSKCEKSFWHHLALSGHQRTHAGKKFYTCDICGKNFGQSSDLLVHQRSHTGEKPYLCSECDKCFSRSTNLIRHRRTHTGEKPFKCLECEKAFSGKSDLISHQRTHTGERPYKCNKCEKSYRHRSAFIVHKRVHTGEKPYKCGACEKCFGQKSDLIVHQRVHTGEKPYKCLECMRSFTRSANLIRHQATHTHTFKCLEYEKSFNCSSDLIVHQRIHMEEKPHQWSACESGFLLGMDFVAQQKMRTQTEELHYKYTVCDKSFHQSSALLQHQTVHIGEKPFVCNVSEKGLELSPPHASEASQMS

SEQ ID NO: 70535 - protein, 402 aa, Homo sapiens; identical to SEQ ID NO: 70534

SEQ ID NO: 70536 - protein, 26 aa, Homo sapiens
MYTSEEKCNQRTQKRKIYNVCPRKGK

SEQ ID NO: 70537 - protein, 406 aa, Homo sapiens
MASTEEQYDLKIVKVEEDPIWDQETHLRGNNFSGQEASRQLFRQFCYQETPGPREALSRLRELCHQWLRPEIHTKEQILELLVLEQFLTILPEELQAWVREHHPESGEEAVAVVEDLEQELSEPGNQAPDHEHGHSEVLLEDVEHLKVKQEPTDIQLQPMVTQLRYESFCLHQFQEQDGESIPENQELASKQEILKEMEHLGDSKLQRDVSLDSKYRETCKRDSKAEKQQAHSTGERRHRCNECGKSFTKSSVLIEHQRIHTGEKPYECEECGKAFSRRSSLNEHRRSHTGEKPYQCKECGKAFSASNGLTRHRRIHTGEKPYECKVCGKAFLLSSCLVQHQRIHTGEKRYQCRECGKAFIQNAGLFQHLRVHTGEKPYQCSQCSKLFSKRTLLKKHQKIHTGERP

SEQ ID NO: 70538 - protein, 406 aa, Homo sapiens; identical to SEQ ID NO: 70537

SEQ ID NO: 70539 - protein, 406 aa, Homo sapiens; identical to SEQ ID NO: 70537

SEQ ID NO: 70540 - protein, 107 aa, Homo sapiens
MASTEEQYDLKIVKVEEDPIWDQETHLRGNNFSGQEASRQLFRQFCYQETPGPREALSRLRELCHQWLRPEIHTKEQILELLVLEQFLTILPEELQAWVREHHPESG

SEQ ID NO: 70541 - protein, 78 aa, Homo sapiens
MASTEEQYDLKIVKVEEDPIWDQETHLRGNNFSGQEASRQLFRQFCYQETPGPREALSRLRELCHQWLRPEIHTKEQI

SEQ ID NO: 70542 - protein, 406 aa, Homo sapiens; identical to SEQ ID NO: 70537

SEQ ID NO: 70543 - protein, 17 aa, Homo sapiens
MASTEEQYDLKIVKVEE

SEQ ID NO: 70544 - protein, 155 aa, Homo sapiens
MASTEEQYDLKIVKVEEDPIWDQETHLRGNNFSGQEASRQLFRQFCYQETPGPREALSRLRELCHQWLRPEIHTKEQILELLVLEQFLTILPEELQAWVREHHPESGEEAVAVVEDLEQELSEPGNQAPDHEHGHSEVLLEDVEHLKVKQEPTDI

SEQ ID NO: 70545 - protein, 24 aa, Homo sapiens
MASTEEQYDLKIVKVEEDPIWDQE

SEQ ID NO: 70546 - protein, 103 aa, Homo sapiens
MASTEEQYDLKIVKVEEDPIWDQETHLRGNNFSGQEASRQLFRQFCYQETPGPREALSRLRELCHQWLRPEIHTKEQILELLVLEQFLTILPEELQAWVREHH

SEQ ID NO: 70547 - protein, 148 aa, Homo sapiens
MASTEEQYDLKIVKVEEDPIWDQETHLRGNNFSGQEASRQLFRQFCYQETPGPREALSRLRELCHQWLRPEIHTKEQILELLVLEQFLTILPEELQAWVREHHPESGEEAVAVVEDLEQELSEPGNQAPDHEHGHSEVLLEDVEHLKV

SEQ ID NO: 70548 - protein, 217 aa, Homo sapiens
MASTEEQYDLKIVKVEEDPIWDQETHLRGNNFSGQEASRQLFRQFCYQETPGPREALSRLRELCHQWLRPEIHTKEQILELLVLEQFLTILPEELQAWVREHHPESGEEAVAVVEDLEQELSEPGNQAPDHEHGHSEVLLEDVEHLKVKQEPTDIQLQPMVTQLRYESFCLHQFQEQDGESIPENQELASKQEILKEMEHLGDSKLQRDVSLDSKYR

SEQ ID NO: 70549 - protein, 320 aa, Homo sapiens
MPKKKTGARKKAENRREREKQLRASRSTIDLAKHPCNASMECDKCQRRQKNRAFCYFCNSVQKLPICAQCGKTKCMMKSSDCVIKHAGVYSTGLAMVGAICDFCEAWVCHGRKCLSTHACACPLTDAECVECERGVWDHGGRIFSCSFCHNFLCEDDQFEHQASCQVLEAETFKCVSCNRLGQHSCLRCKACFCDDHTRSKVFKQEKGKQPPCPKCGHETQETKDLSMSTRSLKFGRQTGGEEGDGASGYDAYWKNLSSDKYGDTSYHDEEEDEYEAEDDEEEEDEGRKDSDTESSDLFTNLNLGRTYASGYAHYEEQEN

SEQ ID NO: 70550 - protein, 260 aa, Homo sapiens
MPQWNVTSVRGKTKCMMKSSDCVIKHAGVYSTGLAMVGAICDFCEAWVCHGRKCLSTHACACPLTDAECVECERGVWDHGGRIFSCSFCHNFLCEDDQFEHQASCQVLEAETFKCVSCNRLGQHSCLRCKACFCDDHTRSKVFKQEKGKQPPCPKCGHETQETKDLSMSTRSLKFGRQTGGEEGDGASGYDAYWKNLSSDKYGDTSYHDEEEDEYEAEDDEEEEDEGRKDSDTESSDLFTNLNLGRTYASGYAHYEEQEN

SEQ ID NO: 70551 - protein, 140 aa, Homo sapiens
MPKKKTGARKKAENRREREKQLRASRSTIDLAKHPCNASMECDKCQRRQKNRAFCYFCNSVQKLPICAQCGKTKCMMKSSDCVIKHAGVYSTGLAMVGAICDFCEAWVCHGRKCLSTHACACPLTDAECVECERGVWDHG

SEQ ID NO: 70552 - protein, 153 aa, Homo sapiens
MPKKKTGARKKAENRREREKQLRASRSTIDLAKHPCNASMECDKCQRRQKNRAFCYFCNSVQKLPICAQCGKTKCMMKSSDCVIKHAGVYSTGLAMVGAICDFCEAWVCHGRKCLSTHACACPLTDAECVECERGVWDHGGRIFSCSFCHNFL

SEQ ID NO: 70553 - protein, 229 aa, Homo sapiens
MPKKKTGARKKAENRREREKQLRASRSTIDLAKHPCNASMECDKCQRRQKNRAFCYFCNSVQKLPICAQCGKTKCMMKSSDCVIKHAGVYSTGLAMVGAICDFCEAWVCHGRKCLSTHACACPLTDAECVECERGVWDHGGRIFSCSFCHNFLCEDDQFEHQASCQVLEAETFKCVSCNRLGQHSCLRCKACFCDDHTRSKVFKQEKGKQPPCPKCGHETQETKDLSMS

SEQ ID NO: 70554 - protein, 463 aa, Homo sapiens
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYVNQMIINYVKRPATREGTPPRTHQRHHKENSFECKDCGKAFSRGYQLSQHQKIHTGEKPYECKECKKAFRWGNQLTQHQKIHTGEKPYECKDCGKAFRWGSSLVIHKRIHTGEKPYECKDCGKAFRRGDELTQHQRFHTGEKDYECKDCGKTFSRVYKLIQHKRIHSGEKPYECKDCGKAFICGSSLIQHKRIHTGEKPYECQECGKAFTRVNYLTQHQKIHTGEKPHECKECGKAFRWGSSLVKHERIHTGEKPYKCTECGKAFNCGYHLTQHERIHTGETPYKCKECGKAFIYGSSLVKHERIHTGVKPYGCTECGKSFSHGHQLTQHQKTHSGAKSYECKECGKACNHLNHLREHQRIHNS

SEQ ID NO: 70555 - protein, 463 aa, Homo sapiens; identical to SEQ ID NO: 70554

SEQ ID NO: 70556 - protein, 463 aa, Homo sapiens; identical to SEQ ID NO: 70554

SEQ ID NO: 70557 - protein, 63 aa, Homo sapiens
MAQGLVTFADVAIDFSQEEWACLNSAQRDLYWDVMLENYSNLVSLDLESAYENKSLPTEKNIH

SEQ ID NO: 70558 - protein, 85 aa, Homo sapiens
MAQGLVTFADVAIDFSQEEWACLNSAQRDLYWDVMLENYSNLVSLDLESAYENKSLPTEKNIHEIRASKRNSDRRSKSLGRNWIC

SEQ ID NO: 70559 - protein, 66 aa, Homo sapiens
MAQGLVTFADVAIDFSQEEWACLNSAQRDLYWDVMLENYSNLVSLDLESAYENKSLPTEKNIHEIR

SEQ ID NO: 70560 - protein, 64 aa, Homo sapiens
MAQGLVTFADVAIDFSQEEWACLNSAQRDLYWDVMLENYSNLVSLDLESAYENKSLPTEKNIHE

SEQ ID NO: 70561 - protein, 177 aa, Homo sapiens
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYVNQMIINYVKRPATREGTPPRTHQRHHKENSFECKDCGKAFSRGYQLSQHQKIHTGEKPYECKECKKAFRWGNQLTQH

SEQ ID NO: 70562 - protein, 87 aa, Homo sapiens
MAQGLVTFADVAIDFSQEEWACLNSAQRDLYWDVMLENYSNLVSLDLESAYENKSLPTEKNIHEIRASKRNSDRRSKSLGRNWICEG

SEQ ID NO: 70563 - protein, 47 aa, Homo sapiens
MAQGLVTFADVAIDFSQEEWACLNSAQRDLYWDVMLENYSNLVSLDL

SEQ ID NO: 70564 - protein, 463 aa, Homo sapiens; identical to SEQ ID NO: 70554

SEQ ID NO: 70565 - protein, 105 aa, Homo sapiens
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYVNQMII

SEQ ID NO: 70566 - protein, 463 aa, Homo sapiens; identical to SEQ ID NO: 70554

SEQ ID NO: 70567 - protein, 463 aa, Homo sapiens; identical to SEQ ID NO: 70554

SEQ ID NO: 70568 - protein, 98 aa, Homo sapiens
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGR

SEQ ID NO: 70569 - protein, 463 aa, Homo sapiens; identical to SEQ ID NO: 70554

SEQ ID NO: 70570 - protein, 167 aa, Homo sapiens
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYVNQMIINYVKRPATREGTPPRTHQRHHKENSFECKDCGKAFSRGYQLSQHQKIHTGEKPYECKECKKA

SEQ ID NO: 70571 - protein, 100 aa, Homo sapiens
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYV

SEQ ID NO: 70572 - protein, 665 aa, Homo sapiens
MESVTFEDVAVEFIQEWALLDSARRSLCKYRMLDQCRTLASRGTPPCKPSCVSQLGQRAEPKATERGILRATGVAWESQLKPEELPSMQDLLEEASSRDMQMGPGLFLRMQLVPSIEERETPLTREDRPALQEPPWSLGCTGLKAAMQIQRVVIPVPTLGHRNPWVARDSAVPARDPAWLQEDKVEEEAMAPGLPTACSQEPVTFADVAVVFTPEEWVFLDSTQRSLYRDVMLENYRNLASVADQLCKPNALSYLEERGEQWTTDRGVLSDTCAEPQCQPQEAIPSQDTFTEILSIDVKGEQPQPGEKLYKYNELEKPFNSIEPLFQYQRIHAGEASCECQEIRNSFFQSAHLIVPEKIRSGDKSYACNKCEKSFRYSSDLIRHEKTHTAEKCFDCQECGQAFKYSSNLRRHMRTHTGEKPFECSQCGKTFTRNFNLILHQRNHTGEKPYECKDCGKAFNQPSSLRSHVRTHTGEKPFECSQCGKAFREHSSLKTHLRTHTREKPYECNQCGKPFRTSTHLNVHKRIHTGEKLYECATCGQVLSRLSTLKSHMRTHTGEKPYVCQECGRAFSEPSSLRKHARTHSGKKPYACQECGRAFGQSSHLIVHVRTHSAGRPYQCNQCEKAFRHSSSLTVHKRTHVGRETIRNGSLPLSMSHPYCGPLAN

SEQ ID NO: 70573 - protein, 182 aa, Homo sapiens
MESVTFEDVAVEFIQEWALLDSARRSLCKYRMLDQCRTLASRGTPPCKPSCVSQLGQRAEPKATERGILRATGVAWESQLKPEELPSMQDLLEEASSRDMQMGPGLFLRMQLVPSIEERETPLTREDRPALQEPPWSLGCTLPLLSLLLPSCPEPPLVLLDSSSAPDRHLGSTLDTEARGIP

SEQ ID NO: 70574 - protein, 556 aa, Homo sapiens
MQLVPSIEERETPLTREDRPALQEPPWSLGCTGLKAAMQIQRVVIPVPTLGHRNPWVARDSAVPARDPAWLQEDKVEEEAMAPGLPTACSQEPVTFADVAVVFTPEEWVFLDSTQRSLYRDVMLENYRNLASVADQLCKPNALSYLEERGEQWTTDRGVLSDTCAEPQCQPQEAIPSQDTFTEILSIDVKGEQPQPGEKLYKYNELEKPFNSIEPLFQYQRIHAGEASCECQEIRNSFFQSAHLIVPEKIRSGDKSYACNKCEKSFRYSSDLIRHEKTHTAEKCFDCQECGQAFKYSSNLRRHMRTHTGEKPFECSQCGKTFTRNFNLILHQRNHTGEKPYECKDCGKAFNQPSSLRSHVRTHTGEKPFECSQCGKAFREHSSLKTHLRTHTREKPYECNQCGKPFRTSTHLNVHKRIHTGEKLYECATCGQVLSRLSTLKSHMRTHTGEKPYVCQECGRAFSEPSSLRKHARTHSGKKPYACQECGRAFGQSSHLIVHVRTHSAGRPYQCNQCEKAFRHSSSLTVHKRTHVGRETIRNGSLPLSMSHPYCGPLAN

SEQ ID NO: 70575 - protein, 303 aa, Homo sapiens
MESVTFEDVAVEFIQEWALLDSARRSLCKYRMLDQCRTLASRGTPPCKPSCVSQLGQRAEPKATERGILRATGVAWESQLKPEELPSMQDLLEEASSRDMQMGPGLFLRMQLVPSIEERETPLTREDRPALQEPPWSLGCTGLKAAMQIQRVVIPVPTLGHRNPWVARDSAVPARDPAWLQEDKVEEEAMAPGLPTACSQEPVTFADVAVVFTPEEWVFLDSTQRSLYRDVMLENYRNLASVADQLCKPNALSYLEERGEQWTTDRGVLSDTCAEPQCQPQEAIPSQDTFTEILSIDVKGPPN

SEQ ID NO: 70576 - protein, 1119 aa, Homo sapiens
AAEERGWRPRRCRSQRGTWLRKPRSEVPRPYAPLSGSPPIRWRRTRWRAAATRPLGLAGPRSPLRAAWVWAPSRVRRQQRRRGRPGAGRGIDDLEEDSDYNPAEDEPRGRQLRLQRPTPSTPRPRRRPGRPRKLPRLEISDLPDGVEGEPLVSSQSGQSPPEPQDPEAPSSSGPGHLVAMGKVSRTPVEAGVSQSDAENAAPSCPDEHDTLPRRRGRPSRRFLGKKYRKYYYKSPKPLLRPFLCRICGSRFLSHEDLRFHVNSHEAGDPQLFKCLQCSYRSRRWSSLKEHMFNHVGSKPYKCDECSYTSVYRKDVIRHAAVHSRDRKKRPDPTPKLSSFPCPVCGRVYPMQKRLTQHMKTHSTEKPHMCDKCGKSFKKRYTFKMHLLTHIQAVANRRFKCEFCEFVCEDKKALLNHQLSHVSDKPFKCSFCPYRTFREDFLLSHVAVKHTGAKPFACEYCHFSTRHKKNLRLHVRCRHASSFEEWGRRHPEEPPSRRRPFFSLQQIEELKQQHSAAPGPPPSSPGPPEIPPEATTFQSSEAPSLLCSDTLGGATIIYQQGAEESTAMATQTALDLLLNMSAQRELGGTALQVAVVKSEDVEAGLASPGGQPSPEGATPQVVTLHVAEPGGGAAAESQLGPPDLPQITLAPGPFGGTGYSVITAPPMEEGTSAPGTPYSEEPAGEAAQAVVVSDTLKEAGTHYIMATDGTQLHHIELTADGSISFPSPDALASGAKWPLLQCGGLPRDGPEPPSPAKTHCVGDSQSSASSPPATSKALGLAVPPSPPSAATAASKKFSCKICAEAFPGRAEMESHKRAHAGPGAFKCPDCPFSARQWPEVRAHMAQHSSLRPHQCSQCSFASKNKKDLRRHMLTHTKEKPFACHLCGQRFNRNGHLKFHIQRLHSPDGRKSGTPTARAPTQTPTQTIILNSDDETLATLHTALQSSHGVLGPERLQQALSQEHIIVAQEQTVTNQEEAAYIQEITTADGQTVQHLVTSDNQVQYIISQDGVQHLLPQEYVVVPEGHHIQVQEGQITHIQYEQGAPFLQESQIQYVPVSPGQQLVTQAQLEAAAHSAVTAVADAAMAQAQGLFGTDETVPEHIQQLQHQGIEYDVITLADD

SEQ ID NO: 70577 - protein, 1342 aa, Homo sapiens
MEENEVESSSDAAPGPGRPEEPSESGLGVGTSEAVSADSSDAAAAPGQAEADDSGVGQSSDRGSRSQEEVSESSSSADPLPNSYLPDSSSVSHGPVAGVTGGPPALVHSSALPDPNMLVSDCTASSSDLGSAIDKIIESTIGPDLIQNCITVTSAEDGGAETTRYLILQGPDDGAPMTSPMSSSTLAHSLAAIEALADGPTSTSTCLEAQGGPSSPVQLPPASGAEEPDLQSLEAMMEVVVVQQFKCKMCQYRSSTKATLLRHMRERHFRPVAAAAAAAGKKGRLRKWSTSTKSQEEEGPEEEDDDDIVDAGAIDDLEEDSDYNPAEDEPRGRQLRLQRPTPSTPRPRRRPGRPRKLPRLEISDLPDGVEGEPLVSSQSGQSPPEPQDPEAPSSSGPGHLVAMGKVSRTPVEAGVSQSDAENAAPSCPDEHDTLPRRRGRPSRRFLGKKYRKYYYKSPKPLLRPFLCRICGSRFLSHEDLRFHVNSHEAGDPQLFKCLQCSYRSRRWSSLKEHMFNHVGSKPYKCDECSYTSVYRKDVIRHAAVHSRDRKKRPDPTPKLSSFPCPVCGRVYPMQKRLTQHMKTHSTEKPHMCDKCGKSFKKRYTFKMHLLTHIQAVANRRFKCEFCEFVCEDKKALLNHQLSHVSDKPFKCSFCPYRTFREDFLLSHVAVKHTGAKPFACEYCHFSTRHKKNLRLHVRCRHASSFEEWGRRHPEEPPSRRRPFFSLQQIEELKQQHSAAPGPPPSSPGPPEIPPEATTFQSSEAPSLLCSDTLGGATIIYQQGAEESTAMATQTALDLLLNMSAQRELGGTALQVAVVKSEDVEAGLASPGGQPSPEGATPQVVTLHVAEPGGGAAAESQLGPPDLPQITLAPGPFGGTGYSVITAPPMEEGTSAPGTPYSEEPAGEAAQAVVVSDTLKEAGTHYIMATDGTQLHHIELTADGSISFPSPDALASGAKWPLLQCGGLPRDGPEPPSPAKTHCVGDSQSSASSPPATSKALGLAVPPSPPSAATAASKKFSCKICAEAFPGRAEMESHKRAHAGPGAFKCPDCPFSARQWPEVRAHMAQHSSLRPHQCSQCSFASKNKKDLRRHMLTHTKEKPFACHLCGQRFNRNGHLKFHIQRLHSPDGRKSGTPTARAPTQTPTQTIILNSDDETLATLHTALQSSHGVLGPERLQQALSQEHIIVAQEQTVTNQEEAAYIQEITTADGQTVQHLVTSDNQVQYIISQDGVQHLLPQEYVVVPEGHHIQVQEGQITHIQYEQGAPFLQESQIQYVPVSPGQQLVTQAQLEAAAHSAVTAVADAAMAQAQGLFGTDETVPEHIQQLQHQGIEYDVITLADD

SEQ ID NO: 70578 - protein, 1187 aa, Homo sapiens
MATSSMPESERNVATKASGAPMTSPMSSSTLAHSLAAIEALADGPTSTSTCLEAQGGPSSPVQLPPASGAEEPDLQSLEAMMEVVVVQQFKCKMCQYRSSTKATLLRHMRERHFRPVAAAAAAAGKKGRLRKWSTSTKSQEEEGPEEEDDDDIVDAGAIDDLEEDSDYNPAEDEPRGRQLRLQRPTPSTPRPRRRPGRPRKLPRLEISDLPDGVEGEPLVSSQSGQSPPEPQDPEAPSSSGPGHLVAMGKVSRTPVEAGVSQSDAENAAPSCPDEHDTLPRRRGRPSRRFLGKKYRKYYYKSPKPLLRPFLCRICGSRFLSHEDLRFHVNSHEAGDPQLFKCLQCSYRSRRWSSLKEHMFNHVGSKPYKCDECSYTSVYRKDVIRHAAVHSRDRKKRPDPTPKLSSFPCPVCGRVYPMQKRLTQHMKTHSTEKPHMCDKCGKSFKKRYTFKMHLLTHIQAVANRRFKCEFCEFVCEDKKALLNHQLSHVSDKPFKCSFCPYRTFREDFLLSHVAVKHTGAKPFACEYCHFSTRHKKNLRLHVRCRHASSFEEWGRRHPEEPPSRRRPFFSLQQIEELKQQHSAAPGPPPSSPGPPEIPPEATTFQSSEAPSLLCSDTLGGATIIYQQGAEESTAMATQTALDLLLNMSAQRELGGTALQVAVVKSEDVEAGLASPGGQPSPEGATPQVVTLHVAEPGGGAAAESQLGPPDLPQITLAPGPFGGTGYSVITAPPMEEGTSAPGTPYSEEPAGEAAQAVVVSDTLKEAGTHYIMATDGTQLHHIELTADGSISFPSPDALASGAKWPLLQCGGLPRDGPEPPSPAKTHCVGDSQSSASSPPATSKALGLAVPPSPPSAATAASKKFSCKICAEAFPGRAEMESHKRAHAGPGAFKCPDCPFSARQWPEVRAHMAQHSSLRPHQCSQCSFASKNKKDLRRHMLTHTKEKPFACHLCGQRFNRNGHLKFHIQRLHSPDGRKSGTPTARAPTQTPTQTIILNSDDETLATLHTALQSSHGVLGPERLQQALSQEHIIVAQEQTVTNQEEAAYIQEITTADGQTVQHLVTSDNQVQYIISQDGVQHLLPQEYVVVPEGHHIQVQEGQITHIQYEQGAPFLQESQIQYVPVSPGQQLVTQAQLEAAAHSAVTAVADAAMAQAQGLFGTDETVPEHIQQLQHQGIEYDVITLADD

SEQ ID NO: 70579 - protein, 109 aa, Homo sapiens
MLENYSNLVSVGYCVHKPEVIFRLQQGEEPWKQEEEFPSQSFPEMGFHHVPAGLKLLSSSDPPALASQSGRITGMSHSIPPVMGSFKFTTSIFTCVGLFRFFFFYLSWF

SEQ ID NO: 70580 - protein, 138 aa, Homo sapiens
MNKVEQKSQESVSFKDVTVGFTQEEWQHLDPSQRALYRDVMLENYSNLVSVGYCVHKPEVIFRLQQGEEPWKQEEEFPSQSFPEVWTADHLKERSQENQSKHLWEVVFINNEMLTKEQGDVIGIPFNVDAPEMLMPLD

SEQ ID NO: 70581 - protein, 810 aa, Homo sapiens
MNKVEQKSQESVSFKDVTVGFTQEEWQHLDPSQRALYRDVMLENYSNLVSVGYCVHKPEVIFRLQQGEEPWKQEEEFPSQSFPVWTADHLKERSQENQSKHLWEVVFINNEMLTKEQGDVIGIPFNVDVSSFPSRKMFCQCDSCGMSFNTVSELVISKINYLGKKSDEFNACGKLLLNIKHDETHTQEKNEVLKNRNTLSHHEETLQHEKIQTLEHNFEYSICQETLLEKAVFNTQKRENAEENNCDYNEFGRTLCDSSSLLFHQISPSRDNHYEFSDCEKFLCVKSTLSKPHGVSMKHYDCGESGNNFRRKLCLSHLQKGDKGEKHFECNECGKAFWEKSHLTRHQRVHTGQKPFQCNECEKAFWDKSNLTKHQRSHTGEKPFECNECGKAFSHKSALTLHQRTHTGEKPYQCNACGKTFCQKSDLTKHQRTHTGLKPYECYECGKSFRVTSHLKVHQRTHTGEKPFECLECGKSFSEKSNLTQHQRIHIGDKSYECNACGKTFYHKSLLTRHQIIHTGWKPYECYECGKTFCLKSDLTVHQRTHTGQKPFACPECGKFFSHKSTLSQHYRTHTGEKPYECHECGKIFYNKSYLTKHNRTHTGEKPYECNECGKAFYQKSQLTQHQRIHIGEKPYKCNECGKAFCHKSALIVHQRTHTQEKPYKCNECGKSFCVKSGLIFHERKHTGEKPYECNECGKFFRHKSSLTVHHRAHTGEKSCQCNECGKIFYRKSELAQHQRSHTGEKPYECNTCRKTFSQKSNLIVHQRRHIGENLMNEMDIRNFQPQVSLHNASEYSHCGESPDDILNVQ

SEQ ID NO: 70582 - protein, 811 aa, Homo sapiens
MNKVEQKSQESVSFKDVTVGFTQEEWQHLDPSQRALYRDVMLENYSNLVSVGYCVHKPEVIFRLQQGEEPWKQEEEFPSQSFPEVWTADHLKERSQENQSKHLWEVVFINNEMLTKEQGDVIGIPFNVDVSSFPSRKMFCQCDSCGMSFNTVSELVISKINYLGKKSDEFNACGKLLLNIKHDETHTQEKNEVLKNRNTLSHHEETLQHEKIQTLEHNFEYSICQETLLEKAVFNTQKRENAEENNCDYNEFGRTLCDSSSLLFHQISPSRDNHYEFSDCEKFLCVKSTLSKPHGVSMKHYDCGESGNNFRRKLCLSHLQKGDKGEKHFECNECGKAFWEKSHLTRHQRVHTGQKPFQCNECEKAFWDKSNLTKHQRSHTGEKPFECNECGKAFSHKSALTLHQRTHTGEKPYQCNACGKTFCQKSDLTKHQRTHTGLKPYECYECGKSFRVTSHLKVHQRTHTGEKPFECLECGKSFSEKSNLTQHQRIHIGDKSYECNACGKTFYHKSLLTRHQIIHTGWKPYECYECGKTFCLKSDLTVHQRTHTGQKPFACPECGKFFSHKSTLSQHYRTHTGEKPYECHECGKIFYNKSYLTKHNRTHTGEKPYECNECGKAFYQKSQLTQHQRIHIGEKPYKCNECGKAFCHKSALIVHQRTHTQEKPYKCNECGKSFCVKSGLIFHERKHTGEKPYECNECGKFFRHKSSLTVHHRAHTGEKSCQCNECGKIFYRKSELAQHQRSHTGEKPYECNTCRKTFSQKSNLIVHQRRHIGENLMNEMDIRNFQPQVSLHNASEYSHCGESPDDILNVQ

SEQ ID NO: 70583 - protein, 817 aa, Homo sapiens
MANATRRGSGVEQKSQESVSFKDVTVGFTQEEWQHLDPSQRALYRDVMLENYSNLVSVGYCVHKPEVIFRLQQGEEPWKQEEEFPSQSFPVWTADHLKERSQENQSKHLWEVVFINNEMLTKEQGDVIGIPFNVDVSSFPSRKMFCQCDSCGMSFNTVSELVISKINYLGKKSDEFNACGKLLLNIKHDETHTQEKNEVLKNRNTLSHHEETLQHEKIQTLEHNFEYSICQETLLEKAVFNTQKRENAEENNCDYNEFGRTLCDSSSLLFHQISPSRDNHYEFSDCEKFLCVKSTLSKPHGVSMKHYDCGESGNNFRRKLCLSHLQKGDKGEKHFECNECGKAFWEKSHLTRHQRVHTGQKPFQCNECEKAFWDKSNLTKHQRSHTGEKPFECNECGKAFSHKSALTLHQRTHTGEKPYQCNACGKTFCQKSDLTKHQRTHTGLKPYECYECGKSFRVTSHLKVHQRTHTGEKPFECLECGKSFSEKSNLTQHQRIHIGDKSYECNACGKTFYHKSLLTRHQIIHTGWKPYECYECGKTFCLKSDLTVHQRTHTGQKPFACPECGKFFSHKSTLSQHYRTHTGEKPYECHECGKIFYNKSYLTKHNRTHTGEKPYECNECGKAFYQKSQLTQHQRIHIGEKPYKCNECGKAFCHKSALIVHQRTHTQEKPYKCNECGKSFCVKSGLIFHERKHTGEKPYECNECGKFFRHKSSLTVHHRAHTGEKSCQCNECGKIFYRKSELAQHQRSHTGEKPYECNTCRKTFSQKSNLIVHQRRHIGENLMNEMDIRNFQPQVSLHNASEYSHCGESPDDILNVQ

SEQ ID NO: 70584 - protein, 810 aa, Homo sapiens; identical to SEQ ID NO: 70581

SEQ ID NO: 70585 - protein, 138 aa, Homo sapiens; identical to SEQ ID NO: 70580

SEQ ID NO: 70586 - protein, 778 aa, Homo sapiens
MNKVDQKFQGSVSFKDVTVGFTQEEWQHLDPSQRALYRDVMLENYSNLVSVGYCAHKPEVIFRLEQGEEPWRLEEEFPSQSFPEVWTADHLKERSQENQSKHLWEVVFINNEMLTKEQGNVIGIPFNMDVSSFPSRKMFCQYDSRGMSFNTVSELVISKINYLGKKSDEFNACGKLLLNIKHDETHTREKNEVLKNRNTLSHRENTLQHEKIQTLDHNFEYSICQETLLEKAVFNTRKRENAEENNCDYNEFGRTFCDSSSLLFHQIPPSKDSHYEFSDCEKFLCVKSTLSKHDGVPVKHYDCGESGNNFRRKLCLSQLQKGDKGEKHFECNECGKAFWEKSHLTRHQRVHTGEKHFQCNQCGKTFWEKSNLTKHQRSHTGEKPFECNECGKAFSHKSALTLHQRTHTGEKPYQCNACGKTFYQKSDLTKHQRTHTGQKPYECYECGKSFCMNSHLTVHQRTHTGEKPFECLECGKSFCQKSHLTQHQRTHIGDKPYECNACGKTFYHKSVLTRHQIIHTGLKPYECYECGKTFCLKSDLTIHQRTHTGEKPFACPECGKFFSHKSTLSQHYRTHTGEKPYECHECGKIFYNKSYLTKHNRTHTGEKPYECNECGKTFCQKSQLTQHQRIHIGEKPYECNECGKAFCHKSALIVHQRTHTQEKPYKCNECGKSFCVKSGLILHERKHTGEKPYECNECGKSFSHKSSLTVHHRAHTGEKSCQCNECGKIFYRKSDLAKHQRSHTGEKPYECNTCRKTFSQKSNLIVHQRTHIGEKPYE

SEQ ID NO: 70587 - protein, 744 aa, Homo sapiens
MNKVDQKFQGSVSFKDVTVGFTQEEWQHLDPSQRALYRDVMLENYSNLVSVGTADHLKERSQENQSKHLWEVVFINNEMLTKEQGNVIGIPFNMDVSSFPSRKMFCQYDSRGMSFNTVSELVISKINYLGKKSDEFNACGKLLLNIKHDETHTREKNEVLKNRNTLSHRENTLQHEKIQTLDHNFEYSICQETLLEKAVFNTRKRENAEENNCDYNEFGRTFCDSSSLLFHQIPPSKDSHYEFSDCEKFLCVKSTLSKHDGVPVKHYDCGESGNNFRRKLCLSQLQKGDKGEKHFECNECGKAFWEKSHLTRHQRVHTGEKHFQCNQCGKTFWEKSNLTKHQRSHTGEKPFECNECGKAFSHKSALTLHQRTHTGEKPYQCNACGKTFYQKSDLTKHQRTHTGQKPYECYECGKSFCMNSHLTVHQRTHTGEKPFECLECGKSFCQKSHLTQHQRTHIGDKPYECNACGKTFYHKSVLTRHQIIHTGLKPYECYECGKTFCLKSDLTIHQRTHTGEKPFACPECGKFFSHKSTLSQHYRTHTGEKPYECHECGKIFYNKSYLTKHNRTHTGEKPYECNECGKTFCQKSQLTQHQRIHIGEKPYECNECGKAFCHKSALIVHQRTHTQEKPYKCNECGKSFCVKSGLILHERKHTGEKPYECNECGKSFSHKSSLTVHHRAHTGEKSCQCNECGKIFYRKSDLAKHQRSHTGEKPYECNTCRKTFSQKSNLIVHQRTHIGEKPYE

SEQ ID NO: 70588 - protein, 560 aa, Homo sapiens
MLLLLSDQLLLTALRKPNPQAMAALFLSAPPQAEVTFEDVAVYLSREEWGRLGPAQRGLYRDVMLETYGNLVSLGVGPAGPKPGVISQLERGDEPWVLDVQGTSGKEHLRVNSPALGTRTEYKELTSQETFGEEDPQGSEPVEACDHISKSEGSLEKLVEQRGPRAVTLTNGESSRESGGNLRLLSRPVPDQRPHKCDICEQSFEQRSYLNNHKRVHRSKKTNTVRNSGEIFSANLVVKEDQKIPTGKKLHYCSYCGKTFRYSANLVKHQRLHTEEKPYKCDECGKAFSQSCEFINHRRMHSGEIPYRCDECGKTFTRRPNLMKHQRIHTGEKPYKCGECGKHFSAYSSLIYHQRIHTGEKPYKCNDCGKAFSDGSILIRHRRTHTGEKPFECKECGKGFTQSSNLIQHQRIHTGEKPYKCNECEKAFIQKTKLVEHQRSHTGEKPYECNDCGKVFSQSTHLIQHQRIHTGEKPYKCSECGKAFHNSSRLIHHQRLHHGEKPYRCSDCKKAFSQSTYLIQHRRIHTGEKPYKCSECGKAFRHSSNMCQHQRIHLREDFSM

SEQ ID NO: 70589 - protein, 539 aa, Homo sapiens
MAALFLSAPPQAEVTFEDVAVYLSREEWGRLGPAQRGLYRDVMLETYGNLVSLGVGPAGPKPGVISQLERGDEPWVLDVQGTSGKEHLRVNSPALGTRTEYKELTSQETFGEEDPQGSEPVEACDHISKSEGSLEKLVEQRGPRAVTLTNGESSRESGGNLRLLSRPVPDQRPHKCDICEQSFEQRSYLNNHKRVHRSKKTNTVRNSGEIFSANLVVKEDQKIPTGKKLHYCSYCGKTFRYSANLVKHQRLHTEEKPYKCDECGKAFSQSCEFINHRRMHSGEIPYRCDECGKTFTRRPNLMKHQRIHTGEKPYKCGECGKHFSAYSSLIYHQRIHTGEKPYKCNDCGKAFSDGSILIRHRRTHTGEKPFECKECGKGFTQSSNLIQHQRIHTGEKPYKCNECEKAFIQKTKLVEHQRSHTGEKPYECNDCGKVFSQSTHLIQHQRIHTGEKPYKCSECGKAFHNSSRLIHHQRLHHGEKPYRCSDCKKAFSQSTYLIQHRRIHTGEKPYKCSECGKAFRHSSNMCQHQRIHLREDFSM

SEQ ID NO: 70590 - protein, 519 aa, Homo sapiens
MYLIRESHASGSSSVTSSCSLPSESPTLRQWRPCSCLPHPRPGVISQLERGDEPWVLDVQGTSGKEHLRVNSPALGTRTEYKELTSQETFGEEDPQGSEPVEACDHISKSEGSLEKLVEQRGPRAVTLTNGESSRESGGNLRLLSRPVPDQRPHKCDICEQSFEQRSYLNNHKRVHRSKKTNTVRNSGEIFSANLVVKEDQKIPTGKKLHYCSYCGKTFRYSANLVKHQRLHTEEKPYKCDECGKAFSQSCEFINHRRMHSGEIPYRCDECGKTFTRRPNLMKHQRIHTGEKPYKCGECGKHFSAYSSLIYHQRIHTGEKPYKCNDCGKAFSDGSILIRHRRTHTGEKPFECKECGKGFTQSSNLIQHQRIHTGEKPYKCNECEKAFIQKTKLVEHQRSHTGEKPYECNDCGKVFSQSTHLIQHQRIHTGEKPYKCSECGKAFHNSSRLIHHQRLHHGEKPYRCSDCKKAFSQSTYLIQHRRIHTGEKPYKCSECGKAFRHSSNMCQHQRIHLREDFSM

SEQ ID NO: 70591 - protein, 527 aa, Homo sapiens
MTAELREAMALAPWGPVKVKKEEEEEENFPGQASSQQVHSENIKVWAPVQGLQTGLDGSEEEEKGQNISWDMAVVLKATQEAPAASTLGSYSLPGTLAKSEILETHGTMNFLGAETKNLQLLVPKTEICEEAEKPLIISERIQKADPQGPELGEACEKGNMLKRQRIKREKKDFRQVIVNDCHLPESFKEEENQKCKKSGGKYSLNSGAVKNPKTQLGQKPFTCSVCGKGFSQSANLVVHQRIHTGEKPFECHECGKAFIQSANLVVHQRIHTGQKPYVCSKCGKAFTQSSNLTVHQKIHSLEKTFKCNECEKAFSYSSQLARHQKVHITEKCYECNECGKTFTRSSNLIVHQRIHTGEKPFACNDCGKAFTQSANLIVHQRSHTGEKPYECKECGKAFSCFSHLIVHQRIHTAEKPYDCSECGKAFSQLSCLIVHQRIHSGDLPYVCNECGKAFTCSSYLLIHQRIHNGEKPYTCNECGKAFRQRSSLTVHQRTHTGEKPYECEKCGAAFISNSHLMRHHRTHLVE

SEQ ID NO: 70592 - protein, 134 aa, Homo sapiens
MTAELREAMALAPWGPVKVKKEEEEEENFPGQASSQQVHSENIKVWAPVQGLQTGLDGSEEEEKGQNISWDMAVVLKATQEAPAASTLGSYSLPGTLAKSEILETHGTMNFLGAETKNLQLLVPKTEICEEAEK

SEQ ID NO: 70593 - protein, 112 aa, Homo sapiens
MTAELREAMALAPWGPVKVKKEEEEEENFPGQASSQQVHSENIKVWAPVQGLQTGLDGSEEEEKGQNISWDMAVVLKATQEAPAASTLGSYSLPGTLAKSEILETHGTMNFL

SEQ ID NO: 70594 - protein, 367 aa, Homo sapiens [sequence omitted]

SEQ ID NO: 70595 - protein, 326 aa, Homo sapiens
MDLTAIYESLLSLSPDVPVPSDHGGTESSPGWGSSGPWSLSPSDSSPSGVTSRLPGRSTSLVEGRSCGWVPPPPGFAPLAPRLGPELSPSPTSPTATSTTPSRYKTELCRTFSESGRCRYGAKCQFAHGLGELRQANRHPKYKTELCHKFYLQGRCPYGSRCHFIHNPSEDLAAPGHPPVLRQSISFSGLPSGRRTSPPPPGLAGPSLSSSSFSPSSSPPPPGDLPLSPSAFSAAPGTPLARRDPTPVCCPSCRRATPISVWGPLGGLVRTPSVQSLGSDPDEYASSGSSLGGSDSPVFEAGVFAPPQPVAAPRRLPIFNRISVSE

SEQ ID NO: 70596 - protein, 338 aa, Homo sapiens
MTTTLVSATIFDLSEVLCKGNKMLNYSAPSAGGCLLDRKAVGTPAGGGFPRRHSVTLPSSKFHQNQLLSSLKGEPAPALSSRDSRFRDRSFSEGGERLLPTQKQPGGGQVNSSRYKTELCRPFEENGACKYGDKCQFAHGIHELRSLTRHPKYKTELCRTFHTIGFCPYGPRCHFIHNAEERRALAGARDLSADRPRLQHSFSFAGFPSAAATAAATGLLDSPTSITPPPILSADDLLGSPTLPDGTNNPFAFSSQELASLFAPSMGLPGGGSPTTFLFRPMSESPHMFDSPPSPQDSLSDQEGYLSSSSSSHSGSDSPTLDNSRRLPIFSRLSISDD

SEQ ID NO: 70597 - protein, 166 aa, Homo sapiens
MNTYTRSASFTPKTFTFPLAQNRTSHPTTTSKLKYLGRPSPRRDALQANGEGPEVGPGTEEPAHRLPVGSGSAGEAAASLGTARVRSGRAECTAKLAGDGHARLASAFLHRRAALPPPLGTCRPRLGEGGSAPALGPSPRRGRRVSEGLRDSLPPLGSLTLGKSPK

SEQ ID NO: 70598 - protein, 321 aa, Homo sapiens
MTTTLVSATIFDLSEVLCKGNKMLNYSAPSAGGCLLDRKAVGTPAGGGFPRRHSVTLPSSKFHQNQLLSSLKGEPAPALSSRDSRFRDRSFSEGGERLLPTQKQPFEENGACKYGDKCQFAHGIHELRSLTRHPKYKTELCRTFHTIGFCPYGPRCHFIHNAEERRALAGARDLSADRPRLQHSFSFAGFPSAAATAAATGLLDSPTSITPPPILSADDLLGSPTLPDGTNNPFAFSSQELASLFAPSMGLPGGGSPTTFLFRPMSESPHMFDSPPSPQDSLSDQEGYLSSSSSSHSGSDSPTLDNSRRLPIFSRLSISDD

SEQ ID NO: 70599 - protein, 338 aa, Homo sapiens; identical to SEQ ID NO: 70596

SEQ ID NO: 70600 - protein, 494 aa, Homo sapiens
MSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPDSLSDRDSYLSGSLSSGSLSGSESPSLDPGRRLPIFSRLSISDD

SEQ ID NO: 70601 - protein, 216 aa, Homo sapiens
MSALGQITITVSRCWNTERNQTDKNPCLHGAYLQLRETVKNKSTHLKKPLMKQAPPWKDHLTFQPLHPAERKTQVWRWQSGNSSDLETTSSASPWPTGSNRDVVLNTLAESCCGLSELITAPPYAGVSIQGFSQIWVLFPFCGGTFHHNEKDVLGLQDFERESVSTSQSRNISLLTLGQLQNCVIGKLTIIDLLTEHLLGVRHGVICFPWGLPSSS

SEQ ID NO: 70602 - protein, 407 aa, Homo sapiens
MQQKAFEESRYPWQESFENVAVCLPLRCPRCGDHTRFRSLSSLRAHLEFSHSYEERTLLTKCSLFPSLKDTDLVTSSELLKPGKLQSSGNVVKQKPSYVNLYSISHEHSKDRKPFEVVAERPVSYVQTYTAMDLHADSLDGTRSGPGLPTSDTKASFEAHVREKFNRMVEAVDRTIEKRIDKLTKELAQKTAELLEVRAAFVQLTQKKQEVQRRERALNRQVDVAVEMIAVLRQRLTESEEELLRKEEEVVTFNHFLEAAAEKEVQGKARLQDFIENLLQRVELAEKQLEYYQSQQASGFVRDLSGHVLTDISSNRKPKCLSRGHPHSVCNHPDLKAHFHPKGRNHLKKAKDDRASMQPAKAIHEQAESSRDLCRPPKKGELLGFGRKGNIRPKMAKKKPTAIVNII

SEQ ID NO: 70603 - protein, 333 aa, Homo sapiens
MQQKAFEESRYPWQESFENVAVCLPLRCPRCGDHTRFRSLSSLRAHLEFSHSYEERTLLTKCSLFPSLKDTDLVTSSELLKPGKLQSSGNVVKQKPSYVNLYSISHEHSKDRKPFEVVAERPVSYVQTYTAMDLHADSLDGTRSGPGLPTSDTKASFEAHVREKFNRMVEAVDRTIEKRIDKLTKELAQKTAELLEVRAAFVQLTQKKQEVQRRERALNRQVDVAVEMIAVLRQRLTESEEELLRKEEEVVTFNHFLEAAAEKEVQGKARLQDFIENLLQRVELAEKQLEYYQSQQASGFVRDLSGHVSWKGAGEARLVCQNDLELEESAIVE

SEQ ID NO: 70604 - protein, 462 aa, Homo sapiens
MQQKAFEESRYPWQESFENVAVCLPLRCPRCGDHTRFRSLSSLRAHLEFSHSYEERTLLTKCSLFPSLKDTDLVTSSELLKPGKLQSSGNVVKQKPSYVNLYSISHEHSKDRKPFEVVAERPVSYVQTYTAMDLHADSLDGTRSGPGLPTSDTKASFEAHVREKFNRMVEAVDRTIEKRIDKLTKELAQKTAELLEVRAAFVQLTQKKQEVQRRERALNRQVDVAVEMIAVLRQRLTESEEELLRKEEEVVTFNHFLEAAAEKEVQGKARLQDFIENLLQRVELAEKQLEYYQSQQASGFVRDLSGHVSWKGAGEARLVCQNDLELEIFGHINHHLSGLKDSHCLVFLQAPPVPWIILASFLWILGNPWTSSTATAGFSQIWVLFPFCGGTFHHNEKDVLGLQDFERESVSTSQSRNISLLTLGQLQNCVIGKLTIIDLLTEHLLGVRHGVICFPWGLPSSS

SEQ ID NO: 70605 - protein, 53 aa, Homo sapiens
MQQKAFEESRYPWQESFENVAVCLPLRCPRCGDHTRFRSLSSLRAHLEFSHSY

SEQ ID NO: 70606 - protein, 630 aa, Homo sapiens
MSVSSGVQILTKPETVDRRRSAETTKEAGRPLEMAVSEPEASAAEWKQLDPAQSNLYNDVMLENYCNQASMGCQAPKPDMISKLEKGEAPWLGKGKRPSQGCPSKIARPKQKETDGKVQKDDDQLENIQKSQNKLLREVAVKKKTQAKKNGSDCGSLGKKNNLHKKHVPSKKRLLKFESCGKILKQNLDLPDHSRNCVKRKSDAAKEHKKSFNHSLSDTRKGKKQTGKKHEKLSSHSSSDKCNKTGKKHDKLCCHSSSHIKQDKIQTGEKHEKSPSLSSSTKHEKPQACVKPYECNQCGKVLSHKQGLIDHQRVHTGEKPYECNECGIAFSQKSHLVVHQRTHTGEKPYECIQCGKAHGHKHALTDHLRIHTGEKPYECAECGKTFRHSSNLIQHVRSHTGEKPYECKECGKSFRYNSSLTEHVRTHTGEIPYECNECGKAFKYSSSLTKHMRIHTGEKPFECNECGKAFSKKSHLIIHQRTHTKEKPYKCNECGKAFGHSSSLTYHMRTHTGESPFECNQCGKGFKQIEGLTQHQRVHTGEKPYECNECGKAFSQKSHLIVHQRTHTGEKPYECNECEKAFNAKSQLVIHQRSHTGEKPYECNECGKTFKQNASLTKHVKTHSEDKSHE

SEQ ID NO: 70607 - protein, 645 aa, Homo sapiens
MSVSSGVQILTKPETVDRRRSAETTKEAGRPLEMAVSEPEASAAVSVTFKHVTMAFTQKEWKQLDPAQSNLYNDVMLENYCNQASMGCQAPKPDMISKLEKGEAPWLGKGKRPSQGCPSKIARPKQKETDGKVQKDDDQLENIQKSQNKLLREVAVKKKTQAKKNGSDCGSLGKKNNLHKKHVPSKKRLLKFESCGKILKQNLDLPDHSRNCVKRKSDAAKEHKKSFNHSLSDTRKGKKQTGKKHEKLSSHSSSDKCNKTGKKHDKLCCHSSSHIKQDKIQTGEKHEKSPSLSSSTKHEKPQACVKPYECNQCGKVLSHKQGLIDHQRVHTGEKPYECNECGIAFSQKSHLVVHQRTHTGEKPYECIQCGKAHGHKHALTDHLRIHTGEKPYECAECGKTFRHSSNLIQHVRSHTGEKPYECKECGKSFRYNSSLTEHVRTHTGEIPYECNECGKAFKYSSSLTKHMRIHTGEKPFECNECGKAFSKKSHLIIHQRTHTKEKPYKCNECGKAFGHSSSLTYHMRTHTGESPFECNQCGKGFKQIEGLTQHQRVHTGEKPYECNECGKAFSQKSHLIVHQRTHTGEKPYECNECEKAFNAKSQLVIHQRSHTGEKPYECNECGKTFKQNASLTKHVKTHSEDKSHE

SEQ ID NO: 70608 - protein, 631 aa, Homo sapiens
MSVSSGVQILTKPETVDRRRSAETTKEAGRPLEMAVSEPEASAAKEWKQLDPAQSNLYNDVMLENYCNQASMGCQAPKPDMISKLEKGEAPWLGKGKRPSQGCPSKIARPKQKETDGKVQKDDDQLENIQKSQNKLLREVAVKKKTQAKKNGSDCGSLGKKNNLHKKHVPSKKRLLKFESCGKILKQNLDLPDHSRNCVKRKSDAAKEHKKSFNHSLSDTRKGKKQTGKKHEKLSSHSSSDKCNKTGKKHDKLCCHSSSHIKQDKIQTGEKHEKSPSLSSSTKHEKPQACVKPYECNQCGKVLSHKQGLIDHQRVHTGEKPYECNECGIAFSQKSHLVVHQRTHTGEKPYECIQCGKAHGHKHALTDHLRIHTGEKPYECAECGKTFRHSSNLIQHVRSHTGEKPYECKECGKSFRYNSSLTEHVRTHTGEIPYECNECGKAFKYSSSLTKHMRIHTGEKPFECNECGKAFSKKSHLIIHQRTHTKEKPYKCNECGKAFGHSSSLTYHMRTHTGESPFECNQCGKGFKQIEGLTQHQRVHTGEKPYECNECGKAFSQKSHLIVHQRTHTGEKPYECNECEKAFNAKSQLVIHQRSHTGEKPYECNECGKTFKQNASLTKHVKTHSEDKSHE

SEQ ID NO: 70609 - protein, 550 aa, Homo sapiens
MPLQGSVSFKDVTVDFTQEEWQQLDPAQKALYRDVMLENYCHFVSVGFHMAKPDMIRKLEQGEELWTQRIFPSYSYLEEDGKTEDVLVKFKEYQDRHSRPLIFINHKKLIKERSNIYGKTFTLGKNRISKTILCEYKPDGKVLKNISELVIRNISPIKEKFGDSTGWEKSLLNTKHEKIHPAVNLHKQTERVLSGKQELIQHQKVQAPEQPFDHNECEKSFLMKGMLFTHTRAHRGERTFEYNKDGIAFIEKSSLSVHPSNLMEKKPSAYNKYGKFLCRKPVFIMPQRPQTEEKPFHCPYCGNNFRRKSYLIEHQRIHTGEKPYVCNQCGKAFRQKTALTLHEKTHIEGKPFICIDCGKSFRQKATLTRHHKTHTGEKAYECPQCGSAFRKKSYLIDHQRTHTGEKPYQCNECGKAFIQKTTLTVHQRTHTGEKPYICNECGKSFCQKTTLTLHQRIHTGEKPYICNECGKSFRQKAILTVHHRIHTGEKSNGCPQCGKAFSRKSNLIRHQKTHTGEKPYECKQCGKFFSCKSNLIVHQKTHKVETTGIQ

SEQ ID NO: 70610 - protein, 549 aa, Homo sapiens
MSQGSVSFKDVTVDFTQEEWQQLDPAQKALYRDVMLENYCHFVSVGFHMAKPDMIRKLEQGEELWTQRIFPSYSYLEEDGKTEDVLVKFKEYQDRHSRPLIFINHKKLIKERSNIYGKTFTLGKNRISKTILCEYKPDGKVLKNISELVIRNISPIKEKFGDSTGWEKSLLNTKHEKIHPAVNLHKQTERVLSGKQELIQHQKVQAPEQPFDHNECEKSFLMKGMLFTHTRAHRGERTFEYNKDGIAFIEKSSLSVHPSNLMEKKPSAYNKYGKFLCRKPVFIMPQRPQTEEKPFHCPYCGNNFRRKSYLIEHQRIHTGEKPYVCNQCGKAFRQKTALTLHEKTHIEGKPFICIDCGKSFRQKATLTRHHKTHTGEKAYECPQCGSAFRKKSYLIDHQRTHTGEKPYQCNECGKAFIQKTTLTVHQRTHTGEKPYICNECGKSFCQKTTLTLHQRIHTGEKPYICNECGKSFRQKAILTVHHRIHTGEKSNGCPQCGKAFSRKSNLIRHQKTHTGEKPYECKQCGKFFSCKSNLIVHQKTHKVETTGIQ

SEQ ID NO: 70611 - protein, 500 aa, Homo sapiens
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTRIHTGDRPYKCAHPGCEKAFTQLSNLQSHRRQHNKDKPFKCHNCHRAYTDAASLEVHLSTHTVKHAKVYTCTICSRAYTSETYLMKHMRKHNPPDLQQQVQAAAAAAAVAQAQAQAQAQAQAQAQAQAQAQASQASQQQQQQQQQQQQQQQQPPPHFQSPGAAPQGGGGGDSNPNPPPQCSFDLTPYKTAEHHKDICLTVTTSTIQVEHLASS

SEQ ID NO: 70612 - protein, 577 aa, Homo sapiens
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQSRGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTRIHSKMHTETIKPHKCPHCSKTFANTSYLAQHLRIHSGAKPYNCSYCQKAFRQLSHLQQHTRIHTGDRPYKCAHPGCEKAFTQLSNLQSHRRQHNKDKPFKCHNCHRAYTDAASLEVHLSTHTVKHAKVYTCTICSRAYTSETYLMKHMRKHNPPDLQQQVQAAAAAAAVAQAQAQAQAQAQAQAQAQAQAQASQASQQQQQQQQQQQQQQQQPPPHFQSPGAAPQGGGGGDSNPNPPPQCSFDLTPYKTAEHHKDICLTVTTSTIQVEHLASS

SEQ ID NO: 70613 - protein, 516 aa, Homo sapiens
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQSRGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTRIHTGDRPYKCAHPGCEKAFTQLSNLQSHRRQHNKDKPFKCHNCHRAYTDAASLEVHLSTHTVKHAKVYTCTICSRAYTSETYLMKHMRKHNPPDLQQQVQAAAAAAAVAQAQAQAQAQAQAQAQAQAQAQASQASQQQQQQQQQQQQQQQQPPPHFQSPGAAPQGGGGGDSNPNPPPQCSFDLTPYKTAEHHKDICLTVTTSTIQVEHLASS

SEQ ID NO: 70614 - protein, 516 aa, Homo sapiens; identical to SEQ ID NO: 70613

SEQ ID NO: 70615 - protein, 577 aa, Homo sapiens; identical to SEQ ID NO: 70612

SEQ ID NO: 70616 - protein, 335 aa, Homo sapiens
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQSRGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRSEGNCGTGNGQSLGLMDSVPGSTTNLLCDPGCRMCSLTFYSKSEMQIHSKSHTETKPHKCPHCSKTFANSSYLAQHIRIHSGAKPYSCNFCEKSFRQLSHLQQHTR

SEQ ID NO: 70617 - protein, 277 aa, Homo sapiens
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSF

SEQ ID NO: 70618 - protein, 461 aa, Homo sapiens
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTRIHTGDRPYKCAHPGCEKAFTQLSNLQSHRRQHNKDKPFKCHNCHRAYTDAASLEVHLSTHTVKHAKVYTCTICSRAYTSETYLMKHMRKHNPPDLQQQVQAAAAAAAVAQAQAQAQAQAQAQAQAQAQAQASQASQQQQQQQQQQQQQQQQPPPHFQSPGAAPQGGGGGDSNPNPPPQCSFDLTPYKTAEHHKDICLTVTTSTIQVEHLASS

SEQ ID NO: 70619 - protein, 386 aa, Homo sapiens
MILGSLSRAGPLPLLRQPPIMQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPSIPETGQGVTKGEGGTPAPASLPGGSKEEEEKAKRLLYCALCKVAVNSLSQLEAHNKGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 70620 - protein, 305 aa, Homo sapiens
MILGSLSRAGPLPLLRQPPIMQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 70621 - protein, 366 aa, Homo sapiens
MQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPSIPETGQGVTKGEGGTPAPASLPGGSKEEEEKAKRLLYCALCKVAVNSLSQLEAHNKGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 70622 - protein, 232 aa, Homo sapiens
MQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPSIPETGQGVTKGEGGTPAPASLPGGSKEEEEKAKRLLYCALCKVAVNSLSQLEAHNKGTKHKTILEARSGLGPIKAYPRLGPPTPGEP

SEQ ID NO: 70623 - protein, 366 aa, Homo sapiens; identical to SEQ ID NO: 70621

SEQ ID NO: 70624 - protein, 165 aa, Homo sapiens
MQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPSIPETGQGVTKGEGGTPAPAS

SEQ ID NO: 70625 - protein, 145 aa, Homo sapiens
MQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPS

SEQ ID NO: 70626 - protein, 366 aa, Homo sapiens; identical to SEQ ID NO: 70621

SEQ ID NO: 70627 - protein, 285 aa, Homo sapiens
MQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 70628 - protein, 369 aa, Homo sapiens
MMQPSLDIKPFMSFPVDSSSAVGLFPNFNTMDPVQKAVINHTFGVSIPPKKKQVISCNVCQLRFNSDSQAEAHYKGSKHAKKVKALDATKNKPKMVPSKDSAKANPSCSITPITGNNSDKSEDKGKLKASSSSQPSSSESGSFLLKSGTTPLPPGAATSPSKSTNGAPGTVVESEEEKAKKLLYCSLCKVAVNSLSQLEAHNTGSKHKTMVEARNGAGPIKSYPRPGSRLKMQNGSKGSGLQNKTFHCEICDVHVNSEIQLKQHISSRRHKDRVAGKPLKPKYSPYNKLQRSPSILAAKLAFQKDMMKPLAPAFLSSPLAAAAAVSSALSLPPRPSASLFQAPAIPPALLRPGHGPIRATPASILFAPY

SEQ ID NO: 70629 - protein, 395 aa, Homo sapiens
MWSGLPSRGSTCHTTTLPALVRTPTLMMQPSLDIKPFMSFPVDSSSAVGLFPNFNTMDPVQKAVINHTFGVSIPPKKKQVISCNVCQLRFNSDSQAEAHYKGSKHAKKVKALDATKNKPKMVPSKDSAKANPSCSITPITGNNSDKSEDKGKLKASSSSQPSSSESGSFLLKSGTTPLPPGAATSPSKSTNGAPGTVVESEEEKAKKLLYCSLCKVAVNSLSQLEAHNTGSKHKTMVEARNGAGPIKSYPRPGSRLKMQNGSKGSGLQNKTFHCEICDVHVNSEIQLKQHISSRRHKDRVAGKPLKPKYSPYNKLQRSPSILAAKLAFQKDMMKPLAPAFLSSPLAAAAAVSSALSLPPRPSASLFQAPAIPPALLRPGHGPIRATPASILFAPY

SEQ ID NO: 70630 - protein, 369 aa, Homo sapiens; identical to SEQ ID NO: 70628

SEQ ID NO: 70631 - protein, 471 aa, Homo sapiens
MNMANFLRGFEEKGIKNDRPEDQLSKEKKKILFSFCEVCNIQLNSAAQAQVHSNGKSHRKRVKQLSDGQPPPPAQASPSSNSSTGSTCHTTTLPALVRTPTLMMQPSLDIKPFMSFPVDSSSAVGLFPNFNTMDPVQKAVINHTFGVSIPPKKKQVISCNVCQLRFNSDSQAEAHYKGSKHAKKVKALDATKNKPKMVPSKDSAKANPSCSITPITGNNSDKSEDKGKLKASSSSQPSSSESGSFLLKSGTTPLPPGAATSPSKSTNGAPGTVVESEEEKAKKLLYCSLCKVAVNSLSQLEAHNTGSKHKTMVEARNGAGPIKSYPRPGSRLKMQNGSKGSGLQNKTFHCEICDVHVNSEIQLKQHISSRRHKDRVAGKPLKPKYSPYNKLQRSPSILAAKLAFQKDMMKPLAPAFLSSPLAAAAAVSSALSLPPRPSASLFQAPAIPPALLRPGHGPIRATPASILFAPY

SEQ ID NO: 70632 - protein, 31 aa, Homo sapiens
MNMANFLRGFEEKGIKNDRPEDQLSKEKKKI

SEQ ID NO: 70633 - protein, 138 aa, Homo sapiens
MLGSTCHTTTLPALVRTPTLMMQPSLDIKPFMSFPVDSSSAVGLFPNFNTKRRGLFETNKFCQMDPVQKAVINHTFGVSIPPKKKQVISCNVCQLRFNSDSQAEAHYKGSKHAKKVKALDATKNKPKMVPSKDSAKAN

SEQ ID NO: 70634 - protein, 75 aa, Homo sapiens
MNMANFLRGFEEKGIKNDRPEDQLSKEKKKILFSFCEVCNIQLNSAAQAQVHSNGKSHRKRVKQLSDGQPPPPAQ

SEQ ID NO: 70635 - protein, 263 aa, Homo sapiens
MMQPSLDIKPFMSFPVDSSSAVGLFPNFNTMDPVQKAVINHTFGVSIPPKKKQVISCNVCQLRFNSDSQAEAHYKGSKHAKKVKALDATKNKPKMVPSKDSAKANPSCSITPITGNNSDKSEDKGKLKASSSSQPSSSESGSFLLKSGTTPLPPGAATSPSKSTNGAPGTVVESEEEKAKKLLYCSLCKVAVNSLSQLEAHNTGSKHKTMVEARNGAGPIKSYPRPGSRLKMQNGSKGSGLQNKTFHCEICDVHVNSEIQLKQ

SEQ ID NO: 70636 - protein, 333 aa, Homo sapiens
MSAKLGKSSSLLTQTSEECNGILTEKMEEEEQTCDPDSSLHWSSSYSPETFRQQFRQFGYQDSPGPHEALSRLWELCHLWLRPEVHTKEQILELLVLEQFLAILPKELQAWVQKHHPENGEETVTMLEDVERELDGPKQIFFGRRKDMIAEKLAPSEITEELPSSQLMPVKKQLQGASWELQSLRPHDEDIKTTNVKSASRQKTSLGIELHCNVSNILHMNGSQSSTYRGTYEQDGRFEKRQGNPSWKKQQKCDECGKIFSQSSALILHQRIHSGKKPYACDECAKAFSRSAILIQHRRTHTDSKYEHAIAEAQKNMYFKTRLKCPRSLSGGR

SEQ ID NO: 70637 - protein, 335 aa, Homo sapiens
MSAKLGKSSSLLTQTSEECNGILTEKMEEEEQTCDPDSSLHWSSSYSPETFRQQFRQFGYQDSPGPHEALSRLWELCHLWLRPEVHTKEQILELLVLEQFLAILPKELQAWVQKHHPENGEETVTMLEDVERELDGPKQIFFGRRKDMIAEKLAPSEITEELPSSQLMPVKKQLQGASWELQSLRPHDEDIKTTNVKSASRQKTSLGIELHCNVSNILHMNGSQSSTYRGTYEQDGRFEKRQGNPSWKKQQKCDECGKIFSQSSALILHQRIHSGKKPYACDECAKAFSRSAILIQHRRTHTGEKPYKCHDCGKAFSQSSNLFRHRKRHIRKKVP

SEQ ID NO: 70638 - protein, 275 aa, Homo sapiens
MAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSDCENSETATKEGISEEKSQGLPQEPSFRGIKLSRPPKASSAIRWECVSPGSFPGDIIAAEATHSTISCFAINTLPATILPSKNVNRKYFS

SEQ ID NO: 70639 - protein, 534 aa, Homo sapiens
MAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSDCENSETATKEGISEEKSQGLPQEPSFRGISEHESNLVWKQGSATGEKLRSPSQGGSFSQVIFTNKSLGKRDLYDEAERCLILTTDSIMCQKVPPEERPYRCDVCGHSFKQHSSLTQHQRIHTGEKPYKCNQCGKAFSLRSYLIIHQRIHSGEKAYECSECGKAFNQSSALIRHRKIHTGEKACKCNECGKAFSQSSYLIIHQRIHTGEKPYECNECGKTFSQSSKLIRHQRIHTGERPYECNECGKAFRQSSELITHQRIHSGEKPYECSECGKAFSLSSNLIRHQRIHSGEEPYQCNECGKTFKRSSALVQHQRIHSGDEAYICNECGKAFRHRSVLMRHQRVHTIK

SEQ ID NO: 70640 - protein, 245 aa, Homo sapiens
MAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSELSRPPKASSAIRWECVSPGSFPGDIIAAEATHSTISCFAINTLPATILPSKNVNRKYFS

SEQ ID NO: 70641 - protein, 779 aa, Homo sapiens
MAANGDSPPWSPALAAEGRGSSCEASVSFEDVTVDFSKEEWQHLDPAQRRLYWDVTLENYSHLLSVGYQIPKSEAAFKLEQGEGPWMLEGEAPHQSCSGEAIGKMQQQGIPGGIFFHCERFDQPIGEDSLCSILEELWQDNDQLEQRQENQNNLLSHVKVLIKERGYEHKNIEKIIHVTTKLVPSIKRLHNCDTILKHTLNSHNHNRNSATKNLGKIFGNGNNFPHSPSSTKNENAKTGANSCEHDHYEKHLSHKQAPTHHQKIHPEEKLYVCTECVMGFTQKSHLFEHQRIHAGEKSRECDKSNKVFPQKPQVDVHPSVYTGEKPYLCTQCGKVFTLKSNLITHQKIHTGQKPYKCSECGKAFFQRSDLFRHLRIHTGEKPYECSECGKGFSQNSDLSIHQKTHTGEKHYECNECGKAFTRKSALRMHQRIHTGEKPYVCADCGKAFIQKSHFNTHQRIHTGEKPYECSDCGKSFTKKSQLHVHQRIHTGEKPYICTECGKVFTHRTNLTTHQKTHTGEKPYMCAECGKAFTDQSNLIKHQKTHTGEKPYKCNGCGKAFIWKSRLKIHQKSHIGERHYECKDCGKAFIQKSTLSVHQRIHTGEKPYVCPECGKAFIQKSHFIAHHRIHTGEKPYECSDCGKCFTKKSQLRVHQKIHTGEKPNICAECGKAFTDRSNLITHQKIHTREKPYECGDCGKTFTWKSRLNIHQKSHTGERHYECSKCGKAFIQKATLSMHQIIHTGKKPYACTECQKAFTDRSNLIKHQKMHSGEKRYKASD

SEQ ID NO: 70642 - protein, 779 aa, Homo sapiens; identical to SEQ ID NO: 70641

SEQ ID NO: 70643 - protein, 789 aa, Homo sapiens
MGTLPHGPRPWLQRDVAAHVSADHAALNSIVSLQASVSFEDVTVDFSKEEWQHLDPAQRRLYWDVTLENYSHLLSVGYQIPKSEAAFKLEQGEGPWMLEGEAPHQSCSGEAIGKMQQQGIPGGIFFHCERFDQPIGEDSLCSILEELWQDNDQLEQRQENQNNLLSHVKVLIKERGYEHKNIEKIIHVTTKLVPSIKRLHNCDTILKHTLNSHNHNRNSATKNLGKIFGNGNNFPHSPSSTKNENAKTGANSCEHDHYEKHLSHKQAPTHHQKIHPEEKLYVCTECVMGFTQKSHLFEHQRIHAGEKSRECDKSNKVFPQKPQVDVHPSVYTGEKPYLCTQCGKVFTLKSNLITHQKIHTGQKPYKCSECGKAFFQRSDLFRHLRIHTGEKPYECSECGKGFSQNSDLSIHQKTHTGEKHYECNECGKAFTRKSALRMHQRIHTGEKPYVCADCGKAFIQKSHFNTHQRIHTGEKPYECSDCGKSFTKKSQLHVHQRIHTGEKPYICTECGKVFTHRTNLTTHQKTHTGEKPYMCAECGKAFTDQSNLIKHQKTHTGEKPYKCNGCGKAFIWKSRLKIHQKSHIGERHYECKDCGKAFIQKSTLSVHQRIHTGEKPYVCPECGKAFIQKSHFIAHHRIHTGEKPYECSDCGKCFTKKSQLRVHQKIHTGEKPNICAECGKAFTDRSNLITHQKIHTREKPYECGDCGKTFTWKSRLNIHQKSHTGERHYECSKCGKAFIQKATLSMHQIIHTGKKPYACTECQKAFTDRSNLIKHQKMHSGEKRYKASD

SEQ ID NO: 70644 - protein, 178 aa, Homo sapiens
MGTLPHGPRPWLQRDVAAHVSADHAALNSIVSLQASVSFEDVTVDFSKEEWQHLDPAQRRLYWDVTLENYSHLLSVGYQIPKSEAAFKLEQGEGPWMLEGEAPHQSCSGEAIGKMQQQGIPGGIFFHCERFDQPIGEDSLCSILEELWQDNDQLEQRQENQNNLLSHVKVLIKERGYE

SEQ ID NO: 70645 - protein, 1284 aa, Homo sapiens
MHKKRVEEGEASDFSLAWDSSVTAAGGLEGEPECDQKTSRALEDRNSVTSQEERNEDDEDMEDESIYTCDHCQQDFESLADLTDHRAHRCPGDGDDDPQLSWVASSPSSKDVASPTQMIGDGCDLGLGEEEGGTGLPYPCQFCDKSFIRLSYLKRHEQIHSDKLPFKCTYCSRLFKHKRSRDRHIKLHTGDKKYHCHECEAAFSRSDHLKIHLKTHSSSKPFKCTVCKRGFSSTSSLQSHMQAHKKNKEHLAKSEKEAKKDDFMCDYCEDTFSQTEELEKHVLTRHPQLSEKADLQCIHCPEVFVDENTLLAHIHQAHANQKHKCPMCPEQFSSVEGVYCHLDSHRQPDSSNHSVSPDPVLGSVASMSSATPDSSASVERGSTPDSTLKPLRGQKKMRDDGQGWTKVVYSCPYCSKRDFNSLAVLEIHLKTIHADKPQQSHTCQICLDSMPTLYNLNEHVRKLHKNHAYPVMQFGNISAFHCNYCPEMFADINSLQEHIRVSHCGPNANPSDGNNAFFCNQCSMGFLTESSLTEHIQQAHCSVGSAKLESPVVQPTQSFMEVYSCPYCTNSPIFGSILKLTKHIKENHKNIPLAHSKKSKAEQSPVSSDVEVSSPKRQRLSASANSISNGEYPCNQCDLKFSNFESFQTHLKLHLELLLRKQACPQCKEDFDSQESLLQHLTVHYMTTSTHYVCESCDKQFSSVDDLQKHLLDMHTFVLYHCTLCQEVFDSKVSIQVHLAVKHSNEKKMYRCTACNWDFRKEADLQVHVKHSHLGNPAKAHKCIFCGETFSTEVELQCHITTHSKKYNCKFCSKAFHAIILLEKHLREKHCVFDAATENGTANGVPPMATKKAEPADLQGMLLKNPEAPNSHEASEDDVDASEPMYGCDICGAAYTMEVLLQNHRLRDHNIRPGEDDGSRKKAEFIKGSHKCNVCSRTFFSENGLREHLQTHRGPAKHYMCPICGERFPSLLTLTEHKVTHSKSLDTGTCRICKMPLQSEEEFIEHCQMHPDLRNSLTGFRCVVCMQTVTSTLELKIHGTFHMQKLAGSSAASSPNGQGLQKLYKCALCLKEFRSKQDLVKLDVNGLPYGLCAGCMARSANGQVGGLAPPEPADRPCAGLRCPECSVKFESAEDLESHMQVDHRDLTPETSGPRKGTQTSPVPRKKTYQCIKCQMTFENEREIQIHVANHMIEEGINHECKLCNQMFDSPAKLLCHLIEHSFEGMGGTFKCPVCFTVFVQANKLQQHIFAVHGQEDKIYDCSQCPQKFFFQTELQNHTMSQHAQ

SEQ ID NO: 70646 - protein, 1167 aa, Homo sapiens
MIGDGCDLGLGEEEGGTGLPYPCQFCDKSFIRLSYLKRHEQIHSDKLPFKCTYCSRLFKHKRSRDRHIKLHTGDKKYHCHECEAAFSRSDHLKIHLKTHSSSKPFKCTVCKRGFSSTSSLQSHMQAHKKNKEHLAKSEKEAKKDDFMCDYCEDTFSQTEELEKHVLTRHPQLSEKADLQCIHCPEVFVDENTLLAHIHQAHANQKHKCPMCPEQFSSVEGVYCHLDSHRQPDSSNHSVSPDPVLGSVASMSSATPDSSASVERGSTPDSTLKPLRGQKKMRDDGQGWTKVVYSCPYCSKRDFNSLAVLEIHLKTIHADKPQQSHTCQICLDSMPTLYNLNEHVRKLHKNHAYPVMQFGNISAFHCNYCPEMFADINSLQEHIRVSHCGPNANPSDGNNAFFCNQCSMGFLTESSLTEHIQQAHCSVGSAKLESPVVQPTQSFMEVYSCPYCTNSPIFGSILKLTKHIKENHKNIPLAHSKKSKAEQSPVSSDVEVSSPKRQRLSASANSISNGEYPCNQCDLKFSNFESFQTHLKLHLELLLRKQACPQCKEDFDSQESLLQHLTVHYMTTSTHYVCESCDKQFSSVDDLQKHLLDMHTFVLYHCTLCQEVFDSKVSIQVHLAVKHSNEKKMYRCTACNWDFRKEADLQVHVKHSHLGNPAKAHKCIFCGETFSTEVELQCHITTHSKKYNCKFCSKAFHAIILLEKHLREKHCVFDAATENGTANGVPPMATKKAEPADLQGMLLKNPEAPNSHEASEDDVDASEPMYGCDICGAAYTMEVLLQNHRLRDHNIRPGEDDGSRKKAEFIKGSHKCNVCSRTFFSENGLREHLQTHRGPAKHYMCPICGERFPSLLTLTEHKVTHSKSLDTGTCRICKMPLQSEEEFIEHCQMHPDLRNSLTGFRCVVCMQTVTSTLELKIHGTFHMQKLAGSSAASSPNGQGLQKLYKCALCLKEFRSKQDLVKLDVNGLPYGLCAGCMARSANGQVGGLAPPEPADRPCAGLRCPECSVKFESAEDLESHMQVDHRDLTPETSGPRKGTQTSPVPRKKTYQCIKCQMTFENEREIQIHVANHMIEEGINHECKLCNQMFDSPAKLLCHLIEHSFEGMGGTFKCPVCFTVFVQANKLQQHIFAVHGQEDKIYDCSQCPQKFFFQTELQNHTMSQHAQ

SEQ ID NO: 70647 - protein, 1284 aa, Homo sapiens; identical to SEQ ID NO: 70645

SEQ ID NO: 70648 - protein, 809 aa, Homo sapiens
MGPLTFMDVAIEFCLEEWQCLDIAQQNLYRNVMLENYRNLVFLGIAVSKPDLITCLEQEKEPWEPMRRHEMVAKPPVMCSHFTQDFWPEQHIKDPFQKATLRRYKNCEHKNVHLKKDHKSVDECKVHRGGYNGFNQCLPATQSKIFLFDKCVKAFHKFSNSNRHKISHTEKKLFKCKECGKSFCMLPHLAQHKIIHTRVNFCKCEKCGKAFNCPSIITKHKRINTGEKPYTCEECGKVFNWSSRLTTHKKNYTRYKLYKCEECGKAFNKSSILTTHKIIRTGEKFYKCKECAKAFNQSSNLTEHKKIHPGEKPYKCEECGKAFNWPSTLTKHKRIHTGEKPYTCEECGKAFNQFSNLTTHKRIHTAEKFYKCTECGEAFSRSSNLTKHKKIHTEKKPYKCEECGKAFKWSSKLTEHKLTHTGEKPYKCEECGKAFNWPSTLTKHNRIHTGEKPYKCEVCGKAFNQFSNLTTHKRIHTAEKPYKCEECGKAFSRSSNLTKHKKIHIEKKPYKCEECGKAFKWSSKLTEHKITHTGEKPYKCEECGKAFNHFSILTKHKRIHTGEKPYKCEECGKAFTQSSNLTTHKKIHTGEKFYKCEECGKAFTQSSNLTTHKKIHTGGKPYKCEECGKAFNQFSTLTKHKIIHTEEKPYKCEECGKAFKWSSTLTKHKIIHTGEKPYKCEECGKAFKLSSTLSTHKIIHTGEKPYKCEKCGKAFNRSSNLIEHKKIHTGEQPYKCEECGKAFNYSSHLNTHKRIHTKEQPYKCKECGKAFNQYSNLTTHNKIHTGEKLYKPEDVTVILTTPQTFSNIK

SEQ ID NO: 70649 - protein, 808 aa, Homo sapiens
GPLTFMDVAIEFCLEEWQCLDIAQQNLYRNVMLENYRNLVFLGIAVSKPDLITCLEQEKEPWEPMRRHEMVAKPPVMCSHFTQDFWPEQHIKDPFQKATLRRYKNCEHKNVHLKKDHKSVDECKVHRGGYNGFNQCLPATQSKIFLFDKCVKAFHKFSNSNRHKISHTEKKLFKCKECGKSFCMLPHLAQHKIIHTRVNFCKCEKCGKAFNCPSIITKHKRINTGEKPYTCEECGKVFNWSSRLTTHKKNYTRYKLYKCEECGKAFNKSSILTTHKIIRTGEKFYKCKECAKAFNQSSNLTEHKKIHPGEKPYKCEECGKAFNWPSTLTKHKRIHTGEKPYTCEECGKAFNQFSNLTTHKRIHTAEKFYKCTECGEAFSRSSNLTKHKKIHTEKKPYKCEECGKAFKWSSKLTEHKLTHTGEKPYKCEECGKAFNWPSTLTKHNRIHTGEKPYKCEVCGKAFNQFSNLTTHKRIHTAEKPYKCEECGKAFSRSSNLTKHKKIHIEKKPYKCEECGKAFKWSSKLTEHKITHTGEKPYKCEECGKAFNHFSILTKHKRIHTGEKPYKCEECGKAFTQSSNLTTHKKIHTGEKFYKCEECGKAFTQSSNLTTHKKIHTGGKPYKCEECGKAFNQFSTLTKHKIIHTEEKPYKCEECGKAFKWSSTLTKHKIIHTGEKPYKCEECGKAFKLSSTLSTHKIIHTGEKPYKCEKCGKAFNRSSNLIEHKKIHTGEQPYKCEECGKAFNYSSHLNTHKRIHTKEQPYKCKECGKAFNQYSNLTTHNKIHTGEKLYKPEDVTVILTTPQTFSNIK

SEQ ID NO: 70650 - protein, 803 aa, Homo sapiens
MDVAIEFCLEEWQCLDIAQQNLYRNVMLENYRNLVFLGIAVSKPDLITCLEQEKEPWEPMRRHEMVAKPPVMCSHFTQDFWPEQHIKDPFQKATLRRYKNCEHKNVHLKKDHKSVDECKVHRGGYNGFNQCLPATQSKIFLFDKCVKAFHKFSNSNRHKISHTEKKLFKCKECGKSFCMLPHLAQHKIIHTRVNFCKCEKCGKAFNCPSIITKHKRINTGEKPYTCEECGKVFNWSSRLTTHKKNYTRYKLYKCEECGKAFNKSSILTTHKIIRTGEKFYKCKECAKAFNQSSNLTEHKKIHPGEKPYKCEECGKAFNWPSTLTKHKRIHTGEKPYTCEECGKAFNQFSNLTTHKRIHTAEKFYKCTECGEAFSRSSNLTKHKKIHTEKKPYKCEECGKAFKWSSKLTEHKLTHTGEKPYKCEECGKAFNWPSTLTKHNRIHTGEKPYKCEVCGKAFNQFSNLTTHKRIHTAEKPYKCEECGKAFSRSSNLTKHKKIHIEKKPYKCEECGKAFKWSSKLTEHKITHTGEKPYKCEECGKAFNHFSILTKHKRIHTGEKPYKCEECGKAFTQSSNLTTHKKIHTGEKFYKCEECGKAFTQSSNLTTHKKIHTGGKPYKCEECGKAFNQFSTLTKHKIIHTEEKPYKCEECGKAFKWSSTLTKHKIIHTGEKPYKCEECGKAFKLSSTLSTHKIIHTGEKPYKCEKCGKAFNRSSNLIEHKKIHTGEQPYKCEECGKAFNYSSHLNTHKRIHTKEQPYKCKECGKAFNQYSNLTTHNKIHTGEKLYKPEDVTVILTTPQTFSNIK

SEQ ID NO: 70651 - protein, 570 aa, Homo sapiens
MENLKSGVYPLKEASGCPGADRNLLVYSFYEKGPLTFRDVAIEFSLEEWQCLDTAQQDLYRKVMLENYRNLVFLAGIAVSKPDLITCLEQGKEPWNMKRHAMVDQPPVTYSHFAQDLWPEQGIKDSFQEVILRRYGKCGHEDLQLRTGCKSVDECNLHKECYDELNQCLTTTQSEIFQYDKYVNVFYKFSNPNIQKIRHTGKKPFKCKKCDKSFCMLLHLTQHKRIHIRENSYQCEECGKVFNWFSTLTRHRRIHTGEKPYKCEQCGKAFKQSSTLTTHKIIHTGEKPYRCEECGKTFNRSSHLTTHKRIHTGEKPYRCEECGRAFNRSSHLTTHKIIHTGEKPYKCEECGKAFNQSSTLTTHKIIHAGEKPYKCEECGKAFYRFSYLTKHKIIHTGEKFYKCEECGKGFNWSSTLTKHKRIHTGEKPYKCEQCGKAFNESSNLTAHKIIHTGEKPYKCEECGKAFNRSPKLTAHKVIHSGEKPYKCEECGKAFNQFSNLTKHKITHIGDTSYKYLECDKAFSQSSTLTKHKVIHTGEKPYNCEEYGKAFNQSSNLIEQSNSYWRETLQM

SEQ ID NO: 70652 - protein, 470 aa, Homo sapiens
MAATLLMAGSQAPVTFEDMAMYLTREEWRPLDAAQRDLYRDVMQENYGNVVSLDFEIRSENEVNPKQEISEDVQFGTTSERPAENAEENPESEEGFESGDRSERQWGDLTAEEWVSYPLQPVTDLLVHKEVHTGIRYHICSHCGKAFSQISDLNRHQKTHTGDRPYKCYECGKGFSRSSHLIQHQRTHTGERPYDCNECGKSFGRSSHLIQHQTIHTGEKPHKCNECGKSFCRLSHLIQHQRTHSGEKPYECEECGKSFSRSSHLAQHQRTHTGEKPYECNECGRGFSERSDLIKHYRVHTGERPYKCDECGKNFSQNSDLVRHRRAHTGEKPYHCNECGENFSRISHLVQHQRTHTGEKPYECNACGKSFSRSSHLITHQKIHTGEKPYECNECWRSFGERSDLIKHQRTHTGEKPYECVQCGKGFTQSSNLITHQRVHTGEKPYECTECEKSFSRSSALIKHKRVHTD

SEQ ID NO: 70653 - protein, 470 aa, Homo sapiens; identical to SEQ ID NO: 70652

SEQ ID NO: 70654 - protein, 302 aa, Homo sapiens
MAATLLMAGSQAPVTFEDMAMYLTREEWRPLDAAQRDLYRDVMQENYGNVVSLDFEIRSENEVNPKQEISEDVQFGTTSERPAENAEENPESEEGFESGDRSERQWGDLTAEEWVSYPLQPVTDLLVHKEVHTGIRYHICSHCGKAFSQISDLNRHQKTHTGDRPYKCYECGKGFSRSSHLIQHQRTHTGERPYDCNECGKSFGRSSHLIQHQTIHTGEKPHKCNECGKSFCRLSHLIQHQRTHSGEKPYECEECGKSFSRSSHLAQHQRTHTGEKPYECTECEKSFSRSSALIKHKRVHTD

SEQ ID NO: 70655 - protein, 615 aa, Homo sapiens
MDSVAFEDVAVNFTHEEWALLGPSQKNLYRDVMRETIRNLNCIGMKWENQNIDDQHQNLRRNPRCDVVERFGKSKDGSQCGETLSQIRNSIVNKNTPARVDACGSSVNGEVIMGHSSLNCYIRVDTGHKHRECHEYAEKSYTHKQCGKGLSYRHSFQTCERPHTGKKPYDCKECGKTFSSPGNLRRHMVVKGGDGPYKCELCGKAFFWPSLLRMHERTHTGEKPYECKQCSKAFPVYSSYLRHEKIHTGEKPYECKQCSKAFPDYSSYLRHERTHTGEKPYKCKQCGKAFSVSGSLRVHERIHTGEKPYTCKQCGKAFCHLGSFQRHMIMHSGDGPHKCKICGKGFDFPGSARIHEGTHTLEKPYECKQCGKLLSHRSSFRRHMMAHTGDGPHKCTVCGKAFDSPSVFQRHERTHTGEKPYECKQCGKAFRTSSSLRKHETTHTGEQPYKCKCGKAFSDLFSFQSHETTHSEEEPYECKECGKAFSSFKYFCRHERTHSEEKSYECQICGKAFSRFSYLKTHERTHTAEKPYECKQCRKAFFWPSFLLRHERTHTGERPYECKHCGKAFSRSSFCREHERTHTGEKPYECKECGKAFSSLSSFNRHKRTHWKDIL

SEQ ID NO: 70656 - protein, 663 aa, Homo sapiens
MALCYGTFWGYPKMLEAANLMEGLVDIGPWVTLPRGQPEVLEWGLPKDQDSVAFEDVAVNFTHEEWALLGPSQKNLYRDVMRETIRNLNCIGMKWENQNIDDQHQNLRRNPRCDVVERFGKSKDGSQCGETLSQIRNSIVNKNTPARVDACGSSVNGEVIMGHSSLNCYIRVDTGHKHRECHEYAEKSYTHKQCGKGLSYRHSFQTCERPHTGKKPYDCKECGKTFSSPGNLRRHMVVKGGDGPYKCELCGKAFFWPSLLRMHERTHTGEKPYECKQCSKAFPVYSSYLRHEKIHTGEKPYECKQCSKAFPDYSSYLRHERTHTGEKPYKCKQCGKAFSVSGSLRVHERIHTGEKPYTCKQCGKAFCHLGSFQRHMIMHSGDGPHKCKICGKGFDFPGSARIHEGTHTLEKPYECKQCGKLLSHRSSFRRHMMAHTGDGPHKCTVCGKAFDSPSVFQRHERTHTGEKPYECKQCGKAFRTSSSLRKHETTHTGEQPYKCKCGKAFSDLFSFQSHETTHSEEEPYECKECGKAFSSFKYFCRHERTHSEEKSYECQICGKAFSRFSYLKTHERTHTAEKPYECKQCRKAFFWPSFLLRHERTHTGERPYECKHCGKAFSRSSFCREHERTHTGEKPYECKECGKAFSSLSSFNRHKRTHWKDIL

SEQ ID NO: 70657 - protein, 637 aa, Homo sapiens
MALCYGTFWGYPKMLEAANLMEGLVDIGPWVTLPRGQPEVLEWGLPKDQDSVAFEDVAVNFTHEEWALLGPSQKNLYRDVMRETIRNLNCIGMKWENQNIDDQHQNLRRNPRCDVVERFGKSKDGSQCGETLSQIRNSIVNKNTPARVDACGSSVNGEVIMGHSSLNCYIRVDTGHKHRECHEYAEKSYTHKQCGKGLSYRHSFQTCERPHTGKKPYDCKECGKTFSSPGNLRRHMVVKGGDGPYKCELCGKAFFWPSLLRMHERTHTGEKPYECKQCSKAFPVYSSYLRHEKIHTGEKPYECKQCSKAFPDYSSYLRHERTHTGEKPYKCKQCGKAFSVSGSLRVHERIHTGEKPYTCKQCGKAFCHLGSFQRHMIMHSGDGPHKCKICGKGFDFPGSARIHEGTHTLEKPYECKQCGKLLSHRSSFRRHMMAHTGDGPHKCTVCGKAFDSPSVFQRHERTHTGEKPYECKQCGKAFRTSSSLRKHETTHTGEQPYKCKCGKAFSDLFSFQSHETTHSEEEPYECKECGKAFSSFKYFCRHERTHSEEKSYECQICGKAFSRFSYLKTHERTHTAEKPYECKQCRKAFFWPSFLLRHERTHTGERPYECKHCGKAFSRSSFCREHERTHTGEKPYE

SEQ ID NO: 70658 - protein, 589 aa, Homo sapiens
MDSVAFEDVAVNFTHEEWALLGPSQKNLYRDVMRETIRNLNCIGMKWENQNIDDQHQNLRRNPRCDVVERFGKSKDGSQCGETLSQIRNSIVNKNTPARVDACGSSVNGEVIMGHSSLNCYIRVDTGHKHRECHEYAEKSYTHKQCGKGLSYRHSFQTCERPHTGKKPYDCKECGKTFSSPGNLRRHMVVKGGDGPYKCELCGKAFFWPSLLRMHERTHTGEKPYECKQCSKAFPVYSSYLRHEKIHTGEKPYECKQCSKAFPDYSSYLRHERTHTGEKPYKCKQCGKAFSVSGSLRVHERIHTGEKPYTCKQCGKAFCHLGSFQRHMIMHSGDGPHKCKICGKGFDFPGSARIHEGTHTLEKPYECKQCGKLLSHRSSFRRHMMAHTGDGPHKCTVCGKAFDSPSVFQRHERTHTGEKPYECKQCGKAFRTSSSLRKHETTHTGEQPYKCKCGKAFSDLFSFQSHETTHSEEEPYECKECGKAFSSFKYFCRHERTHSEEKSYECQICGKAFSRFSYLKTHERTHTAEKPYECKQCRKAFFWPSFLLRHERTHTGERPYECKHCGKAFSRSSFCREHERTHTGEKPYE

SEQ ID NO: 70659 - protein, 540 aa, Homo sapiens
MGIVEKASSSSDSVTFEDVAVNFTQEEWTLLDPSQKKLYRDVMWETFRNLATIGTKQKEWNIEEQYKNQGRNLRNHMVERLCESKEGSHGGEGFSQIANLSLNKKTPSGGKLWESSVCGKVLSHHSSLNRHIRSYTRHKLYKCQEYGEKPYKCKKCGKPFSYLQSFKKHKRTHSAGIVYKCKACGKAFSCQRSFQIHGRTHTGDKPFKCKECGKAFRYHQSAQKHEKAHTGEKPYKCKECGKPFIYRHSARAHERNHTVQKRYECKQCGKTYISSVGFQAHERTHTGEKPYECKKCGKVFVYHNSAQRHEKTHTGEKPYKCKECGKAFSYHCTAQKHERNHTAQKHYECKLCGKTYLSPLGFQAHESTHTGDKPFECKKCGKAFRYYYSAQRHERTHTGEKPYKCKECGKAFYCCSSARRHERMHTAKKQYECKKCGKTYITLAGFQIHERTHTGEKPYECKQCGKAFSSSSYIHIHERIHTGEKPYECKECGKPFSFLTGFRVHMRMHTGEKPYKCKDCGNAFIWRASLQYHVKKVHAE

SEQ ID NO: 70660 - protein, 615 aa, Homo sapiens; identical to SEQ ID NO: 70655

SEQ ID NO: 70661 - protein, 327 aa, Homo sapiens
MEVAVPVKQEAEGLALDSPWHRFRRFHLGDAPGPREALGLLRALCRDWLRPEVHTKEQMLELLVLEQFLSALPADTQAWVCSRQPQSGEEAVALLEELWGPAASPDGSSATRVPQDVTQGPGATGGKEDSGMIPLAGTAPGAEGPAPGDSQAVRPYKQEPSSPPLAPGLPAFLAAPGTTSCPECGKTSLKPAHLLRHRQSHSGEKPHACPECGKAFRRKEHLRRHRDTHPGSPGSPGPALRPLPAREKPHACCECGKTFYWREHLVRHRKTHSGARPFACWECGKGFGRREHVLRHQRIHGRAAASAQGAVAPGPDGGGPFPPWPLG

SEQ ID NO: 70662 - protein, 518 aa, Homo sapiens
MAVALGCAIQASLNQGSVFQEYDTDCEVFRQRFRQFQYREAAGPHEAFNKLWELCCQWLKPKMRSKEQILELLVLEQFLTILPTEIETWVREHCPENRERVVSLIEDLQRELEIPEQQVDMHDMLLEELAPVGTAHIPPTMHLESPALQVMGPAQEAPVAEAWIPQAGPPELNYGATGECQNFLDPGYPLPKLDMNFSLENREEPWVKELQDSKEMKQLLDSKIGFEIGIENEEDTSKQKKMETMYPFIVTLEGNALQGPILQKDYVQLENQWETPPEDLQTDLAKLVDQQNPTLGETPENSNLEEPLNPKPHKKKSPGEKPHRCPQCGKCFARKSQLTGHQRIHSGEEPHKCPECGKRFLRSSDLYRHQRLHTGERPYECTVCKKRFTRRSHLIGHQRTHSEEETYKCLECGKSFCHGSSLKRHLKTHTGEKPHRCHNCGKSFSRLTALTLHQRTHTEERPFKCNYCGKSFRQRPSLVIHLRIHTGEKPYKCTHCSKSFRQRAGLIMHQVTHFRGLI

SEQ ID NO: 70663 - protein, 127 aa, Homo sapiens
MAVALGCAIQASLNQGSVFQEYDTDCEVFRQRFRQFQYREAAGPHEAFNKLWELCCQWLKPKMRSKEQILELLVLEQFLTILPTEIETWVREHCPENRERVVSLIEDLQRELEIPEQQTFAAEYSHY

SEQ ID NO: 70664 - protein, 164 aa, Homo sapiens
MAVALGCAIQASLNQGSVFQEYDTDCEVFRQRFRQFQYREAAGPHEAFNKLWELCCQWLKPKMRSKEQILELLVLEQFLTILPTEIETWVREHCPENRERVVSLIEDLQRELEIPEQQVRKECGIFVIGPKEVAEAAGTRPHICLYVIPQPQDFSRVLFLFLFC

SEQ ID NO: 70665 - protein, 682 aa, Homo sapiens
MTKSKEAVTFKDVAVVFSEEELQLLDLAQRKLYRDVMLENFRNVVSVGHQSTPDGLPQLEREEKLWMMKMATQRDNSSGAKNLKEMETLQEVGLRYLPHEELFCSQIWQQITRELIKYQDSVVNIQRTGCQLEKRDDLHYKDEGFSNQSSHLQVHRVHTGEKPYKGEHCVKSFSWSSHLQINQRAHAGEKPYKCEKCDNAFRRFSSLQAHQRVHSRAKSYTNDASYRSFSQRSHLPHHQRVPTGENPYKYEECGRNVGKSSHCQAPLIVHTGEKPYKCEECGVGFSQRSYLQVHLKVHTGKKPYKCEECGKSFSWRSRLQAHERIHTGEKPYKCNACGKSFSYSSHLNIHCRIHTGEKPYKCEECGKGFSVGSHLQAHQISHTGEKPYKCEECGKGFCRASNLLDHQRGHTGEKPYQCDACGKGFSRSSDFNIHFRVHTGEKPYKCEECGKGFSQASNLLAHQRGHTGEKPYKCGTCGKGFSRSSDLNVHCRIHTGEKPYKCERCGKAFSQFSSLQVHQRVHTGEKPYQCAECGKGFSVGSQLQAHQRCHTGEKPYQCEECGKGFCRASNFLAHRGVHTGEKPYRCDVCGKRFRQRSYLQAHQRVHTGERPYKCEECGKVFSWSSYLQAHQRVHTGEKPYKCEECGKGFSWSSSLIIHQRVHADDEGDKDFPSSEDSHRKTR

SEQ ID NO: 70666 - protein, 538 aa, Homo sapiens
MTKSKEAVTFKDVAVVFSEEELQLLDLAQRKLYRDVMLENFRNVVSVGHQSTPDGLPQLEREEKLWMMKMATQRDNSSGAKNLKEMETLQEVGLRYLPHEELFCSQIWQQITRELIKYQDSVVNIQRTGCQLEKRDDLHYKDEGFSNQSSHLQVHRVHTGEKPYKGEHCVKSFSWSSHLQINQRAHAGEKPYKCEKCDNAFRRFSSLQAHQRVHSRAKSYTNDASYRSFSQRSHLPHHQRVPTGENPYKYEECGRNVGKSSHCQAPLIVHTGEKPYKCEECGVGFSQRSYLQVHLKVHTGKKPYKCEECGKSFSWRSRLQAHERIHTGEKPYKCNACGKSFSYSSHLNIHCRIHTGEKPYKCEECGKGFSVGSHLQAHQISHTGEKPYKCEECGKGFCRASNLLDHQRGHTGEKPYQCDACGKGFSRSSDFNIHFRVHTGKNPINVRSVARASARPQIFWPIKEATLERNPTNVVHVGRASVGAQILMYTVESTQERNPINARGVVRPSVSSPAFRCIREFTLERNHISVQSVGRASV

SEQ ID NO: 70667 - protein, 562 aa, Homo sapiens
MAAAWMAPAQESVTFEDVAVTFTQEEWGQLDVTQRALYVEVMLETCGLLVALGDSTKPETVEPIPSHLALPEEVSLQEQLAQGVPRYSYLGQAMDQDGPSEMQEYFLRPGTDPQSEKLHGKMSLEHEGLATADGICSMMIQNQVSPEDALYGFDSYGPVTDSLIHEGENSYKFEEMFNENCFLVQHEQILPRVKPYDCPECGKAFGKSKHLLQHHIIHTGEKPYKCLECGKDFNRRSHLTRHQRTHNGDKPFVCSECGRTFNRGSHLTRHQRVHSGEKPFVCNECGKAFTYRSNFVLHNKSHNEKKPFACSECGKGFYESTALIQHFIIHTGERPFKCLECGKAFNCRSHLKQHERIHTGEKPFVCSQCGKAFTHYSTYVLHERAHTGEKPFECKECGKAFSIRKDLIRHFNIHTGEKPYECLQCGKAFTRMSGLTRHQWIHTGEKPYVCIQCGKAFCRTTNLIRHFSIHTGEKPYECVECGKAFNRRSPLTRHQRIHTAEKSHEPIQSGNVSCESTDLIQHSIIHTESSPVSAVNMETPSIAAHSSSLDINGFIVEETLPL

SEQ ID NO: 70668 - protein, 521 aa, Homo sapiens
MLETCGLLVALGDSTKPETVEPIPSHLALPEEVSLQEQLAQGVPRYSYLGQAMDQDGPSEMQEYFLRPGTDPQSEKLHGKMSLEHEGLATADGICSMMIQNQVSPEDALYGFDSYGPVTDSLIHEGENSYKFEEMFNENCFLVQHEQILPRVKPYDCPECGKAFGKSKHLLQHHIIHTGEKPYKCLECGKDFNRRSHLTRHQRTHNGDKPFVCSECGRTFNRGSHLTRHQRVHSGEKPFVCNECGKAFTYRSNFVLHNKSHNEKKPFACSECGKGFYESTALIQHFIIHTGERPFKCLECGKAFNCRSHLKQHERIHTGEKPFVCSQCGKAFTHYSTYVLHERAHTGEKPFECKECGKAFSIRKDLIRHFNIHTGEKPYECLQCGKAFTRMSGLTRHQWIHTGEKPYVCIQCGKAFCRTTNLIRHFSIHTGEKPYECVECGKAFNRRSPLTRHQRIHTAEKSHEPIQSGNVSCESTDLIQHSIIHTESSPVSAVNMETPSIAAHSSSLDINGFIVEETLPL

SEQ ID NO: 70669 - protein, 540 aa, Homo sapiens
MAHELVMFRDVAIDVSQEEWECLNPAQRNLYKEVMLENYSNLVSLGLSVSKPAVISSLEQGKEPWMVVREETGRWCPDLASRDEPQKLSPKRDIYETELSQWVNMEEFKSHSPERSIFSAIWEGNCHFEQHQGQEEGYFRQLMINHENMPIFSQHTLLTQEFYDREKISECKKCRKIFSYHLFFSHHKRTHSKELSECKECTEIVNTPCLFKQQTIQNGDKCNECKECWKAFVHCSQLKHLRIHNGEKRYECNECGKAFNYGSELTLHQRIHTGEKPYECKECGKAFRQRSQLTQHQRLHTGEKPYECKQCGKAFIRGFQLTEHLRLHTGEKPYECKECGKTFRHRSHLTIHQRIHTGEKPYECRECGKAFSYHSSFSHHQKIHSGKKPYECHECGKAFCDGLQLTLHQRIHTGEKPYECKECGKTFRQCSHLKRHQRIHTGEKPHECMICGKAFRLHSHLIQHQRIHTGEKPYECKECGKAFSYHSSFSHHQRIHSGKKPYQCGKAFNHRLQLNLHQTLHTGEKPVRFPLLPPHPSLAS

SEQ ID NO: 70670 - protein, 246 aa, Homo sapiens
MVVREETGRWCPGTWKTWGFHNNFLDNNEATDINADLASRDEPQKLSPKRDIYETELSQWVNMEEFKSHSPERSIFSAIWEGNCHFEQHQGQEEGYFRQLMINHENMPIFSQHTLLTQEFYDREKISECKKCRKIFSYHLFFSHHKCSHLKRHQRIHTGEKPHECMICGKAFRLHSHLIQHQRIHTGEKPYECKECGKAFSYHSSFSHHQRIHSGKKPYQCGKAFNHRLQLNLHQTLHTGEKPVRF

SEQ ID NO: 70671 - protein, 563 aa, Homo sapiens
MAHELVMFRDVAIDVSQEEWECLNPAQRNLYKEVMLENYSNLVSLGLSVSKPAVISSLEQGKEPWMVVREETGRWCPGTWKTWGFHNNFLDNNEATDINADLASRDEPQKLSPKRDIYETELSQWVNMEEFKSHSPERSIFSAIWEGNCHFEQHQGQEEGYFRQLMINHENMPIFSQHTLLTQEFYDREKISECKKCRKIFSYHLFFSHHKRTHSKELSECKECTEIVNTPCLFKQQTIQNGDKCNECKECWKAFVHCSQLKHLRIHNGEKRYECNECGKAFNYGSELTLHQRIHTGEKPYECKECGKAFRQRSQLTQHQRLHTGEKPYECKQCGKAFIRGFQLTEHLRLHTGEKPYECKECGKTFRHRSHLTIHQRIHTGEKPYECRECGKAFSYHSSFSHHQKIHSGKKPYECHECGKAFCDGLQLTLHQRIHTGEKPYECKECGKTFRQCSHLKRHQRIHTGEKPHECMICGKAFRLHSHLIQHQRIHTGEKPYECKECGKAFSYHSSFSHHQRIHSGKKPYQCGKAFNHRLQLNLHQTLHTGEKPVRFPLLPPHPSLAS

SEQ ID NO: 70672 - protein, 258 aa, Homo sapiens
EKRYECNECGKAFNYGSELTLHQRIHTGEKPYECKECGKAFRQRSQLTQHQRLHTGEKPYECKQCGKAFIRGFQLTEHLRLHTGEKPYECKECGKTFRHRSHLTIHQRIHTGEKPYECRECGKAFSYHSSFSHHQKIHSGKKPYECHECGKAFCDGLQLTLHQRIHTGEKPYECKECGKTFRQCSHLKRHQRIHTGEKPHECMICGKAFRLHSHLIQHQRIHTGEKPYECKECGKAFSYHSSFSHHQRIHSDATTAIS

SEQ ID NO: 70673 - protein, 436 aa, Homo sapiens
MEEFKSHSPERSIFSAIWEGNCHFEQHQGQEEGYFRQLMINHENMPIFSQHTLLTQEFYDREKISECKKCRKIFSYHLFFSHHKRTHSKELSECKECTEIVNTPCLFKQQTIQNGDKCNECKECWKAFVHCSQLKHLRIHNGEKRYECNECGKAFNYGSELTLHQRIHTGEKPYECKECGKAFRQRSQLTQHQRLHTGEKPYECKQCGKAFIRGFQLTEHLRLHTGEKPYECKECGKTFRHRSHLTIHQRIHTGEKPYECRECGKAFSYHSSFSHHQKIHSGKKPYECHECGKAFCDGLQLTLHQRIHTGEKPYECKECGKTFRQCSHLKRHQRIHTGEKPHECMICGKAFRLHSHLIQHQRIHTGEKPYECKECGKAFSYHSSFSHHQRIHSGKKPYQCGKAFNHRLQLNLHQTLHTGEKPVRFPLLPPHPSLAS

SEQ ID NO: 70674 - protein, 563 aa, Homo sapiens; identical to SEQ ID NO: 70671

SEQ ID NO: 70675 - protein, 595 aa, Homo sapiens
MRETLEALSSLGFSVGQPEMAPQSEPREGSHNAQEQMSSSREERALGVCSGHEAPTPEEGAHTEQAEAPCRGQACSAQKAQPVGTCPGEEWMIRKVKVEDEDQEAEEEVEWPQHLSLLPSPFPAPDLGHLAAAYKLEPGAPGALSGLALSGWGPMPEKPYGCGECERRFRDQLTLRLHQRLHRGEGPCACPDCGRSFTQRAHMLLHQRSHRGERPFPCSECDKRFSKKAHLTRHLRTHTGERPYPCAECGKRFSQKIHLGSHQKTHTGERPFPCTECEKRFRKKTHLIRHQRIHTGERPYQCAQCARSFTHKQHLVRHQRVHQTAGPARPSPDSSASPHSTAPSPTPSFPGPKPFACSDCGLSFGWKKNLATHQCLHRSEGRPFGCDECALGATVDAPAAKPLASAPGGPGCGPGSDPVVPQRAPSGERSFFCPDCGRGFSHGQHLARHPRVHTGERPFACTQCDRRFGSRPNLVAHSRAHSGARPFACAQCGRRFSRKSHLGRHQAVHTGSRPHACAVCARSFSSKTNLVRHQAIHTGSRPFSCPQCGKSFSRKTHLVRHQLIHGEAAHAAPDAALAAPAWSAPPEVAPPPLFF

SEQ ID NO: 70676 - protein, 3925 aa, Homo sapiens
MPGERPRGAPPPTMTGDLQPRQVASSPGHPSQPPLEDNTPATRTTKGAREAGGQAQAMELPEAQPRQARDGELKPPSLRGQAPSSTPGKRGSPQTPPGRSPLQAPSRLAGRAEGSPPQRYILGIASSRTKPTLDETPENPQLEAAQLPEVDTPQGPGTGAPLRPGLPRTEAQPAAEELGFHRCFQEPPSSFTSTNYTSPSATPRPPAPGPPQSRGTSPLQPGSYPEYQASGADSWPPAAENSFPGANFGVPPAEPEPIPKGSRPGGSPRGVSFQFPFPALHGASTKPFPADVAGHAFTNGPLVFAFHQPQGAWPEEAVGTGPAYPLPTQPAPSPLPCYQGQPGGLNRHSDLSGALSSPGAAHSAPRPFSDSLHKSLTKILPERPPSAQDGLGSTRGPPSSLPQRHFPGQAYRASGVDTSPGPPDTELAAPGPPPARLPQLWDPTAAPYPTPPGGPLAATRSMFFNGQPSPGQRLCLPQSAPLPWPQVLPTARPSPHGMEMLSRLPFPAGGPEWQGGSQGALGTAGKTPGPREKLPAVRSSQGGSPALFTYNGMTDPGAQPLFFGVAQPQVSPHGTPSLPPPRVVGASPSESPLPSPATNTAGSTCSSLSPMSSSPANPSSEESQLPGPLGPSAFFHPPTHPQETGSPFPSPEPPHSLPTHYQPEPAKAFPFPADGLGAEGAFQCLEETPFPHEGPEVGRGGLQGFPRAPPPYPTHHFSLSSASLDQLDVLLTCRQCDRNYSSLAAFLAHRQFCGLLLARAKDGHQRSPGPPGLPSPPAAPRVPADAHAGLLSHAKTFLLAGDAQAEGKDDPLRTGFLPSLAATPFPLPASDLDMEDDAKLDSLITEALNGMEYQSDNPEIDSSFIDVFADEEPSGPRGPSSGHPLKSKAGVTPESKAPPPLPAATPDPQTPRPGDRGCPARGRPKTRSLGLAPTEADAPSQGRQQRRGKQLKLFRKDLDSGGAAEGSGSGGGGRASGLRPRRNDGLGERPPPRPRRPRTQAPGSRADPAPRVPRAAALPEETRSSRRRRLPPRKDPRKRKARGGAWGKELILKIVQQKNRLREYDFASESEEDEQPPPRGPGFRGRRGRGEKRKEVELTQGPREDEPQKPRKAARQEAGGDGAPANPEEPGGSRPGPGRSPQARGPSRSLETGAAAREGGPKCADRPSVAPKDPLQVPTNTETSEETRPSLDFPQEAKEPETAEESAPDSTEFTEALRSPPAACAGEMGASPGLLIPEQPPPSRHDTGTPKPSGSLANTAPHGSSPTPGVGSLLGGPGGTQAPVSHNSKDPPARQPGEFLAPVANPSSTACPKPSVLSSKISSFGCDPAGFNRDPLGVPVAKKGPQPYSSPHSELFLGPKDLAGCFLEELHPKPSARDAPPASSSCLCQDGEDAGSLEPQLPRSPPGTAETEPGRAASPPTLESSSLFPDLPVDRFDPPLYGSLSANRDSGLPFACADPPQKTVPSDPPYPSFLLLEEVSPMLPSHFPDLSGGKVLSKTCPPERTVVPGAAPSLPGKGSGCSVALMSHLSEDELEIQKLVTELESQLQRSKDTRGAPRELAEAESVGRVELGTGTEPPSQRRTCQATVPHEDTFSAADLTRVGESTAHREGAESAVATVEAVQGRPGGTWPCPASFHPGHAALLPCAQEDLVSGAPFSPRGANFHFQPVQKAGASKTGLCQAEGDSRPPQDVCLPEPSKQPGPQLDAGSLAKCSPDQELSFPKNKEAASSQESEDSLRLLPCEQRGGFLPEPGTADQPHRGAPAPEAFGSPAVHLAPDLAFQGDGAPPLDATWPFGASPSHAAQGHSAGRAGGHLHPTAGRPGFEGNEFAPAGASSLTAPRGREAWLVPVPSPACVSNTHPSRRSQDPALSPPIRQLQLPGPGVAKSKDGILGLQELTPAAQSPPRVNPSGLEGGTVEGGKVACGPAQGSPGGVQVTTLPAVAGHQLGLEADGHWGLLGQAEKTQGQGTANQLQPENGVSPGGTDNHASVNASPKTALTGPTEGAVLLEKCKGSRAAMSLQEEAEPTPSPPSPNRESLALALTAAHSRSGSEGRTPERASSPGLNKPLLATGDSPAPSVGDLAACAPSPTSAAHMPCSLGPLPREDPLTSPSRAQGGLGGQLPASPSCRDPPGPQQLLACSPAWAPLEEADGVQATTDTGAEDSPVAPPSLTTSPCDPKEALAGCLLQGEGSPLEDPSSWPPGSVSAVTCTHSGDTPKDSTLRIPEDSRKEKLWESPGRATSPPLAGAVSPSVAVRATGLSSTPTGDEAQAGRGLPGPDPQSRGAPPHTNPDRMPRGHSSYSPSNTARLGHREGQAVTAVPTEPPTLQGAGPDSPACLEGEMGTSSKEPEDPGTPETGRSGATKMPRVTCPSTGLGLGRTTAPSSTASDFQSDSPQSHRNASHQTPQGDPLGPQDLKQRSRGYKKKPASTENGQWKGQAPHGPVTCEVCAASFRSGPGLSRHKARKHRPHPGAPAEPSPAALPAQQPLEPLAQKCQPPRKKSHRVSGKERPNHSRGDPSHVTQPPPAQGSKEVLRAPGSPHSQQLHPPSPTEHEVDVKTPASKPRPDQAREDELHPKQAEKREGRRWRREPTVDSPSHSEGKSNKKRGKLRGRRLREESILPVSADVISDGRGSRPSPAMASYAASPSHCLSVEGGPEADGEQPPRLATLGPGVMEGAAETDQEALCAGETGAQKPPGDRMLCPGRMDGAALGEQPTGQKGASARGFWGPRETKALGVCKESGSEPAEDSSRAHSRSEEGVWEENTPPLGPLGFPETSSSPADSTTSSCLQGLPDNPDTQGGVQGPEGPTPDASGSSAKDPPSLFDDEVSFSQLFPPGGRLTRKRNPHVYGKRCEKPVLPLPTQPSFEEGGDPTLGPARLPTDLSDSSSLCLCHEDPWEDEDPAGLPESFLLDGFLNSRVPGIDPWAPGLSLWALEPSREAGAEKLPSHCPEDDRPEAIPELHMVPAAWRGLEMPAPADDSSSSLGDVSPEPPSLERERCDGGLPGNTHLLPLRATDFEVLSTKFEMQDLCFLGPFEDPVGLPGPSFLDFEGTASSQGPQSRRTEEAAGAGRAQGRGRPAKGRRASYKCKVCFQRFRSLGELDLHKLAHTPAPPPTCYMCVERRFGSRELLRGHLQERHAQSKAGPWACGMCLKEVADVWMYNEHLREHAVRFARRGQARRSLGDLPGGLEGSSAVAHLLNSITEPAPKHHRGKRSAGKAAGSPGDPWGQEGEAKKDSPGERAKPRARSTPSNPDGAATPDSASATALADAGSPGPPRTTPSPSPDPWAGGEPLLQATPVHEACKDPSRDCHHCGKRFPKPFKLQRHLAVHSPQRVYLCPRCPRVYPEHGELLAHLGGAHGLLERPELQHTPLYACELCATVMRIIKKSFACSSCNYTFAKKEQFDRHMNKHLRGGRQPFAFRGVRRPGAPGQKARALEGTLPSKRRRVAMPGSAPGPGEDRPPPRGSSPILSEGSLPALLHLCSEVAPSTTKGWPETLERPVDPVTHPIRGCELPSNHQECPPPSLSPFPAALADGRGDCALDGALERPENEASPGSPGPLLQQALPLGASLPRPGARGQDAEGKRAPLVFSGKRRAPGARGRCAPDHFQEDHLLQKEKEVSSSHMVSEGGPRGTFHKGSATKPAGCQSSSKDRSAASTPSKALKFPVHPRKAVGSLAPGELARGTENGMKPATPKAKPGPSSQGSGSPRPGTKTGGGSQPQPASGQLQSETATTPAKPSFPSRSPAPERLPARAQAKSCTKGPREAGEQGPHGSLGPKEKGESSTKRKKGQVPGPARSESVGSFGRAPSAPDKPPRTPRKQATPSRVLPTKPKPNSQNKPRPPPSEQRKAEPGHTQRKDRLGKAFPQGRPLLRPPKRGTAVHGAEPAEPHTHRTAEAQSDLLSQLFGQRLTGFKIPLKKDASE

SEQ ID NO: 70677 - protein, 492 aa, Homo sapiens
MLCDEKAQKRRKRKAKESGMALPQGHLTFRDVAIEFSQAEWKCLDPAQRALYKDVMLENYRNLVSLGSSYALGSNAEDKPIKKQLGVSFHLHLSELELFPDERVINGCNQVENFINHSSSVSCLQEMSSSVKTPIFNRNDFDDSSFLPQEQKVHLREKPYECNEHSKVFRVSSSLTKHQVIHTVEKPYKCNSCGKVFSRNSHLAEHCRIHTGEKPYKCNVCGKVFSYNSNFARHQRIHTREKPYECNECGKVFSNNSYLARHQRIHAEEKPYKCNECGKGFSHKSSLANHWRIYTGEKPYKCDECGKAFYRIALLVRHQKIHTGEKPYKCNECGKVFIQNSHLAQHWRIHTGEKPYKCNECGKVFNQLSNLARHRRIHTGEKPYKCNECGKAFSEYSGLSAHLVIHTGEKPYKCSECGKAFRHKLSLTNHQRIHTGERPYKCNECGKVFNRIAHLARHRKIHTGEKPYKCNECGKAFSRISYLAQHWTIHMG

SEQ ID NO: 70678 - protein, 458 aa, Homo sapiens
MLEQRREPWSGESEVKIAKNSDGRECIKGVNTGSSYALGSNAEDKPIKKQLGVSFHLHLSELELFPDERVINGCNQVENFINHSSSVSCLQEMSSSVKTPIFNRNDFDDSSFLPQEQKVHLREKPYECNEHSKVFRVSSSLTKHQVIHTVEKPYKCNSCGKVFSRNSHLAEHCRIHTGEKPYKCNVCGKVFSYNSNFARHQRIHTREKPYECNECGKVFSNNSYLARHQRIHAEEKPYKCNECGKGFSHKSSLANHWRIYTGEKPYKCDECGKAFYRIALLVRHQKIHTGEKPYKCNECGKVFIQNSHLAQHWRIHTGEKPYKCNECGKVFNQLSNLARHRRIHTGEKPYKCNECGKAFSEYSGLSAHLVIHTGEKPYKCSECGKAFRHKLSLTNHQRIHTGERPYKCNECGKVFNRIAHLARHRKIHTGEKPYKCNECGKAFSRISYLAQHWTIHMG

SEQ ID NO: 70679 - protein, 178 aa, Homo sapiens
FPQTRKRIAWSEGHAAARLTSKESCCEKAQKRRKRKAKESGMALPQGHLTFRDVAIEFSQAEWKCLDPAQRALYKDVMLENYRNLVSLGISLPDLNINSMLEQRREPWSGESEVKIAKNSDGRECIKGVNTGSSYALGSNAEDKPIKKQLGVSFHLHLSELELFPDERVINGCNQVEN

SEQ ID NO: 70680 - protein, 535 aa, Homo sapiens
MLCDEKAQKRRKRKAKESGMALPQGHLTFRDVAIEFSQAEWKCLDPAQRALYKDVMLENYRNLVSLGISLPDLNINSMLEQRREPWSGESEVKIAKNSDGRECIKGVNTGSSYALGSNAEDKPIKKQLGVSFHLHLSELELFPDERVINGCNQVENFINHSSSVSCLQEMSSSVKTPIFNRNDFDDSSFLPQEQKVHLREKPYECNEHSKVFRVSSSLTKHQVIHTVEKPYKCNSCGKVFSRNSHLAEHCRIHTGEKPYKCNVCGKVFSYNSNFARHQRIHTREKPYECNECGKVFSNNSYLARHQRIHAEEKPYKCNECGKGFSHKSSLANHWRIYTGEKPYKCDECGKAFYRIALLVRHQKIHTGEKPYKCNECGKVFIQNSHLAQHWRIHTGEKPYKCNECGKVFNQLSNLARHRRIHTGEKPYKCNECGKAFSEYSGLSAHLVIHTGEKPYKCSECGKAFRHKLSLTNHQRIHTGERPYKCNECGKVFNRIAHLARHRKIHTGEKPYKCNECGKAFSRISYLAQHWTIHMG

SEQ ID NO: 70681 - protein, 535 aa, Homo sapiens; identical to SEQ ID NO: 70680

SEQ ID NO: 70682 - protein, 587 aa, Homo sapiens
MPTALCPRVLAPKESEEPRKMRSPPGENPSPQGELPSPESSRRLFRRFRYQEAAGPREALQRLWDLCGGWLRPERHTKEQILELLVLEQFLAILPREIQSWVRAQEPESGEQAVAAVEALEREPGRPWQWLKHCEDPVVIDDGDSPLDQEQEQLPVEPHSDLAKNQDAQPITLAQCLGLPSRPPSQLSGDPVLQDAFLLQEENVRDTQQVTTLQLPPSRVSPFKDMILCFSEEDWSLLDPAQTGFYGEFIIGEDYGVSMPPNDLAAQPDLSQGEENEPRVPELQDLQGKEVPQVSYLDSPSLQPFQVEERRKREELQVPEFQACPQTVVPQNTYPAGGNPRSLENSLDEEVTIEIVLSSSGDEDSQHGPYCTEELGSPTEKQRSLPASHRSSTEAGGEVQTSKKSYVCPNCGKIFRWRVNFIRHLRSRREQEKPHECSVCGELFSDSEDLDGHLESHEAQKPYRCGACGKSFRLNSHLLSHRRIHLQPDRLQPVEKREQAASEDADKGPKEPLENGKAKLSFQCCECGKAFQRHDHLARHRSHFHLKDKARPFQCRYCVKSFTQNYDLLRHERLHMKRRSKQALNSY

SEQ ID NO: 70683 - protein, 623 aa, Homo sapiens
MPTALCPRVLAPKESEEPRKMRSPPGENPSPQGELPSPESSRRLFRRFRYQEAAGPREALQRLWDLCGGWLRPERHTKEQILELLVLEQFLAILPREIQSWVRAQEPESGEQAVAAVEALEREPGRPWQWLKHCEDPVVIDDGDSPLDQEQEQLPVEPHSDLAKNQDAQPITLAQCLGLPSRPPSQLSGDPVLQDAFLLQEENVRDTQQVTTLQLPPRIFQFNNHRSNGYILEMLGSGGKKAQIISVLSQIYVSRVSPFKDMILCFSEEDWSLLDPAQTGFYGEFIIGEDYGVSMPPNDLAAQPDLSQGEENEPRVPELQDLQGKEVPQVSYLDSPSLQPFQVEERRKREELQVPEFQACPQTVVPQNTYPAGGNPRSLENSLDEEVTIEIVLSSSGDEDSQHGPYCTEELGSPTEKQRSLPASHRSSTEAGGEVQTSKKSYVCPNCGKIFRWRVNFIRHLRSRREQEKPHECSVCGELFSDSEDLDGHLESHEAQKPYRCGACGKSFRLNSHLLSHRRIHLQPDRLQPVEKREQAASEDADKGPKEPLENGKAKLSFQCCECGKAFQRHDHLARHRSHFHLKDKARPFQCRYCVKSFTQNYDLLRHERLHMKRRSKQALNSY

SEQ ID NO: 70684 - protein, 609 aa, Homo sapiens
MSTAPSLSALRSSKHSGGGGGGGGGGGADPAWTSALSGNSSGPGPGSSPAGSTKPFVHAVPPSDPLRQANRLPIKVLKMLTARTGHILHPEYLQPLPSTPVSPIELDAKKSPLALLAQTCSQIGKPDPSPSSKLSSVASNGGGAGGAGGGAAGDKDTKSGPLKLSDIGVEDKSSFKPYSKPGSDKKEPGGGGGGGGGGGGGGGGVSSEKSGFRVPSATCQPFTPRTGSPSSSASAEGGPTGLAHGRISCGGGINVDVNQHPDGGPGGKALGSDCGGSSGSSSGSGPSAPTSSSVLGSGLVAPVSPYKPGQTVFPLPPAGMTYPGSLAGAYAGYPPQFLPHGVALDPTKPGSLVGAQLAAAAAGSLGCSKPAGSSPLAGASPPSVMTASLCRDPYCLSYHCASHLAGAAAASASCAHDPAAAAAALKSGYPLVYPTHPLHGVHSSLTAAAAAGATPPSLAGHPLYPYGFMLPNDPLPHICNWVSANGPCDKRFATSEELLSHLRTHTAFPGTDKLLSGYPSSSSLASAAAAAMACHMHIPTSGAPGSPGTLALRSPHHALGLSSRYHPYSKSPLPTPGAPVPVPAATGPYYSPYALYGQRLTTASALGYQ

SEQ ID NO: 70685 - protein, 646 aa, Homo sapiens
MSTAPSLSALRSSKHSGGGGGGGGGGGADPAWTSALSGNSSGPGPGSSPAGSTKPFVHAVPPSDPLRQANRLPIKVLKMLTARTGHILHPEYLQPLPSTPVSPIELDAKKSPLALLAQTCSQIGKPDPSPSSKLSSVASNGGGAGGAGGGAAGDKDTKSGPLKLSDIGVEDKSSFKPYSKPGSDKKEPGGGGGGGGGGGGGGGGVSSEKSGFRVPSATCQPFTPRTGSPSSSASACSPGGMLSSAGGAPEGKDDKKDTDVGGGGKGTGGASAEGGPTGLAHGRISCGGGINVDVNQHPDGGPGGKALGSDCGGSSGSSSGSGPSAPTSSSVLGSGLVAPVSPYKPGQTVFPLPPAGMTYPGSLAGAYAGYPPQFLPHGVALDPTKPGSLVGAQLAAAAAGSLGCSKPAGSSPLAGASPPSVMTASLCRDPYCLSYHCASHLAGAAAASASCAHDPAAAAAALKSGYPLVYPTHPLHGVHSSLTAAAAAGATPPSLAGHPLYPYGFMLPNDPLPHICNWVSANGPCDKRFATSEELLSHLRTHTAFPGTDKLLSGYPSSSSLASAAAAAMACHMHIPTSGAPGSPGTLALRSPHHALGLSSRYHPYSKSPLPTPGAPVPVPAATGPYYSPYALYGQRLTTASALGYQ

SEQ ID NO: 70686 - protein, 646 aa, Homo sapiens; identical to SEQ ID NO: 70685

SEQ ID NO: 70687 - protein, 541 aa, Homo sapiens
MPRRKQSHPQPVKCEGVKVDTEDSLDEGPGALVLESDLLLGQDLEFEEEEEEEEGDGNSDQLMGFERDSEGDSLGARPGLPYGLSDDESGGGRALSAESEVEEPARGPGEARGERPGPACQLCGGPTGEGPCCGAGGPGGGPLLPPRLLYSCRLCTFVSHYSSHLKRHMQTHSGEKPFRCGRCPYASAQLVNLTRHTRTHTGEKPYRCPHCPFACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHGHGGAGGPGLSASEGWAPPHSPPSVLSSRGPPALGTAGSRAVHTDSS

SEQ ID NO: 70688 - protein, 479 aa, Homo sapiens
MGFERDSEGDSLGARPGLPYGLSDDESGGGRALSAESEVEEPARGPGEARGERPGPACQLCGGPTGEGPCCGAGGPGGGPLLPPRLLYSCRLCTFVSHYSSHLKRHMQTHSGEKPFRCGRCPYASAQLVNLTRHTRTHTGEKPYRCPHCPFACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHGHGGAGGPGLSASEGWAPPHSPPSVLSSRGPPALGTAGSRAVHTDSS

SEQ ID NO: 70689 - protein, 1311 aa, Homo sapiens
MSRRKQAKPRSLKDPNCKLEDKTEDGEALDCKKRPEDGEELEDEAVHSCDSCLQVFESLSDITEHKINQCQLTDGVDVEDDPTCSWPASSPSSKDQTSPSHGEGCDFGEEEGGPGLPYPCQFCDKSFSRLSYLKHHEQSHSDKLPFKCTYCSRLFKHKRSRDRHIKLHTGDKKYHCSECDAAFSRSDHLKIHLKTHTSNKPYKCAICRRGFLSSSSLHGHMQVHERNKDGSQSGSRMEDWKMKDTQKCSQCEEGFDFPEDLQKHIAECHPECSPNEDRAALQCVYCHELFVEETSLMNHMEQVHSGEKKNSCSICSESFHTVEELYSHMDSHQQPESCNHSNSPSLVTVGYTSVSSTTPDSNLSVDSSTMVEAAPPIPKSRGRKRAAQQTPDMTGPSSKQAKVTYSCIYCNKQLFSSLAVLQIHLKTMHLDKPEQAHICQYCLEVLPSLYNLNEHLKQVHEAQDPGLIVSAMPAIVYQCNFCSEVVNDLNTLQEHIRCSHGFANPAAKDSNAFFCPHCYMGFLTDSSLEEHIRQVHCDLSGSRFGSPVLGTPKEPVVEVYSCSYCTNSPIFNSVLKLNKHIKENHKNIPLALNYIHNGKKSRALSPLSPVAIEQTSLKMMQAVGGAPARPTGEYICNQCGAKYTSLDSFQTHLKTHLDTVLPKLTCPQCNKEFPNQESLLKHVTIHFMITSTYYICESCDKQFTSVDDLQKHLLDMHTFVFFRCTLCQEVFDSKVSIQLHLAVKHSNEKKVYRCTSCNWDFRNETDLQLHVKHNHLENQGKVHKCIFCGESFGTEVELQCHITTHSKKYNCKFCSKAFHAIILLEKHLREKHCVFETKTPNCGTNGASEQVQKEEVELQTLLTNSQESHNSHDGSEEDVDTSEPMYGCDICGAAYTMETLLQNHQLRDHNIRPGESAIVKKKAELIKGNYKCNVCSRTFFSENGLREHMQTHLGPVKHYMCPICGERFPSLLTLTEHKVTHSKSLDTGNCRICKMPLQSEEEFLEHCQMHPDLRNSLTGFRCVVCMQTVTSTLELKIHGTFHMQKTGNGSAVQTTGRGQHVQKLYKCASCLKEFRSKQDLVKLDINGLPYGLCAGCVNLSKSASPGINVPPGTNRPGLGQNENLSAIEGKGKVGGLKTRCSSCNVKFESESELQNHIQTIHRELVPDSNSTQLKTPQVSPMPRISPSQSDEKKTYQCIKCQMVFYNEWDIQVHVANHMIDEGLNHECKLCSQTFDSPAKLQCHLIEHSFEGMGGTFKCPVCFTVFVQANKLQQHIFSAHGQEDKIYDCTQCPQKFFFQTELQNHTMTQHSS

SEQ ID NO: 70690 - protein, 1311 aa, Homo sapiens
ISRAQKAQTRRLNDPNCKLEDKTEDGEALDCKKRPEDGEELEDEAVHSCDSCLQVFESLSDITEHKINQCQLTDGVDVEDDPTCSWPASSPSSKDQTSPSHGEGCDFGEEEGGPGLPYPCQFCDKSFSRLSYLKHHEQSHSDKLPFKCTYCSRLFKHKRSRDRHIKLHTGDKKYHCSECDAAFSRSDHLKIHLKTHTSNKPYKCAICRRGFLSSSSLHGHMQVHERNKDGSQSGSRMEDWKMKDTQKCSQCEEGFDFPEDLQKHIAECHPECSPNEDRAALQCVYCHELFVEETSLMNHMEQVHSGEKKNSCSICSESFHTVEELYSHMDSHQQPESCNHSNSPSLVTVGYTSVSSTTPDSNLSVDSSTMVEAAPPIPKSRGRKRAAQQTPDMTGPSSKQAKVTYSCIYCNKQLFSSLAVLQIHLKTMHLDKPEQAHICQYCLEVLPSLYNLNEHLKQVHEAQDPGLIVSAMPAIVYQCNFCSEVVNDLNTLQEHIRCSHGFANPAAKDSNAFFCPHCYMGFLTDSSLEEHIRQVHCDLSGSRFGSPVLGTPKEPVVEVYSCSYCTNSPIFNSVLKLNKHIKENHKNIPLALNYIHNGKKSRALSPLSPVAIEQTSLKMMQAVGGAPARPTGEYICNQCGAKYTSLDSFQTHLKTHLDTVLPKLTCPQCNKEFPNQESLLKHVTIHFMITSTYYICESCDKQFTSVDDLQKHLLDMHTFVFFRCTLCQEVFDSKVSIQLHLAVKHSNEKKVYRCTSCNWDFRNETDLQLHVKHNHLENQGKVHKCIFCGESFGTEVELQCHITTHSKKYNCKFCSKAFHAIILLEKHLREKHCVFETKTPNCGTNGASEQVQKEEVELQTLLTNSQESHNSHDGSEEDVDTSEPMYGCDICGAAYTMETLLQNHQLRDHNIRPGESAIVKKKAELIKGNYKCNVCSRTFFSENGLREHMQTHLGPVKHYMCPICGERFPSLLTLTEHKVTHSKSLDTGNCRICKMPLQSEEEFLEHCQMHPDLRNSLTGFRCVVCMQTVTSTLELKIHGTFHMQKTGNGSAVQTTGRGQHVQKLYKCASCLKEFRSKQDLVKLDINGLPYGLCAGCVNLSKSASPGINVPPGTNRPGLGQNENLSAIEGKGKVGGLKTRCSSCNVKFESESELQNHIQTIHRELVPDSNSTQLKTPQVSPMPRISPSQSDEKKTYQCIKCQMVFYNEWDIQVHVANHMIDEGLNHECKLCSQTFDSPAKLQCHLIEHSFEGMGGTFKCPVCFTVFVQANKLQQHIFSAHGQEDKIYDCTQCPQKFFFQTELQVHTATPRQS

SEQ ID NO: 70691 - protein, 1345 aa, Homo sapiens
FLSDYVQSESLRVRGPLWSHPDGFGGLASIFHYYVDYRSDSAVQDLADPNCKLEDKTEDGEALDCKKRPEDGEELEDEAVHSCDSCLQVFESLSDITEHKINQCQLTDGVDVEDDPTCSWPASSPSSKDQTSPSHGEGCDFGEEEGGPGLPYPCQFCDKSFSRLSYLKHHEQSHSDKLPFKCTYCSRLFKHKRSRDRHIKLHTGDKKYHCSECDAAFSRSDHLKIHLKTHTSNKPYKCAICRRGFLSSSSLHGHMQVHERNKDGSQSGSRMEDWKMKDTQKCSQCEEGFDFPEDLQKHIAECHPECSPNEDRAALQCVYCHELFVEETSLMNHMEQVHSGEKKNSCSICSESFHTVEELYSHMDSHQQPESCNHSNSPSLVTVGYTSVSSTTPDSNLSVDSSTMVEAAPPIPKSRGRKRAAQQTPDMTGPSSKQAKVTYSCIYCNKQLFSSLAVLQIHLKTMHLDKPEQAHICQYCLEVLPSLYNLNEHLKQVHEAQDPGLIVSAMPAIVYQCNFCSEVVNDLNTLQEHIRCSHGFANPAAKDSNAFFCPHCYMGFLTDSSLEEHIRQVHCDLSGSRFGSPVLGTPKEPVVEVYSCSYCTNSPIFNSVLKLNKHIKENHKNIPLALNYIHNGKKSRALSPLSPVAIEQTSLKMMQAVGGAPARPTGEYICNQCGAKYTSLDSFQTHLKTHLDTVLPKLTCPQCNKEFPNQESLLKHVTIHFMITSTYYICESCDKQFTSVDDLQKHLLDMHTFVFFRCTLCQEVFDSKVSIQLHLAVKHSNEKKVYRCTSCNWDFRNETDLQLHVKHNHLENQGKVHKCIFCGESFGTEVELQCHITTHSKKYNCKFCSKAFHAIILLEKHLREKHCVFETKTPNCGTNGASEQVQKEEVELQTLLTNSQESHNSHDGSEEDVDTSEPMYGCDICGAAYTMETLLQNHQLRDHNIRPGESAIVKKKAELIKGNYKCNVCSRTFFSENGLREHMQTHLGPVKHYMCPICGERFPSLLTLTEHKVTHSKSLDTGNCRICKMPLQSEEEFLEHCQMHPDLRNSLTGFRCVVCMQTVTSTLELKIHGTFHMQKTGNGSAVQTTGRGQHVQKLYKCASCLKEFRSKQDLVKLDINGLPYGLCAGCVNLSKSASPGINVPPGTNRPGLGQNENLSAIEGKGKVGGLKTRCSSCNVKFESESELQNHIQTIHRELVPDSNSTQLKTPQVSPMPRISPSQSDEKKTYQCIKCQMVFYNEWDIQVHVANHMIDEGLNHECKLCSQTFDSPAKLQCHLIEHSFEGMGGTFKCPVCFTVFVQANKLQQHIFSAHGQEDKIYDCTQCPQKFFFQTELQVHTATPRQS

SEQ ID NO: 70692 - protein, 670 aa, Homo sapiens
MAEVVAEVAEMPTQMSPGAVEMSTPMSAEMMEMSTEVTEMTPGEALASSLFFQHHQFMCSECGSLYNTLEEVLSHQEQHMLAVSEEEALTTQNVGLEPELVPGAEGPFQCGECSQLILSPGELLAHQDAHLRESANQIQYQCWDCQELFPSPELWVAHRKAQHLSATVAEPPVPPPLPPPTPLPPPSPPSEVKMEPYECPECSTLCATPEEFLEHQGTHFDSLEKEERNGLEEEEEDDEEDEEDDEEMEDEEAMAEVGDDAVGGDESTAGWAQGCGDCPQHQPSAGARRQHRRTAHSPASATHPFHCSQCQRSFSSANRLQAHGRAHVGGTHECTTCSKVFKKAASLEQHLRLHRGEARYLCVDCGRGFGTELTLVAHRRAHTANPLHRCRCGKTFSNMTKFLYHRRTHAGKSGAPPTGATAPPAPAEPTPPPPPPAPPAQLPCPQCSKSFASASRLSRHRRAVHGPPERRHRCGVCGKGFKKLIHVRNHLRTHTGERPFQCHSCGKTFASLANLSRHQLTHTGARPYQCLDCGKRFTQSSNLQQHRRLHLRPVAFARAPRLPITGLYNKSPYYCGTCGRWFRAMAGLRLHQRVHARARTLTLQPPRSPSPAPPPPPEPQQTIMCTELGETIAIIETSQPLALEDTLQLCQAALGASEAGGLLQLDTAFV

SEQ ID NO: 70693 - protein, 526 aa, Homo sapiens
MAEVVAEVAEMPTQMSPGAVEMSTPMSAEMMEMSTEVTEMTPSPPSEVKMEPYECPECSTLCATPEEFLEHQGTHFDSLEKEERNGLEEEEEDDEEDEEDDEEMEDEEAMAEVGDDAVGGDESTAGWAQGCGDCPQHQPSAGARRQHRRTAHSPASATHPFHCSQCQRSFSSANRLQAHGRAHVGGTHECTTCSKVFKKAASLEQHLRLHRGEARYLCVDCGRGFGTELTLVAHRRAHTANPLHRCRCGKTFSNMTKFLYHRRTHAGKSGAPPTGATAPPAPAEPTPPPPPPAPPAQLPCPQCSKSFASASRLSRHRRAVHGPPERRHRCGVCGKGFKKLIHVRNHLRTHTGERPFQCHSCGKTFASLANLSRHQLTHTGARPYQCLDCGKRFTQSSNLQQHRRLHLRPVAFARAPRLPITGLYNKSPYYCGTCGRWFRAMAGLRLHQRVHARARTLTLQPPRSPSPAPPPPPEPQQTIMCTELGETIAIIETSQPLALEDTLQLCQAALGASEAGGLLQLDTAFV

SEQ ID NO: 70694 - protein, 660 aa, Homo sapiens
MAHALVTFRDVAIDFSQKEWECLDTTQRKLYRDVMLENYNNLVSLGYSGSKPDVITLLEQGKEPCVVARDVTGRQCPGLLSRHKTKKLSSEKDIHEISLSKESIIEKSKTLRLKGSIFRNEWQNKSEFEGQQGLKERSISQKKIVSKKMSTDRKRPSFTLNQRIHNSEKSCDSHLVQHGKIDSDVKHDCKECGSTFNNVYQLTLHQKIHTGEKSCKCEKCGKVFSHSYQLTLHQRFHTGEKPYECQECGKTFTLYPQLNRHQKIHTGKKPYMCKKCDKGFFSRLELTQHKRIHTGKKSYECKECGKVFQLIFYFKEHERIHTGKKPYECKECGKAFSVCGQLTRHQKIHTGVKPYECKECGKTFRLSFYLTEHRRTHAGKKPYECKECGKSFNVRGQLNRHKTIHTGIKPFACKVCEKAFSYSGDLRVHSRIHTGEKPYECKECGKAFMLRSVLTEHQRLHTGVKPYECKECGKTFRVRSQISLHKKIHTDVKPYKCVRCGKTFRFGFYLTEHQRIHTGEKPYKCKECGKAFIRRGNLKEHLKIHSGLKPYDCKECGKSFSRRGQFTEHQKIHTGVKPYKCKECGKAFSRSVDLRIHQRIHTGEKPYECKQCGKAFRLNSHLTEHQRIHTGEKPYECKVCRKAFRQYSHLYQHQKTHNVI

SEQ ID NO: 70695 - protein, 628 aa, Homo sapiens
MAHALVTFRDVAIDFSQKEWECLDTTQRKLYRDVMLENYNNLVSLGLLSRHKTKKLSSEKDIHEISLSKESIIEKSKTLRLKGSIFRNEWQNKSEFEGQQGLKERSISQKKIVSKKMSTDRKRPSFTLNQRIHNSEKSCDSHLVQHGKIDSDVKHDCKECGSTFNNVYQLTLHQKIHTGEKSCKCEKCGKVFSHSYQLTLHQRFHTGEKPYECQECGKTFTLYPQLNRHQKIHTGKKPYMCKKCDKGFFSRLELTQHKRIHTGKKSYECKECGKVFQLIFYFKEHERIHTGKKPYECKECGKAFSVCGQLTRHQKIHTGVKPYECKECGKTFRLSFYLTEHRRTHAGKKPYECKECGKSFNVRGQLNRHKTIHTGIKPFACKVCEKAFSYSGDLRVHSRIHTGEKPYECKECGKAFMLRSVLTEHQRLHTGVKPYECKECGKTFRVRSQISLHKKIHTDVKPYKCVRCGKTFRFGFYLTEHQRIHTGEKPYKCKECGKAFIRRGNLKEHLKIHSGLKPYDCKECGKSFSRRGQFTEHQKIHTGVKPYKCKECGKAFSRSVDLRIHQRIHTGEKPYECKQCGKAFRLNSHLTEHQRIHTGEKPYECKVCRKAFRQYSHLYQHQKTHNVI

SEQ ID NO: 70696 - protein, 628 aa, Homo sapiens; identical to SEQ ID NO: 70695

SEQ ID NO: 70697 - protein, 660 aa, Homo sapiens; identical to SEQ ID NO: 70694

SEQ ID NO: 70698 - protein, 499 aa, Homo sapiens
MAQGLVTFRDVAIEFSLEEWKCLEPAQRDLYREVTLENFGHLASLGLSISKPDVVSLLEQGKEPWMIANDVTGPWCPDLESRCEKFLQKDIFEIGAFNWEIMESLKCSDLEGSDFRADWECEGQFERQVNEECYFKQVNVTYGHMPVFQHHTSHTVRQSRETGEKLMECHECGKAFSRGSHLIQHQKIHTGEKPFGCKECGKAFSRASHLVQHQRIHTGEKPYDCKDCGKAFGRTSELILHQRLHTGVKPYECKECGKTFRQHSQLILHQRTHTGEKPYVCKDCGKAFIRGSQLTVHRRIHTGARPYECKECGKAFRQHSQLTVHQRIHTGEKPYECKECGKGFIHSSEVTRHQRIHSGEKPYECKECGKAFRQHAQLTRHQRVHTGDRPYECKDCGKAFSRSSYLIQHQRIHTGDKPYECKECGKAFIRVSQLTHHQRIHTCEKPYECRECGMAFIRSSQLTEHQRIHPGIKPYECRECGQAFILGSQLIEHYRIHTG

SEQ ID NO: 70699 - protein, 539 aa, Homo sapiens
MRRGPWERWSLASHRLDAGLCTCPREESREIRAGQIVLKAMAQGLVTFRDVAIEFSLEEWKCLEPAQRDLYREVTLENFGHLASLGLSISKPDVVSLLEQGKEPWMIANDVTGPWCPDLESRCEKFLQKDIFEIGAFNWEIMESLKCSDLEGSDFRADWECEGQFERQVNEECYFKQVNVTYGHMPVFQHHTSHTVRQSRETGEKLMECHECGKAFSRGSHLIQHQKIHTGEKPFGCKECGKAFSRASHLVQHQRIHTGEKPYDCKDCGKAFGRTSELILHQRLHTGVKPYECKECGKTFRQHSQLILHQRTHTGEKPYVCKDCGKAFIRGSQLTVHRRIHTGARPYECKECGKAFRQHSQLTVHQRIHTGEKPYECKECGKGFIHSSEVTRHQRIHSGEKPYECKECGKAFRQHAQLTRHQRVHTGDRPYECKDCGKAFSRSSYLIQHQRIHTGDKPYECKECGKAFIRVSQLTHHQRIHTCEKPYECRECGMAFIRSSQLTEHQRIHPGIKPYECRECGQAFILGSQLIEHYRIHTG

SEQ ID NO: 70700 - protein, 499 aa, Homo sapiens; identical to SEQ ID NO: 70698

SEQ ID NO: 70701 - protein, 686 aa, Homo sapiens
MTESQGTVTFKDVAIDFTQEEWKRLDPAQRKLYRNVMLENYNNLITVGYPFTKPDVIFKLEQEEEPWVMEEEVLRRHWQGEIWGVDEHQKNQDRLLRQVEVKFQKTLTEEKGNECQKKFANVFPLNSDFFPSRHNLYEYDLFGKCLEHNFDCHNNVKCLMRKEHCEYNEPVKSYGNSSSHFVITPFKCNHCGKGFNQTLDLIRHLRIHTGEKPYECSNCRKAFSHKEKLIKHYKIHSREQSYKCNECGKAFIKMSNLIRHQRIHTGEKPYACKECEKSFSQKSNLIDHEKIHTGEKPYECNECGKAFSQKQSLIAHQKVHTGEKPYACNECGKAFPRIASLALHMRSHTGEKPYKCDKCGKAFSQFSMLIIHVRIHTGEKPYECNECGKAFSQSSALTVHMRSHTGEKPYECKECRKAFSHKKNFITHQKIHTREKPYECNECGKAFIQMSNLVRHQRIHTGEKPYICKECGKAFSQKSNLIAHEKIHSGEKPYECNECGKAFSQKQNFITHQKVHTGEKPYDCNECGKAFSQIASLTLHLRSHTGEKPYECDKCGKAFSQCSLLNLHMRSHTGEKPYVCNECGKAFSQRTSLIVHMRGHTGEKPYECNKCGKAFSQSSSLTIHIRGHTGEKPFDCSKCGKAFSQISSLTLHMRKHTGEKPYHCIECGKAFSQKSHLVRHQRIHTH

SEQ ID NO: 70702 - protein, 342 aa, Homo sapiens
MRSHTGEKPYKCDKCGKAFSQFSMLIIHVRIHTGEKPYECNECGKAFSQSSALTVHMRSHTGEKPYECKECRKAFSHKKNFITHQKIHTREKPYECNECGKAFIQMSNLVRHQRIHTGEKPYICKECGKAFSQKSNLIAHEKIHSGEKPYECNECGKAFSQKQNFITHQKVHTGEKPYDCNECGKAFSQIASLTLHLRSHTGEKPYECDKCGKAFSQCSLLNLHMRSHTGEKPYVCNECGKAFSQRTSLIVHMRGHTGEKPYECNKCGKAFSQSSSLTIHIRGHTGEKPFDCSKCGKAFSQISSLTLHMRKHTGEKPYHCIECGKAFSQKSHLVRHQRIHTH

SEQ ID NO: 70703 - protein, 527 aa, Homo sapiens
MRKEHCEYNEPVKSYGNSSSHFVITPFKCNHCGKGFNQTLDLIRHLRIHTGEKPYECSNCRKAFSHKEKLIKHYKIHSREQSYKCNECGKAFIKMSNLIRHQRIHTGEKPYACKECEKSFSQKSNLIDHEKIHTGEKPYECNECGKAFSQKQSLIAHQKVHTGEKPYACNECGKAFPRIASLALHMRSHTGEKPYKCDKCGKAFSQFSMLIIHVRIHTGEKPYECNECGKAFSQSSALTVHMRSHTGEKPYECKECRKAFSHKKNFITHQKIHTREKPYECNECGKAFIQMSNLVRHQRIHTGEKPYICKECGKAFSQKSNLIAHEKIHSGEKPYECNECGKAFSQKQNFITHQKVHTGEKPYDCNECGKAFSQIASLTLHLRSHTGEKPYECDKCGKAFSQCSLLNLHMRSHTGEKPYVCNECGKAFSQRTSLIVHMRGHTGEKPYECNKCGKAFSQSSSLTIHIRGHTGEKPFDCSKCGKAFSQISSLTLHMRKHTGEKPYHCIECGKAFSQKSHLVRHQRIHTH

SEQ ID NO: 70704 - protein, 516 aa, Homo sapiens
MFEQLKPIEPRDCWREARVKKKPVTFEDVAVNFTQEEWDCLDASQRVLYQDVMSETFKNLTSVARIFLHKPELITKLEQEEEQWREFVHLPNTEGLSEGKKKELREQHPSLRDEGTSDDKVFLACRGAGQCPLSAPAGTMDRTRVLQASQAGPPFFCYTCGKCFSRRSYLYSHQFVHNPKLTNSCSQCGKLFRSPKSLSYHRRMHLGERPFCCTLCDKTYCDASGLSRHRRVHLGYRPHSCSVCGKSFRDQSELKRHQKIHQNQEPVDGNQECTLRIPGTQAEFQTPIARSQRSIQGLLDVNHAPVARSQEPIFRTEGPMAQNQASVLKNQAPVTRTQAPITGTLCQDARSNSHPVKPSRLNVFCCPHCSLTFSKKSYLSRHQKAHLTEPPNYCFHCSKSFSSFSRLVRHQQTHWKQKSYLCPICDLSFGEKEGLMDHWRGYKGKDLCQSSHHKCRVILGQWLGFSHDVPTMAGEEWKHGGDQSPPRIHTPRRRGLREKACKGDKTKEAVSILKHK

SEQ ID NO: 70705 - protein, 516 aa, Homo sapiens; identical to SEQ ID NO: 70704

SEQ ID NO: 70706 - protein, 516 aa, Homo sapiens; identical to SEQ ID NO: 70704

SEQ ID NO: 70707 - protein, 516 aa, Homo sapiens; identical to SEQ ID NO: 70704

SEQ ID NO: 70708 - protein, 211 aa, Homo sapiens
  MOD_RES (1)..(1): Any amino acid
XARSQEPIFRTEGPMAQNQASVLKNQAPVTRTQAPITGTLCQDARSNSHPVKPSRLNVFCCPHCSLTFSKKSYLSRHQKAHLTEPPNYCFHCSKSFSSFSRLVRHQQTHWKQKSYLCPICDLSFGEKEGLMDHWRGYKGKDLCQSSHHKCRVILGQWLGFSHDVPTMAGEEWKHGGDQSPPRIHTPRRRGLREKACKGDKTKEAVSILKHK

SEQ ID NO: 70709 - protein, 516 aa, Homo sapiens; identical to SEQ ID NO: 70704

SEQ ID NO: 70710 - protein, 516 aa, Homo sapiens; identical to SEQ ID NO: 70704

SEQ ID NO: 70711 - protein, 516 aa, Homo sapiens; identical to SEQ ID NO: 70704

SEQ ID NO: 70712 - protein, 516 aa, Homo sapiens; identical to SEQ ID NO: 70704

SEQ ID NO: 70713 - protein, 536 aa, Homo sapiens
MFEQLKPIEPVQKTLPWVGEVAATLQEAMKRDCWREARVKKKPVTFEDVAVNFTQEEWDCLDASQRVLYQDVMSETFKNLTSVARIFLHKPELITKLEQEEEQWREFVHLPNTEGLSEGKKKELREQHPSLRDEGTSDDKVFLACRGAGQCPLSAPAGTMDRTRVLQASQAGPPFFCYTCGKCFSRRSYLYSHQFVHNPKLTNSCSQCGKLFRSPKSLSYHRRMHLGERPFCCTLCDKTYCDASGLSRHRRVHLGYRPHSCSVCGKSFRDQSELKRHQKIHQNQEPVDGNQECTLRIPGTQAEFQTPIARSQRSIQGLLDVNHAPVARSQEPIFRTEGPMAQNQASVLKNQAPVTRTQAPITGTLCQDARSNSHPVKPSRLNVFCCPHCSLTFSKKSYLSRHQKAHLTEPPNYCFHCSKSFSSFSRLVRHQQTHWKQKSYLCPICDLSFGEKEGLMDHWRGYKGKDLCQSSHHKCRVILGQWLGFSHDVPTMAGEEWKHGGDQSPPRIHTPRRRGLREKACKGDKTKEAVSILKHK

SEQ ID NO: 70714 - protein, 516 aa, Homo sapiens; identical to SEQ ID NO: 70704

SEQ ID NO: 70715 - protein, 451 aa, Homo sapiens
AGGSPESLLFFQKPVTFEDVAVNFTQEEWDCLDASQRVLYQDVMSETFKNLTSVARIFLHKPELITKLEQEEEQWRETRVLQASQAGPPFFCYTCGKCFSRRSYLYSHQFVHNPKLTNSCSQCGKLFRSPKSLSYHRRMHLGERPFCCTLCDKTYCDASGLSRHRRVHLGYRPHSCSVCGKSFRDQSELKRHQKIHQNQEPVDGNQECTLRIPGTQAEFQTPIARSQRSIQGLLDVNHAPVARSQEPIFRTEGPMAQNQASVLKNQAPVTRTQAPITGTLCQDARSNSHPVKPSRLNVFCCPHCSLTFSKKSYLSRHQKAHLTEPPNYCFHCSKSFSSFSRLVRHQQTHWKQKSYLCPICDLSFGEKEGLMDHWRGYKGKDLCQSSHHKCRVILGQWLGFSHDVPTMAGEEWKHGGDQSPPRIHTPRRRGLREKACKGDKTKEAVSILKHK

SEQ ID NO: 70716 - protein, 516 aa, Homo sapiens; identical to SEQ ID NO: 70704

SEQ ID NO: 70717 - protein, 536 aa, Homo sapiens; identical to SEQ ID NO: 70713

SEQ ID NO: 70718 - protein, 536 aa, Homo sapiens; identical to SEQ ID NO: 70713

SEQ ID NO: 70719 - protein, 536 aa, Homo sapiens; identical to SEQ ID NO: 70713

SEQ ID NO: 70720 - protein, 536 aa, Homo sapiens; identical to SEQ ID NO: 70713

SEQ ID NO: 70721 - protein, 516 aa, Homo sapiens; identical to SEQ ID NO: 70704

SEQ ID NO: 70722 - protein, 516 aa, Homo sapiens; identical to SEQ ID NO: 70704

SEQ ID NO: 70723 - protein, 536 aa, Homo sapiens; identical to SEQ ID NO: 70713

SEQ ID NO: 70724 - protein, 516 aa, Homo sapiens; identical to SEQ ID NO: 70704

SEQ ID NO: 70725 - protein, 516 aa, Homo sapiens; identical to SEQ ID NO: 70704

SEQ ID NO: 70726 - protein, 536 aa, Homo sapiens; identical to SEQ ID NO: 70713

SEQ ID NO: 70727 - protein, 574 aa, Homo sapiens
MAAAVPRRPTQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEEAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGQTAYPCEECGKSFSQKGSLISHQLVHTGEGPYECRECGKSFGQKGNLIQHQQGHTGERAYHCGECGKSFRQKFCFINHQRVHTGERPYKCGECGKSFGQKGNLVHHQRGHTGERPYECKECGKSFRYRSHLTEHQRLHTGERPYNCRECGKLFNRKYHLLVHERVHTGERPYACEVCGKLFGNKHSVTIHQRIHTGERPYECSECGKSFLSSSALHVHKRVHSGQKPYKCSECGKSFSECSSLIKHRRIHTGERPYECTKCGKTFQRSSTLLHHQSSHRRKAL

SEQ ID NO: 70728 - protein, 1267 aa, Homo sapiens
MGDMKTPDFDDLLAAFDIPDPTSLDAKEAIQTPSEENESPLKPPGICMDESVSLSHSGSAPDVPAVSVIVKNTSRQESFEAEKDHITPSLLHNGFRGSDLPPDPHNCGKFDSTFMNGDSARSFPGKLEPPKSEPLPTFNQFSPISSPEPEDPIKDNGFGIKPKHSDSYFPPPLGCGAVGGPVLEALAKFPVPELHMFDHFCKKEPKPEPLPLGSQQEHEQSGQNTVEPHKDPDATRFFGEALEFNSHPSNSIGESKGLARELGTCSSVPPRQRLKPAHSKLSSCVAALVALQAKRVASVTKEDQPGHTKDLSGPTKESSKGSPKMPKSPKSPRSPLEATRKSIKPSDSPRSICSDSSSKGSPSVAASSPPAIPKVRIKTIKTSSGEIKRTVTRILPDPDDPSKSPVGSPLGSAIAEAPSEMPGDEVPVEEHFPEAGTNSGSPQGARKGDESMTKASDSSSPSCSSGPRVPKGAAPGSQTGKKQQSTALQASTLAPANLLPKAVHLANLNLVPHSVAASVTAKSSVQRRSQPQLTQMSVPLVHQVKKAAPLIVEVFNKVLHSSNPVPLYAPNLSPPADSRIHVPASGYCCLECGDAFALEKSLSQHYGRRSVHIEVLCTLCSKTLLFFNKCSLLRHARDHKSKGLVMQCSQLLVKPISADQMFVSAPVNSTAPAAPAPSSSPKHGLTSGSASPPPPALPLYPDPVRLIRYSIKCLECHKQMRDYMVLAAHFQRTTEETEGLTCQVCQMLLPNQCSFCAHQRIHAHKSPYCCPECGVLCRSAYFQTHVKENCLHYARKVGYRCIHCGVVHLTLALLKSHIQERHCQVFHKCAFCPMAFKTASSTADHSATQHPTQPHRPSQLIYKCSCEMVFNKKRHIQQHFYQNVSKTQVGVFKCPECPLLFVQKPELMQHVKSTHGVPRNVDELSSLQSSADTSSSRPGSRVPTEPPATSVAARSSSLPSGRWGRPEAHRRVEARPRLRNTGWTCQECQEWVPDRESYVSHMKKSHGRTLKRYPCRQCEQSFHTPNSLRKHIRNNHDTVKKFYTCGYCTEDSPSFPRPSLLESHISLMHGIRNPDLSQTSKVKPPGGHSPQVNHLKRPVSGVGDAPGTSNGATVSSTKRHKSLFQCAKCSFATDSGLEFQSHIPQHQVDSSTAQCLLCGLCYTSASSLSRHLFIVHKVRDQEEEEEEEAAAAEMAVEVAEPEEGSGEEVPMETRENGLEECAGEPLSADPEARRLLGPAPEDDGGHNDHSQPQASQDQDSHTLSPQV

SEQ ID NO: 70729 - protein, 1267 aa, Homo sapiens; identical to SEQ ID NO: 70728

SEQ ID NO: 70730 - protein, 792 aa, Homo sapiens
MAAINPWASWGALTDQSWGMTAVDPWASWALCPQYPAWHVEGSLEEGRRATGLPAAQVQEPVTFKDVAVDFTQEEWGQLDLVQRTLYRDVMLETYGHLLSVGNQIAKPEVISLLEQGEEPWSVEQACPQRTCPEWVRNLESKALIPAQSIFEEEQSHGMKLERYIWDDPWFSRLEVLGCKDQLEMYHMNQSTAMRQMVFMQKQVLSQRSSEFCGLGAEFSQNLNFVPSQRVSQIEHFYKPDTHAQSWRCDSAIMYADKVTCENNDYDKTVYQSIQPIYPARIQTGDNLFKCTDAVKSFNHIIHFGDHKGIHTGEKLYEYKECHQIFNQSPSFNEHPRLHVGENQYNYKEYENIFYFSSFMEHQKIGTVEKAYKYNEWEKVFGYDSFLTQHTSTYTAEKPYDYNECGTSFIWSSYLIQHKKTHTGEKPYECDKCGKVFRNRSALTKHERTHTGIKPYECNKCGKAFSWNSHLIVHKRIHTGEKPYVCNECGKSFNWNSHLIGHQRTHTGEKPFECTECGKSFSWSSHLIAHMRMHTGEKPFKCDECEKAFRDYSALSKHERTHSGAKPYKCTECGKSFSWSSHLIAHQRTHTGEKPYNCQECGKAFRERSALTKHEIIHSGIKPYECNKCGKSCSQMAHLVRHQRTHTGEKPYECNKCGKSFSQSCHLVAHRRIHTGEKPYKCNQCERSFNCSSHLIAHRRTHTGEKPYRCNECGKAFNESSSLIVHLRNHTGEKPYKCNHCEKAFCKNSSLIIHQRMHSGEKRFICSECGKAFSGHSALLQHQRNHSEEKLN

SEQ ID NO: 70731 - protein, 702 aa, Homo sapiens
MLETYGHLLSVGNQIAKPEVISLLEQGEEPWSVEQACPQRTCPEWVRNLESKALIPAQSIFEEEQSHGMKLERYIWDDPWFSRLEVLGCKDQLEMYHMNQSTAMRQMVFMQKQVLSQRSSEFCGLGAEFSQNLNFVPSQRVSQIEHFYKPDTHAQSWRCDSAIMYADKVTCENNDYDKTVYQSIQPIYPARIQTGDNLFKCTDAVKSFNHIIHFGDHKGIHTGEKLYEYKECHQIFNQSPSFNEHPRLHVGENQYNYKEYENIFYFSSFMEHQKIGTVEKAYKYNEWEKVFGYDSFLTQHTSTYTAEKPYDYNECGTSFIWSSYLIQHKKTHTGEKPYECDKCGKVFRNRSALTKHERTHTGIKPYECNKCGKAFSWNSHLIVHKRIHTGEKPYVCNECGKSFNWNSHLIGHQRTHTGEKPFECTECGKSFSWSSHLIAHMRMHTGEKPFKCDECEKAFRDYSALSKHERTHSGAKPYKCTECGKSFSWSSHLIAHQRTHTGEKPYNCQECGKAFRERSALTKHEIIHSGIKPYECNKCGKSCSQMAHLVRHQRTHTGEKPYECNKCGKSFSQSCHLVAHRRIHTGEKPYKCNQCERSFNCSSHLIAHRRTHTGEKPYRCNECGKAFNESSSLIVHLRNHTGEKPYKCNHCEKAFCKNSSLIIHQRMHSGEKRFICSECGKAFSGHSALLQHQRNHSEEKLN

SEQ ID NO: 70732 - protein, 508 aa, Homo sapiens
MAAINPWASWGALTDQSWGMTAVDPWASWALCPQYPAWHVEGSLEEGRRATGLPAAQVQEPVTFKDVAVDFTQEEWGQLDLVQRTLYRDVMLETYGHLLSVGNQIAKPEVISLLEQGEEPWSVEQACPQRTCPEWVRNLESKALIPAQSIFEEEQSHGMKLERYIWDDPWFSRLEVLGCKDQLEMYHMNQSTAMRQMVFMQKQVLSQRSSEFCGLGAEFSQNLNFVPSQRVSQIEHFYKPDTHAQSWRCDSAIMYADKVTCENNDYDKTVYQSIQPIYPARIQTGDNLFKCTDAVKSFNHIIHFGDHKGIHTGEKLYEYKECHQIFNQSPSFNEHPRLHVGENQYNYKEYENIFYFSSFMEHQKIGTVEKAYKYNEWEKVFGYDSFLTQHTSTYTAEKPYDYNECGTSFIWSSYLIQHKKTHTGEKPYECDKCGKVFRNRSALTKHERTHTGIKPYECNKCGKAFSWNSHLIVHKRIHTGEKPYVCNECGKSFNWNSHLIGHQRTHTG

SEQ ID NO: 70733 - protein, 840 aa, Homo sapiens
MKEDKSSIREAISKAKSTANIKTEQEGEASEKSLHLSPQHITHQTMPIGQRGSEQGKRVENINGTSYPSLQQKTNAVKKLHKCDECGKSFKYNSRLVQHKIMHTGEKRYECDDCGGTFRSSSSLRVHKRIHTGEKPYKCEECGKAYMSYSSLINHKSTHSGEKNCKCDECGKSFNYSSVLDQHKRIHTGEKPYECGECGKAFRNSSGLRVHKRIHTGEKPYECDICGKTFSNSSGLRVHKRIHTGEKPYECDECGKAFITCRTLLNHKSIHFGDKPYKCDECEKSFNYSSLLIQHKVIHTGEKPYECDECGKAFRNSSGLIVHKRIHTGEKPYKCDVCGKAFSYSSGLAVHKSIHPGKKAHECKECGKSFSYNSLLLQHRTIHTGERPYVCDVCGKTFRNNAGLKVHRRLHTGEKPYKCDVCGKAYISRSSLKNHKGIHLGEKPYKCSYCEKSFNYSSALEQHKRIHTREKPFGCDECGKAFRNNSGLKVHKRIHTGERPYKCEECGKAYISLSSLINHKSVHPGEKPFKCDECEKAFITYRTLTNHKKVHLGEKPYKCDVCEKSFNYTSLLSQHRRVHTREKPYECDRCEKVFRNNSSLKVHKRIHTGERPYECDVCGKAYISHSSLINHKSTHPGRTPHTCDECGKAFFSSRTLISHKRVHLGEKPFKCVECGKSFSYSSLLSQHKRIHTGEKPYVCDRCGKAFRNSSGLTVHKRIHTGEKPYECDECGKAYISHSSLINHKSVHQGKQPYNCECGKSFNYRSVLDQHKRIHTGKKPYRCNECGKAFNIRSNLTKHKRTHTGEESLNVIYVGSYSGTSQKRTYEGGNALDGGRMRMPL

SEQ ID NO: 70734 - protein, 498 aa, Homo sapiens
MSYSSLINHKSTHSGEKNCKCDECGKSFNYSSVLDQHKRIHTGEKPYECGECGKAFRNSSGLRVHKRIHTGEKPYECDICGKTFSNSSGLRVHKRIHTGEKPYECDECGKAFITCRTLLNHKSIHFGDKPYKCDECGKAFRNNSGLKVHKRIHTGERPYKCEECGKAYISLSSLINHKSVHPGEKPFKCDECEKAFITYRTLTNHKKVHLGEKPYKCDVCEKSFNYTSLLSQHRRVHTREKPYECDRCEKVFRNNSSLKVHKRIHTGERPYECDVCGKAYISHSSLINHKSTHPGRTPHTCDECGKAFFSSRTLISHKRVHLGEKPFKCVECGKSFSYSSLLSQHKRIHTGEKPYVCDRCGKAFRNSSGLTVHKRIHTGEKPYECDECGKAYISHSSLINHKSVHQGKQPYNCECGKSFNYRSVLDQHKRIHTGKKPYRCNECGKAFNIRSNLTKHKRTHTGEESLNVIYVGSYSGTSQKRTYEGGNALDGGRMRMPL

SEQ ID NO: 70735 - protein, 900 aa, Homo sapiens
MSHLKTSTEDEEPTEEYENVGNAASKWPKVEDPMPESKVGDTCVWDSKVENQQKKPVENRMKEDKSSIREAISKAKSTANIKTEQEGEASEKSLHLSPQHITHQTMPIGQRGSEQGKRVENINGTSYPSLQQKTNAVKKLHKCDECGKSFKYNSRLVQHKIMHTGEKRYECDDCGGTFRSSSSLRVHKRIHTGEKPYKCEECGKAYMSYSSLINHKSTHSGEKNCKCDECGKSFNYSSVLDQHKRIHTGEKPYECGECGKAFRNSSGLRVHKRIHTGEKPYECDICGKTFSNSSGLRVHKRIHTGEKPYECDECGKAFITCRTLLNHKSIHFGDKPYKCDECEKSFNYSSLLIQHKVIHTGEKPYECDECGKAFRNSSGLIVHKRIHTGEKPYKCDVCGKAFSYSSGLAVHKSIHPGKKAHECKECGKSFSYNSLLLQHRTIHTGERPYVCDVCGKTFRNNAGLKVHRRLHTGEKPYKCDVCGKAYISRSSLKNHKGIHLGEKPYKCSYCEKSFNYSSALEQHKRIHTREKPFGCDECGKAFRNNSGLKVHKRIHTGERPYKCEECGKAYISLSSLINHKSVHPGEKPFKCDECEKAFITYRTLTNHKKVHLGEKPYKCDVCEKSFNYTSLLSQHRRVHTREKPYECDRCEKVFRNNSSLKVHKRIHTGERPYECDVCGKAYISHSSLINHKSTHPGRTPHTCDECGKAFFSSRTLISHKRVHLGEKPFKCVECGKSFSYSSLLSQHKRIHTGEKPYVCDRCGKAFRNSSGLTVHKRIHTGEKPYECDECGKAYISHSSLINHKSVHQGKQPYNCECGKSFNYRSVLDQHKRIHTGKKPYRCNECGKAFNIRSNLTKHKRTHTGEESLNVIYVGSYSGTSQKRTYEGGNALDGGRMRMPL

SEQ ID NO: 70736 - protein, 160 aa, Homo sapiens
MPESKVGDTCVWDSKVENQQKKPVENRMKEDKSSIREAISKAKSTANIKTEQEGEASEKSLHLSPQHITHQTMPIGQRGSEQGKRVENINGTSYPSLQQKTNAVKKLHKCDECGKSFKYNSRLVQHKIMHTGEKRYECDDCGGTFRSSSSLRVHKRIHTG

SEQ ID NO: 70737 - protein, 104 aa, Homo sapiens
MPESKVGDTCVWDSKVENQQKKPVENRMKEDKSSIREAISKAKSTANIKTEQEGEASEKSLHLSPQHITHQTMPIGQRGSEQGKRVENINGTSYPSLQQKTNAV

SEQ ID NO: 70738 - protein, 78 aa, Homo sapiens
MPESKVGDTCVWDSKVENQQKKPVENRMKEDKSSIREAISKAKSTANIKTEQEGEASEKSLHLSPQHITHQTMPIGQR

SEQ ID NO: 70739 - protein, 867 aa, Homo sapiens
MPESKVGDTCVWDSKVENQQKKPVENRMKEDKSSIREAISKAKSTANIKTEQEGEASEKSLHLSPQHITHQTMPIGQRGSEQGKRVENINGTSYPSLQQKTNAVKKLHKCDECGKSFKYNSRLVQHKIMHTGEKRYECDDCGGTFRSSSSLRVHKRIHTGEKPYKCEECGKAYMSYSSLINHKSTHSGEKNCKCDECGKSFNYSSVLDQHKRIHTGEKPYECGECGKAFRNSSGLRVHKRIHTGEKPYECDICGKTFSNSSGLRVHKRIHTGEKPYECDECGKAFITCRTLLNHKSIHFGDKPYKCDECEKSFNYSSLLIQHKVIHTGEKPYECDECGKAFRNSSGLIVHKRIHTGEKPYKCDVCGKAFSYSSGLAVHKSIHPGKKAHECKECGKSFSYNSLLLQHRTIHTGERPYVCDVCGKTFRNNAGLKVHRRLHTGEKPYKCDVCGKAYISRSSLKNHKGIHLGEKPYKCSYCEKSFNYSSALEQHKRIHTREKPFGCDECGKAFRNNSGLKVHKRIHTGERPYKCEECGKAYISLSSLINHKSVHPGEKPFKCDECEKAFITYRTLTNHKKVHLGEKPYKCDVCEKSFNYTSLLSQHRRVHTREKPYECDRCEKVFRNNSSLKVHKRIHTGERPYECDVCGKAYISHSSLINHKSTHPGRTPHTCDECGKAFFSSRTLISHKRVHLGEKPFKCVECGKSFSYSSLLSQHKRIHTGEKPYVCDRCGKAFRNSSGLTVHKRIHTGEKPYECDECGKAYISHSSLINHKSVHQGKQPYNCECGKSFNYRSVLDQHKRIHTGKKPYRCNECGKAFNIRSNLTKHKRTHTGEESLNVIYVGSYSGTSQKRTYEGGNALDGGRMRMPL

SEQ ID NO: 70740 - protein, 461 aa, Homo sapiens
MDSVAFEDVAVNFTLEEWALLDPSQKNLYRDVMRETFRNLASVGKQWEDQNIEDPFKIPRRNISHIPERLCESKEGGQGEETFSQIPDGILNKKTPGVKPCESSVCGEVGMGPSSLNRHIRDHTGREPNEYQEYGKKSYTRNQCGRALSYHRSFPVRERTHPGGKPYDCKECGETFISLVSIRRHMLTHRGGVPYKCKVCGKAFDYPSLFRIHERSHTGEKPYECKQCGKAFSCSSYIRIHERTHTGDKPYECKQCGKAFSCSKYIRIHERTHTGEKPYECKQCGKAFRCASSVRSHERTHTGEKLFECKECGKALTCLASVRRHMIKHTGNGPYKCKVCGKAFDFPSSFRIHERTHTGEKPYDCKQCGKAFSCSSSFRKHERIHTGEKPYKCTKCGKAFSRSSYFRIHERTHTGEKPYECKQCGKAFSRSTYFRVHEKIHTGEKPYENPNPNASVVPVLS

SEQ ID NO: 70741 - protein, 1055 aa, Homo sapiens
MVGSHADMAPASTAEGAGEKPGPAAPAPAAQYECGECGKSFRWSSRLLHHQRTHTGERPYKCPDCPKAFKGSSALLYHQRGHTGERPYQCPDCPKAFKRSSLLQIHRSVHTGLRAFICGQCGLAFKWSSHYQYHLRQHTGERPYPCPDCPKAFKNSSSLRRHRHVHTGERPYTCGVCGKSFTQSTNLRQHQRVHTGERPFRCPLCPKTFTHSSNLLLHQRTHGAAPAPGTASAAPPPQSREPGKVFVCDAYLQRHLQPHSPPAPPAPPPPPPPVVPELFLAAAETTVELVYRCDGCEQGFSSEELLLEHQPCPGPDAAPQPQEAPAEAPKADQPPSPLPQPPPPAAAPAPGFACLPCGKSFRTVAGLSRHQHSHGAAGGQAFRCGSCDGSFPQLASLLAHQQCHVEEAAAGRPPPQAEAAEVTCPQEPLAPAAPVPPPPPSAPASAERPYKCAECGKSFKGSSGLRYHLRDHTGERPYQCGECGKAFKRSSLLAIHQRVHTGLRAFTCGQCGLTFKWSSHYQYHLRLHSGERPYACGECGKAFRNTSCLRRHRHVHTGERPHACGVCGKSFAQTSNLRQHQRVHTGERPFRCPLCPKTFTHSSNLLLHQRTHSAERPFTCPICGRGFVMAAYLQRHLRTHAPANTPPSTTAPAAGPQPPAPLAAARAPPATQDVHVLPHLQATLSLEVAGGTAQAPSLGPAAPNSQTFLLVQTAQGLQLIPSSVQPPTPPPPPAPPKLILLPSSSAGAGGGRARQGPRAVGKAGQGAGVVWLPGPGGLGVQGAASAGASGTGQSLIVLQNVGGGEAGPQEMSGVQLQPLRPAPEVTTVQLQPAQEVTTVQLQPAQEVTTVQLQPAQEVTTVQLQPVAGQLSNSSGGAVATEAPNLLVVQSGAAEELLTGPGPGEAGDGEASTGVVQDVLFETLQTDEGLQSVLVLSGADGEQTRLCVQEVETLPPGLTEPPATGPPGQKLLIIRSAPATELLDSSNTGGGTATLQLLAPPPSGPASGPAGLPGAPASQMVQVVPAGAGPGVMTPQGLPSIQIVQTLPAVQLVHTF

SEQ ID NO: 70742 - protein, 533 aa, Homo sapiens
MDRYQGNQDRVLRQVTVISRETLTDEMGSKYSAFGKMFNRCTDLAPLSQKFHKFDSCENSLKSNSDLLNYNRSYARKNPTKRFRCGRPPKYNASCSVPEKEGFIHTGMEPYGDSQCEKVLSHKQAHVQYKKFQAREKPNVCSMCGKAFIKKSQLIIHQRIHTGEKPYVCGDCRKAFSEKSHLIVHQRIHTGEKPYECTKYGRAFSRKSPFTVHQRVHTGEKPYECFECPKAFSQKSHLIIHQRVHTREKPFECSECRKAFCEMSHLFIHQITHTGKKPYECTECGKTFPRKTQLIIHQRTHTGEKPYKCGECGKTFCQQSHLIGHQRIHTGEKPYVCTDCGKAFSQKSHLTGHQRLHTGEKPYMCTECGKSFSQKSPLIIHQRIHTGEKPYQCGECGKTFSQKSLLIIHLRVHTGEKPYECTECGRAFSLKSHLILHQRGHTGEKPYECSECGKAFCGKSPLIIHQKTHPREKTPECAESGMTFFWKSQMITYQRRHTGEKPSRCSDCGKAFCQHVYFTGHQNPYRKDTLYIC

SEQ ID NO: 70743 - protein, 657 aa, Homo sapiens
MIESQEPVTFEDVAVDFTQEEWQQLNPAQKTLHRDVMLETYNHLVSVGCSGIKPDVIFKLEHGKDPWIIESELSRWIYPDRVKGLESSQQIISGELLFQREILERAPKDNSLYSVLKIWHIDNQMDRYQGNQDRVLRQVTVISRETLTDEMGSKYSAFGKMFNRCTDLAPLSQKFHKFDSCENSLKSNSDLLNYNRSYARKNPTKRFRCGRPPKYNASCSVPEKEGFIHTGMEPYGDSQCEKVLSHKQAHVQYKKFQAREKPNVCSMCGKAFIKKSQLIIHQRIHTGEKPYVCGDCRKAFSEKSHLIVHQRIHTGEKPYECTKYGRAFSRKSPFTVHQRVHTGEKPYECFECPKAFSQKSHLIIHQRVHTREKPFECSECRKAFCEMSHLFIHQITHTGKKPYECTECGKTFPRKTQLIIHQRTHTGEKPYKCGECGKTFCQQSHLIGHQRIHTGEKPYVCTDCGKAFSQKSHLTGHQRLHTGEKPYMCTECGKSFSQKSPLIIHQRIHTGEKPYQCGECGKTFSQKSLLIIHLRVHTGEKPYECTECGRAFSLKSHLILHQRGHTGEKPYECSECGKAFCGKSPLIIHQKTHPREKTPECAESGMTFFWKSQMITYQRRHTGEKPSRCSDCGKAFCQHVYFTGHQNPYRKDTLYIC

SEQ ID NO: 70744 - protein, 214 aa, Homo sapiens
MIESQEPVTFEDVAVDFTQEEWQQLNPAQKTLHRDVMLETYNHLVSVGCSGIKPDVIFKLEHGKDPWIIESELSRWIYPDRVKGLESSQQIISGELLFQREILERAPKDNSLYSVLKIWHIDNQMDRYQGNQDRVLRQVTVISRETLTDEMGSKYSAFGKMFNRCTDLAPLSQKFHKFDSCENSLKSNSDLLNYNRSYARKNPTKRFRCGRPPK

SEQ ID NO: 70745 - protein, 643 aa, Homo sapiens
MIESQEEWQQLNPAQKTLHRDVMLETYNHLVSVGCSGIKPDVIFKLEHGKDPWIIESELSRWIYPDRVKGLESSQQIISGELLFQREILERAPKDNSLYSVLKIWHIDNQMDRYQGNQDRVLRQVTVISRETLTDEMGSKYSAFGKMFNRCTDLAPLSQKFHKFDSCENSLKSNSDLLNYNRSYARKNPTKRFRCGRPPKYNASCSVPEKEGFIHTGMEPYGDSQCEKVLSHKQAHVQYKKFQAREKPNVCSMCGKAFIKKSQLIIHQRIHTGEKPYVCGDCRKAFSEKSHLIVHQRIHTGEKPYECTKYGRAFSRKSPFTVHQRVHTGEKPYECFECPKAFSQKSHLIIHQRVHTREKPFECSECRKAFCEMSHLFIHQITHTGKKPYECTECGKTFPRKTQLIIHQRTHTGEKPYKCGECGKTFCQQSHLIGHQRIHTGEKPYVCTDCGKAFSQKSHLTGHQRLHTGEKPYMCTECGKSFSQKSPLIIHQRIHTGEKPYQCGECGKTFSQKSLLIIHLRVHTGEKPYECTECGRAFSLKSHLILHQRGHTGEKPYECSECGKAFCGKSPLIIHQKTHPREKTPECAESGMTFFWKSQMITYQRRHTGEKPSRCSDCGKAFCQHVYFTGHQNPYRKDTLYIC

SEQ ID NO: 70746 - protein, 1978 aa, Homo sapiens
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKETLGSEAVSSNVIDYGHASKYGYTEDPLEVRIYDPEIPTDEVENEFQSQQNISASVPNPNVICNSMFPVEDVFRQMDFPGESSNNRSFFSVESGTKMSGLHISGGQSVLEPIKSVNQSINQTVSQTMSQSLIPPSMNQQPFSSELISSVSQQERIPHEPVINSSNVHVGSRGSKKNYQSQADIPIRSPFGIVKASWLPKFSHADAQKMKRLPTPSMMNDYYAASPRIFPHLCSLCNVECSHLKDWIQHQNTSTHIESCRQLRQQYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAAKTGQAKASVAKVNKSTGKSASSVKSVVTVAVKGNKASIKTAKSGGKKSLEAKKTGNVKNKDSNKPVTIPENSEIKTSIEVKATENCAKEAISDAALEATENEPLNKETEEMCVMLVSNLPNKGYSVEEVYDLAKPFGGLKDILILSSHKKAYIEINRKAAESMVKFYTCFPVLMDGNQLSISMAPENMNIKDEEAIFITLVKENDPEANIDTIYDRFVHLDNLPEDGLQCVLCVGLQFGKVDHHVFISNRNKAILQLDSPESAQSMYSFLKQNPQNIGDHMLTCSLSPKIDLPEVQIEHDPELEKESPGLKNSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGSGRISALQGKLSKLDYRDITKQSQETEARPSIMKRDDSNNKTLAEQNTKNPKSTTGRSSKSKEEPLFPFNLDEFVTVDEVIEEVNPSQAKQNPLKGKRKETLKNVPFSELNLKKKKGKTSTPRGVEGELSFVTLDEIGEEEDAAAHLAQALVTVDEVIDEEELNMEEMVKNSNSLFTLDELIDQDDCISHSEPKDVTVLSVAEEQDLLKQERLVTVDEIGEVEELPLNESADITFATLNTKGNEGDTVRDSIGFISSQVPEDPSTLVTVDEIQDDSSDLHLVTLDEVTEEDEDSLADFNNLKEELNFVTVDEVGEEEDGDNDLKVELAQSKNDHPTDKKGNRKKRAVDTKKTKLESLSQVGPVNENVMEEDLKTMIERHLTAKTPTKRVRIGKTLPSEKAVVTEPAKGEEAFQMSEVDEESGLKDSEPERKRKKTEDSSSGKSVASDVPEELDFLVPKAGFFCPICSLFYSGEKAMTNHCKSTRHKQNTEKFMAKQRKEKEQNEAEERSSR

SEQ ID NO: 70747 - protein, 1139 aa, Homo sapiens
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKETLGSEAVSSNVIDYGHASKYGYTEDPLEVRIYDPEIPTDEVENEFQSQQNISASVPNPNVICNSMFPVEDVFRQMDFPGESSNNRSFFSVESGTKMSGLHISGGQSVLEPIKSVNQSINQTVSQTMSQSLIPPSMNQQPFSSELISSVSQQERIPHEPVINSSNVHVGSRGSKKNYQSQADIPIRSPFGIVKASWLPKFSHADAQKMKRLPTPSMMNDYYAASPRIFPHLCSLCNVECSHLKDWIQHQNTSTHIESCRQLRQQYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAAKTGQAKASVAKVNKSTGKSASSVKSVVTVAVKGNKASIKTAKSGGKKSLEAKKTGNVKNKDSNKPVTIPENSEIKTSIEVKATENCAKEAISDAALEATENEPLNKETEEMCVMLVSNLPNKGYSVEEVYDLAKPFGGLKDILILSSHKKAYIEINRKAAESMVKFYTCFPVLMDGNQLSISMAPENMNIKDEEAIFITLVKENDPEANIDTIYDRFVHLDNLPEDGLQCVLCVGLQFGKVDHHVFISNRNKAILQLDSPESAQSMYSFLKQNPQNIGDHMLTCSLSPKIDLPEVQIEHDPELEKERLWLSKTLRILKALLVEVPNLKRSHYFHLIWMNLLLWMRL

SEQ ID NO: 70748 - protein, 814 aa, Homo sapiens
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKETLGSEAVSSNVIDYGHASKYGYTEDPLEVRIYDPEIPTDEVENEFQSQQNISASVPNPNVICNSMFPVEDVFRQMDFPGESSNNRSFFSVESGTKMSGLHISGGQSVLEPIKSVNQSINQTVSQTMSQSLIPPSMNQQPFSSELISSVSQQERIPHEPVINSSNVHVGSRGSKKNYQSQADIPIRSPFGIVKASWLPKFSHADAQKMKRLPTPSMMNDYYAASPRIFPHLCSLCNVECSHLKDWIQHQNTSTHIESCRQLRQQYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAGLLPTGGGNNYPQIVLAPGLCH

SEQ ID NO: 70749 - protein, 880 aa, Homo sapiens
MPRDGVPAGNTTPAAAQAAAQSPDSATAGAPQVLDSLKRYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAAKTGQAKASVAKVNKSTGKSASSVKSVVTVAVKGNKASIKTAKSGGKKSLEAKKTGNVKNKDSNKPVTIPENSEIKTSIEVKATENCAKEAISDAALEATENEPLNKETEEMCVMLVSNLPNKGYSVEEVYDLAKPFGGLKDILILSSHKKAYIEINRKAAESMVKFYTCFPVLMDGNQLSISMAPENMNIKDEEAIFITLVKENDPEANIDTIYDRFVHLDNLPEDGLQCVLCVGLQFGKVDHHVFISNRNKAILQLDSPESAQSMYSFLKQNPQNIGDHMLTCSLSPKIDLPEVQIEHDPELEKESPGLKNSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNIS

SEQ ID NO: 70750 - protein, 918 aa, Homo sapiens
MDSPPLKALNSNSIYFLLLFHCMLISEVQIEHDPELEKESPGLKNSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGSGRISALQGKLSKLDYRDITKQSQETEARPSIMKRDDSNNKTLAEQNTKNPKSTTGRSSKSKEEPLFPFNLDEFVTVDEVIEEVNPSQAKQNPLKGKRKETLKNVPFSELNLKKKKGKTSTPRGVEGELSFVTLDEIGEEEDAAAHLAQALVTVDEVIDEEELNMEEMVKNSNSLFTLDELIDQDDCISHSEPKDVTVLSVAEEQDLLKQERLVTVDEIGEVEELPLNESADITFATLNTKGNEGDTVRDSIGFISSQVPEDPSTLVTVDEIQDDSSDLHLVTLDEVTEEDEDSLADFNNLKEELNFVTVDEVGEEEDGDNDLKVELAQSKNDHPTDKKGNRKKRAVDTKKTKLESLSQVGPVNENVMEEDLKTMIERHLTAKTPTKRVRIGKTLPSEKAVVTEPAKGEEAFQMSEVDEESGLKDSEPERKRKKTEDSSSGKSVASDVPEELDFLVPKAGFFCPICSLFYSGEKAMTNHCKSTRHKQNTEKFMAKQRKEKEQNEAEERSSR

SEQ ID NO: 70751 - protein, 1978 aa, Homo sapiens; identical to SEQ ID NO: 70746

SEQ ID NO: 70752 - protein, 29 aa, Homo sapiens
MSRPRFNPRGDFPLQRPRAPNPSGMRPPG

SEQ ID NO: 70753 - protein, 197 aa, Homo sapiens
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKE

SEQ ID NO: 70754 - protein, 36 aa, Homo sapiens
MSRPRFNPRGDFPLQRPRAPNPSGMRPPGPFMRPGS

SEQ ID NO: 70755 - protein, 62 aa, Homo sapiens
MSRPRFNPRGDFPLQRPRAPNPSGMRPPGPFMRPGSMGLPRFYPAGRARGIPHRFAGHESYQ

SEQ ID NO: 70756 - protein, 62 aa, Homo sapiens; identical to SEQ ID NO: 70755

SEQ ID NO: 70757 - protein, 585 aa, Homo sapiens
MDSPPLKALNSNSIYFLLLFHCMLISEVQIEHDPELEKESPGLKNSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGSGRISALQGKLSKLDYRDITKQSQETEARPSIMKRDDSNNKTLAEQNTKNPKSTTGRSSKSKEEPLFPFNLDEFVTVDEVIEEVNPSQAKQNPLKGKRKETLKNVPFSELNLKKKKGKTSTPRGVEGELSFVTLDEIGEEEDAAAHLAQALVTVDEVIDEEELNMEEMVKFKFTFYIR

SEQ ID NO: 70758 - protein, 1024 aa, Homo sapiens
MPRDGVPAGNTTPAAAQAAAQSPDSATAGAPQVLDSLKRFVLFLENFAPLVNSLNLGIANPLLLGPSPLHFAQIKTQLALQQLNAVASHGSTPPYTLLNQAFLKIAMSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKETLGSEAVSSNVIDYGHASKYGYTEDPLEVRIYDPEIPTDEVENEFQSQQNISASVPNPNVICNSMFPVEDVFRQMDFPGESSNNRSFFSVESGTKMSGLHISGGQSVLEPIKSVNQSINQTVSQTMSQSLIPPSMNQQPFSSELISSVSQQERIPHEPVINSSNVHVGSRGSKKNYQSQADIPIRSPFGIVKASWLPKFSHADAQKMKRLPTPSMMNDYYAASPRIFPHLCSLCNVECSHLKDWIQHQNTSTHIESCRQLRQQYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAESVDQTQQLVPLVRNTARDHDGTPENEGEETVQSALFGFQYDASDHTMAWLGPNTVPEVKEMILQDPQLQTTQLPQTTQAPDITWGMLKKTTYKAEQILLQTQKPFTPDNLFLALLSGDAKPEYEQ

SEQ ID NO: 70759 - protein, 438 aa, Homo sapiens
MQAEDRSQFGSAAEMLSEQTAALGTGWESMNVQLDGAEPQVERGSQEERPWRTVPGPLEHLCCDLEEEPQSLQEKAQSAPWVPAIPQEGNTGDWEMAAALLAAGSQGLVTIKDVSLCFSQEEWRSLDPSQTDFYGEYVMQENCGIVVSLRFPIPKLDMLSQLEGGEEQWVPDPQDLEERDILRVTYTGDGSEHEGDTPELEAEPPRMLSSVSEDTVLWNPEHDESWDSMPSSSRGMLLGPPFLQEDSFSNLLCSTEMDSLLRPHTCPQCGKQFVWGSHLARHQQTHTGERPYSCLKCEKTFGRRHHLIRHQKTHLHDKTSRCSECGKNFRCNSHLASHQRVHAEGKSCKGQEVGESPGTRKRQRAPPVPKCHVCTECGKSFGRRHHLVRHWLTHTGEKPFQCPRCEKSFGRKHHLDRHLLTHQGQSPRNSWDRGTSVF

SEQ ID NO: 70760 - protein, 415 aa, Homo sapiens
MLSEQTAALGTGWESMNVQLDGAEPQVERGSQEERPWRTVPGPLEHLCCDLEEEPQSLQEKAQSAPWVPAIPQEGNTGDWEMAAALLAAGSQVSSASLGVSCGPITAAFVLLSHQPIDELAHMIINGFPIPKLDMLSQLEGGEEQWVPDPQDLEERDILRVTYTGDGSEHEGDTPELEAEPPRMLSSVSEDTVLWNPEHDESWDSMPSSSRGMLLGPPFLQEDSFSNLLCSTEMDSLLRPHTCPQCGKQFVWGSHLARHQQTHTGERPYSCLKCEKTFGRRHHLIRHQKTHLHDKTSRCSECGKNFRCNSHLASHQRVHAEGKSCKGQEVGESPGTRKRQRAPPVPKCHVCTECGKSFGRRHHLVRHWLTHTGEKPFQCPRCEKSFGRKHHLDRHLLTHQGQSPRNSWDRGTSVF

SEQ ID NO: 70761 - protein, 438 aa, Homo sapiens; identical to SEQ ID NO: 70759

SEQ ID NO: 70762 - protein, 424 aa, Homo sapiens
MLSEQTAALGTGWESMNVQLDGAEPQVERGSQEERPWRTVPGPLEHLCCDLEEEPQSLQEKAQSAPWVPAIPQEGNTGDWEMAAALLAAGSQGLVTIKDVSLCFSQEEWRSLDPSQTDFYGEYVMQENCGIVVSLRFPIPKLDMLSQLEGGEEQWVPDPQDLEERDILRVTYTGDGSEHEGDTPELEAEPPRMLSSVSEDTVLWNPEHDESWDSMPSSSRGMLLGPPFLQEDSFSNLLCSTEMDSLLRPHTCPQCGKQFVWGSHLARHQQTHTGERPYSCLKCEKTFGRRHHLIRHQKTHLHDKTSRCSECGKNFRCNSHLASHQRVHAEGKSCKGQEVGESPGTRKRQRAPPVPKCHVCTECGKSFGRRHHLVRHWLTHTGEKPFQCPRCEKSFGRKHHLDRHLLTHQGQSPRNSWDRGTSVF

SEQ ID NO: 70763 - protein, 136 aa, Homo sapiens
MQAEDRSQFGSAAEMLSEQTAALGTGWESMNVQLDGAEPQVERGSQEERPWRTVPGPLEHLCCDLEEEPQSLQEKAQSAPWVPAIPQEGNTGDWEMAAALLAAGSQGLVTIKDVSLCFSQEEWRSLDPSQTDFYGE

SEQ ID NO: 70764 - protein, 107 aa, Homo sapiens
MLSEQTAALGTGWESMNVQLDGAEPQVERGSQEERPWRTVPGPLEHLCCDLEEEPQSLQEKAQSAPWVPAIPQEGNTGDWEMAAALLAAGSQGLVTIKDVSLCFSQE

SEQ ID NO: 70765 - protein, 77 aa, Homo sapiens
MLSEQTAALGTGWESMNVQLDGAEPQVERGSQEERPWRTVPGPLEHLCCDLEEEPQSLQEKAQSAPWVPAIPQEGNT

SEQ ID NO: 70766 - protein, 1327 aa, Homo sapiens
MRSFLQQDVNKTKSRLNVLNGLANNMDDLKINTDITGAKEELLDDNNFISDKESGVHKPKDCQTSFQKNNTLTLPEELSKDKSENALSGGQSSLFIHAGAPTVSSENFILPKGAAVNGPVSHSSLTKTSNMNKGSVSLTTGQPVDQPTTESCSTLKVAADLQLSTPQKASQHQVLFLLSDVAHAKNPTHSNKKLPTSASVGCDIQNSVGSNIKSDGTLINQVEVGEDGEDLLVKDDCVNTVTGISSGTDGFRSENDTNWDPQKEFIQFLMTNEETVDKAPPHSKIGLEKKRKRKMDVSKITRYTEDCFSDSNCVPNKSKMQEVDFLEQNEELQAVDSQKYALSKVKPESTDEDLESVDAFQHLIYNPDKCGEESSPVHTSTFLSNTLKKKCEESDSESPATFSTEEPSFYPCTKCNVNFREKKHLHRHMMYHLDGNSHFRHLNVPRPYACRECGRTFRDRNSLLKHMIIHQERRQKLMEEIRELKELQDEGRSARLQCPQCVFGTNCPKTFVQHAKTHEKDKRYYCCEECNFMAVTENELECHRGIAHGAVVKCPMVTSDIAQRKTQKKTFMKDSVVGSSKKSATYICKMCPFTTSAKSVLKKHTEYLHSSSCVDSFGSPLGLDKRKNDILEEPVDSDSTKTLTKQQSTTFPKNSALKQDVKRTFGSTSQSSSFSKIHKRPHRIQKARKSIAQSGVNMCNQNSSPHKNVTIKSSVDQKPKYFHQAAKEKSNAKANSHYLYRHKYENYRMIKKSGESYPVHFKKEEASSLNSLHLFSSSSNSHNNFISDPHKPDAKRPESFKDHRRVAVKRVIKESKKESSVGGEDLDSYPDFLHKMTVVVLQKLNSAEKKDSYETEDESSWDNVELGDYTTQAIEDETYSDINQEHVNLFPLFKSKVEGQEPGENATLSYDQNDGFYFEYYEDTGSNNFLHEIHDPQHLETADASLSKHSSVFHWTDLSLEKKSCPYCPATFETGVGLSNHVRGHLHRAGLSYEARHVVSPEQIATSDKMQHFKRTGTGTPVKRVRKAIEKSETTSEHTCQLCGGWFDTKIGLSNHVRGHLKRLGKTKWDAHKSPICVLNEMMQNEEKYEKILKALNSRRIIPRPFVAQKLASSDDFISQNVIPLEAYRNGLKTEALSVSASEEEGLNFLNEYDETKPELPSGKKNQSLTLIELLKNKRMGEERNSAISPQKIHNQTARKRFVQKCVLPLNEDSPLMYQPQKMDLTMHSALDCKQKKSRSRSGSKKKMLTLPHGADEVYILRCRFCGLVFRGPLSVQEDWIKHLQRHIVNANLPRTGAGMVEVTSLLKKPASITETSFSLLMAEAAS

SEQ ID NO: 70767 - protein, 105 aa, Homo sapiens
MLIRQNLALDCKQKKSRSRSGSKKKMLTLPHGADEVYILRCRFCGLVFRGPLSVQEDWIKHLQRHIVNANLPRTGAGMVEVTSLLKKPASITETSFSLLMAEAAS

SEQ ID NO: 70768 - protein, 105 aa, Homo sapiens; identical to SEQ ID NO: 70767

SEQ ID NO: 70769 - protein, 1327 aa, Homo sapiens; identical to SEQ ID NO: 70766

SEQ ID NO: 70770 - protein, 650 aa, Homo sapiens
MMYHLDGNSHFRHLNVPRPYACRECGRTFRDRNSLLKHMIIHQERRQKLMEEIRELKELQDEGRSARLQCPQCVFGTNCPKTFVQHAKTHEKDKRYYCCEECNFMAVTENELECHRGIAHGAVVKCPMVTSDIAQRKTQKKTFMKDSVVGSSKKSATYICKMCPFTTSAKSVLKKHTEYLHSSSCVDSFGSPLGLDKRKNDILEEPVDSDSTKTLTKQQSTTFPKNSALKQDVKRTFGSTSQSSSFSKIHKRPHRIQKARKSIAQSGVNMCNQNSSPHKNVTIKSSVDQKPKYFHQAAKEKSNAKANSHYLYRHKYENYRMIKKSGESYPVHFKKEEASSLNSLHLFSSSSNSHNNFISDPHKPDAKRPESFKDHRRVAVKRVIKESKKESSVGGEDLDSYPDFLHKMTVVVLQKLNSAEKKDSYETEDESSWDNVELGDYTTQAIEDETYSDINQEHVNLFPLFKSKVEGQEPGENATLSYDQNDGFYFEYYEDTGSNNFLHEIHDPQHLETADASLSKHSSVFHWTDLSLEKKSCPYCPATFETGVGLSNHVRGHLHRAGLSYEARHVVSPEQIATSDKMQHFKRTGTGTPVKRVRKAIEKSETTSEHTCQLCGGWFDTKIGLSNHVRGHLKRLGKTKWDAHKSPICV

SEQ ID NO: 70771 - protein, 307 aa, Homo sapiens
MRSFLQQDVNKTKSRLNVLNGLANNMDDLKINTDITGAKEELLDDNNFISDKESGVHKPKDCQTSFQKNNTLTLPEELSKDKSENALSGGQSSLFIHAGAPTVSSENFILPKGAAVNGPVSHSSLTKTSNMNKGSVSLTTGQPVDQPTTESCSTLKVAADLQLSTPQKASQHQVLFLLSDVAHAKNPTHSNKKLPTSASVGCDIQNSVGSNIKSDGTLINQVEVGEDGEDLLVKDDCVNTVTGISSGTDGFRSENDTNWDPQKEFIQFLMTNEETVDKAPPHSKIGLEKKKAKNGCKQDNSLYRGLL

SEQ ID NO: 70772 - protein, 505 aa, Homo sapiens
MTKAQESLTLEDVAVDFTWEEWQFLSPAQKDLYRDVMLENYSNLVSVGYQAGKPDALTKLEQGEPLWTLEDEIHSPAHPEIEKADDHLQQPLQNQKILKRTGQRYEHGRTLKSYLGLTNQSRRYNRKEPAEFNGDGAFLHDNHEQMPTEIEFPESRKPISTKSQFLKHQQTHNIEKAHECTDCGKAFLKKSQLTEHKRIHTGKKPHVCSLCGKAFYKKYRLTEHERAHRGEKPHGCSLCGKAFYKRYRLTEHERAHKGEKPYGCSECGKAFPRKSELTEHQRIHTGIKPHQCSECGRAFSRKSLLVVHQRTHTGEKPHTCSECGKGFIQKGNLNIHQRTHTGEKPYGCIDCGKAFSQKSCLVAHQRYHTGKTPFVCPECGQPCSQKSGLIRHQKIHSGEKPYKCSDCGKAFLTKTMLIVHHRTHTGERPYGCDECEKAYFYMSCLVKHKRIHSREKRGDSVKVENPSTASHSLSPSEHVQGKSPVNMVTVAMVAGQCEFAHILHS

SEQ ID NO: 70773 - protein, 610 aa, Homo sapiens
MPSARGKSKSKAPITFGDLAIYFSQEEWEWLSPIQKDLYEDVMLENYRNLVSLGLSFRRPNVITLLEKGKAPWMVEPVRRRRAPDSGSKCETKKLPPNQCNKSGQSICQKLVSAQQKAPTRKSGCNKNSVLVKPKKGHSGKKPLKCNDCGKTFSRSFSLKLHQNIHTGEKPFECSNCRKAFRQISSILLHQRIHSGKKSHECNKCGESFNQRTTLILHMRIHDGKEILDCGKALSQCQSFNIHQKIHVVGNVCQCRKCGKAFNQMSSLLLHKKIHNGKKTHKYNKCGRGFKKKSVFVVHKRIHAGEKIPENAKALSQSLQQRSHHLENPFKCRKCGKLFNRISPLMLHQRIHTSEKPYKCDKCDKFFRRLSTLILHLRIHNGEKLYRCNKCEKVCNRHSSLIQHQKVHTKKKKLFECKECGKMFSGTANLKIHQNIHSEEKPFKCNKCSKVFGRQSFLIEHQRIHTGEKPYQCEECGKAFSHRISLTRHKRIHTEDRPYECDQCGKAFSQSAHLAQHERIHTGEKPYTCKTCGKAFSQRTSLILHERSHTGEKPYECNECGKAFSSGSDLIRHQRSHSSEKPYECSKCGKAYSRSSSLIRHQNTHSEEKA

SEQ ID NO: 70774 - protein, 738 aa, Homo sapiens
MRTLVNALSGGGQEIKPEGKCAHNGMCFRCEEVAPDTCEAYPYPGLVVSVAGKEGPNPDHKRGFLDLAQEGIQALPYQLSAHLSVWTLKGEERMPSARGKSKSKAPITFGDLAIYFSQEEWEWLSPIQKDLYEDVMLENYRNLVSLGLSFRRPNVITLLEKGKAPWMVEPVRRRRAPELVTVALFSSFGEVMFSRMVLMLMDVCQYLVIDELDSGSKCETKKLPPNQCNKSGQSICQKLVSAQQKAPTRKSGCNKNSVLVKPKKGHSGKKPLKCNDCGKTFSRSFSLKLHQNIHTGEKPFECSNCRKAFRQISSILLHQRIHSGKKSHECNKCGESFNQRTTLILHMRIHDGKEILDCGKALSQCQSFNIHQKIHVVGNVCQCRKCGKAFNQMSSLLLHKKIHNGKKTHKYNKCGRGFKKKSVFVVHKRIHAGEKIPENAKALSQSLQQRSHHLENPFKCRKCGKLFNRISPLMLHQRIHTSEKPYKCDKCDKFFRRLSTLILHLRIHNGEKLYRCNKCEKVCNRHSSLIQHQKVHTKKKKLFECKECGKMFSGTANLKIHQNIHSEEKPFKCNKCSKVFGRQSFLIEHQRIHTGEKPYQCEECGKAFSHRISLTRHKRIHTEDRPYECDQCGKAFSQSAHLAQHERIHTGEKPYTCKTCGKAFSQRTSLILHERSHTGEKPYECNECGKAFSSGSDLIRHQRSHSSEKPYECSKCGKAYSRSSSLIRHQNTHSEEKA

SEQ ID NO: 70775 - protein, 324 aa, Homo sapiens
KNSVLVKPKKGHSGKKPLKCNDCGKTFSRSFSLKLHQNIHTGEKPFECSNCRKAFRQISSILLHQRIHSGKKSHECNKCGESFNQRTTLILHMRIHDGKNPFKCRKCGKLFNRISPLMLHQRIHTSEKPYKCEECGKMFSGTANLKIHQNIHSEEKPFKCNKCSKVFGRQSFLIEHQRIHTGEKPYQCEECGKAFSHRISLTRHKRIHTEDRPYECDQCGKAFSQSAHLAQHERIHTGEKPYTCKTCGKAFSQRTSLILHERSHTGEKPYECNECGKAFSSGSDLIRHQRSHSSEKPYECSKCGKAYSRSSSLIRHQNTHSEEK

SEQ ID NO: 70776 - protein, 392 aa, Homo sapiens [sequence omitted]

SEQ ID NO: 70777 - protein, 610 aa, Homo sapiens; identical to SEQ ID NO: 70773

SEQ ID NO: 70778 - protein, 575 aa, Homo sapiens
MAMSQESLTFKDVFVDFTLEEWQQLDSAQKNLYRDVMLENYSHLVSVGHLVGKPDVIFRLGPGDESWMADGGTPVRTCAVWEVDEQIDHYKESQDKFLWQAAFIGKETLKDESGQECKICRKIIYLNTDFVSVKQRLPKYYSWERCSKHHLNFLGQNRSYVRKKDDGCKAYWKVCLHYNLHKAQPAERFFDPNQRGKALHQKQALRKSQRSQTGEKLYKCTECGKVFIQKANLVVHQRTHTGEKPYECCECAKAFSQKSTLIAHQRTHTGEKPYECSECGKTFIQKSTLIKHQRTHTGEKPFVCDKCPKAFKSSYHLIRHEKTHIRQAFYKGIKCTTSSLIYQRIHTSEKPQCSEHGKASDEKPSPTKHWRTHTKENIYECSKCGKSFRGKSHLSVHQRIHTGEKPYECSICGKTFSGKSHLSVHHRTHTGEKPYECRRCGKAFGEKSTLIVHQRMHTGEKPYKCNECGKAFSEKSPLIKHQRIHTGERPYECTDCKKAFSRKSTLIKHQRIHTGEKPYKCSECGKAFSVKSTLIVHHRTHTGEKPYECRDCGKAFSGKSTLIKHQRSHTGDKNL

SEQ ID NO: 70779 - protein, 581 aa, Homo sapiens
MAMSQESLTFKDVFVDFTLEEWQQLDSAQKNLYRDVMLENYSHLVSVGHLVGKPDVIFRLGPGDESWMADGGTPVRTCAGEDRPEVWEVDEQIDHYKESQDKFLWQAAFIGKETLKDESGQECKICRKIIYLNTDFVSVKQRLPKYYSWERCSKHHLNFLGQNRSYVRKKDDGCKAYWKVCLHYNLHKAQPAERFFDPNQRGKALHQKQALRKSQRSQTGEKLYKCTECGKVFIQKANLVVHQRTHTGEKPYECCECAKAFSQKSTLIAHQRTHTGEKPYECSECGKTFIQKSTLIKHQRTHTGEKPFVCDKCPKAFKSSYHLIRHEKTHIRQAFYKGIKCTTSSLIYQRIHTSEKPQCSEHGKASDEKPSPTKHWRTHTKENIYECSKCGKSFRGKSHLSVHQRIHTGEKPYECSICGKTFSGKSHLSVHHRTHTGEKPYECRRCGKAFGEKSTLIVHQRMHTGEKPYKCNECGKAFSEKSPLIKHQRIHTGERPYECTDCKKAFSRKSTLIKHQRIHTGEKPYKCSECGKAFSVKSTLIVHHRTHTGEKPYECRDCGKAFSGKSTLIKHQRSHTGDKNL

SEQ ID NO: 70780 - protein, 1237 aa, Homo sapiens
MGDMKTPDFDDLLAAFDIPDIDANEAIHSGPEENEGPGGPGKPEPGVGSESEDTAAASAGDGPGVPAQASDHGLPPPDISVVSVIVKNTVCPEQSEALAGGSAGDGAQAAGVTKEGPVGPHRMQNGFGSPEPSLPGTPHSPAPPSGGTWKEKGMEGKTPLDLFAHFGPEPGDHSDPLPPSAPSPTREGALTPPPFPSSFELAQENGPGMQPPVSSPPLGALKQESCSPHHPQVLAQQGSGSSPKATDIPASASPPPVAGVPFFKQSPGHQSPLASPKVPVCQPLKEEDDDEGPVDKSSPGSPQSPSSGAEAADEDSNDSPASSSSRPLKVRIKTIKTSCGNITRTVTQVPSDPDPPAPLAEGAFLAEASLLKLSPATPTSEGPKVVSVQLGDGTRLKGTVLPVATIQNASTAMLMAASVARKAVVLPGGTATSPKMIAKNVLGLVPQALPKADGRAGLGTGGQKVNGASVVMVQPSKTATGPSTGGGTVISRTQSSLVEAFNKILNSKNLLPAYRPNLSPPAEAGLALPPTGYRCLECGDAFSLEKSLARHYDRRSMRIEVTCNHCARRLVFFNKCSLLLHAREHKDKGLVMQCSHLVMRPVALDQMVGQPDITPLLPVAVPPVSGPLALPALGKGEGAITSSAITTVAAEAPVLPLSTEPPAAPATSAYTCFRCLECKEQCRDKAGMAAHFQQLGPPAPGATSNVCPTCPMMLPNRCSFSAHQRMHKNRPPHVCPECGGNFLQANFQTHLREACLHVSRRVGYRCPSCSVVFGGVNSIKSHIQTSHCEVFHKCPICPMAFKSGPSAHAHLYSQHPSFQTQQAKLIYKCAMCDTVFTHKPLLSSHFDQHLLPQRVSVFKCPSCPLLFAQKRTMLEHLKNTHQSGRLEETAGKGAGGALLTPKTEPEELAVSQGGAAPATEESSSSSEEEEVPSSPEPPRPAKRPRRELGSKGLKGGGGGPGGWTCGLCHSWFPERDEYVAHMKKEHGKSVKKFPCRLCERSFCSAPSLRRHVRVNHEGIKRVYPCRYCTEGKRTFSSRLILEKHVQVRHGLQLGAQSPGRGTTLARGSSARAQGPGRKRRQSSDSCSEEPDSTTPPAKSPRGGPGSGGHGPLRYRSSSSTEQSLMMGLRVEDGAQQCLDCGLCFASPGSLSRHRFISHKKRRGVGKASALGLGDGEEEAPPSRSDPDGGDSPLPASGGPLTCKVCGKSCDSPLNLKTHFRTHGMAFIRARQGAVGDN

SEQ ID NO: 70781 - protein, 1237 aa, Homo sapiens; identical to SEQ ID NO: 70780

SEQ ID NO: 70782 - protein, 1103 aa, Homo sapiens
MGDMKTPDFDDLLAAFDIPDIDANEAIHSGPEENEGPGGPGKPEPGVGSESEDTAAASAGDGPGVPAQASDHGLPPPDISVVSVIVKNTVCPEQSEALAGGSAGDGAQAAGVTKEGPVGPHRMQNGFGSPEPSLPGTPHSPAPPSGGTWKEKGMEGKTPLDLFAHFGPEPGDHSDPLPPSAPSPTREGALTPPPFPSSFELAQENGPGMQPPVSSPPLGALKQESCSPHHPQVLAQQGSGSSPKATDIPASASPPPVAGVPFFKQSPGHQSPLASPKVPVCQPLKEEDDDEGPVDKSSPGSPQSPSSGAEAADEDSNDSPASSSSRPLKVRIKTIKTSCGNITRTVTQVPSDPDPPAPLAEGAFLAEASLLKLSPATPTSEGPKVVSVQLGDGTRLKGTVLPVATIQNASTAMLMAASVARKAVVLPGGTATSPKMIAKNVLGLVPQALPKADGRAGLGTGGQKVNGASVVMVQPSKTATGPSTGGGTVISRTQSSLVEAFNKILNSKNLLPAYRPNLSPPAEAGLALPPTGYRCLECGDAFSLEKSLARHYDRRSMRIEVTCNHCARRLVFFNKCSLLLHAREHKDKGLVMQCSHLVMRPVALDQMVGQPDITPLLPVAVPPVSGPLALPALGKGEGAITSSAITTVAAEAPVLPLSTEPPAAPATSAYTCFRCLECKEQCRDKAGMAAHFQQLGPPAPGATSNVCPTCPMMLPNRCSFSAHQRMHKNRPPHVCPECGGNFLQANFQTHLREACLHVSRRVGYRCPSCSVVFGGVNSIKSHIQTSHCEVFHKCPICPMAFKSGPSAHAHLYSQHPSFQTQQAKLIYKCAMCDTVFTHKPLLSSHFDQHLLPQRVSVFKCPSCPLLFAQKRTMLEHLKNTHQSGRLEETAGKGAGGALLTPKTEPEELAVSQGGAAPATEESSSSSEEEEVPSSPEPPRPAKRPRRELGSKGLKGGGGGPGGWTCGLCHSWFPERDEYVAHMKKEHGKSVKKFPCRLCERSFCSAPSLRRHVRVNHEGIKRVYPCRSKGPGLRAVPLLPSCPLPFQVLHRGKTHLQQPPDPRETCPGPARLAAWGPVPWPGDHLGSGFQCQSPGARSETPPVF

SEQ ID NO: 70783 - protein, 706 aa, Homo sapiens
  MOD_RES (1)..(1): Any amino acid
XTVLPVATIQNASTAMLMAASVARKAVVLPGGTATSPKMIAKNVLGLVPQALPKADGRAGLGTGGQKVNGASVVMVQPSKTATGPSTGGGTVISRTQSSLVEAFNKILNSKNLLPAYRPNLSPPAEAGLALPPTGYRCLECGDAFSLEKSLARHYDRRSMRIEVTCNHCARRLVFFNKCSLLLHAREHKDKGLVMQCSHLVMRPVALDQMVGQPDITPLLPVAVPPVSGPLALPALGKGEGAITSSAITTVAAEAPVLPLSTEPPAAPATSAYTCFRCLECKEQCRDKAGMAAHFQQLGPPAPGATSNVCPTCPMMLPNRCSFSAHQRMHKNRPPHVCPECGGNFLQANFQTHLREACLHVSRRVGYRCPSCSVVFGGVNSIKSHIQTSHCEVFHKCPICPMAFKSGPSAHAHLYSQHPSFQTQQAKLIYKCAMCDTVFTHKPLLSSHFDQHLLPQRVSVFKCPSCPLLFAQKRTMLEHLKNTHQSGRLEETAGKGAGGALLTPKTEPEELAVSQGGAAPATEESSSSSEEEEVPSSPEPPRPAKRPRRELGSKGLKGGGGGPGGWTCGLCHSWFPERDEYVAHMKKEHGKSVKKFPCRLCERSFCSAPSLRRHVRVNHEGIKRVYPCRSKGPGLRAVPLLPSCPLPFQVLHRGKTHLQQPPDPRETCPGPARLAAWGPVPWPGDHLGSGFQCQSPGARSETPPVF

SEQ ID NO: 70784 - protein, 149 aa, Homo sapiens
MPCCSHRRCREDPGTSESQEMEEWALLDISQRKLYKEVMLETFRNLTSVGKSWKDQNIEYEYQNPRRNFRSLIEKKVNEIKDDSHCGETFTQVPDDRLNFQEKKASPEIKSCDSFVCGEVGLGNSSFNMNIRGDIGHKAYEYQEYGPKP

SEQ ID NO: 70785 - protein, 566 aa, Homo sapiens
MPCCSHRRCREDPGTSESQEMDPVAFDDVAVNFTQEEWALLDISQRKLYKEVMLETFRNLTSVGKSWKDQNIEYEYQNPRRNFRSLIEKKVNEIKDDSHCGETFTQVPDDRLNFQEKKASPEIKSCDSFVCGEVGLGNSSFNMNIRGDIGHKAYEYQEYGPKPCKCQQPKKAFRYHPSFRTPQRDHTGEKPYACKECGKTFISHSSIQRHVVMHSGDGPYKCKFCGKAFHCLSLYLIHERIHTGEKPYECKQCGKSFSYSATLRIHERTHTGEKPYECQQCGKAFHSPRCYRRHERIHTGEKAYQCKECGKAFTCPQYVRIHERTHSRKKPYECTQCGKALSSLTSFQTHIRMHSGERPYECKICGKGFCSANSFQRHEKTHSGEKPYKCKQCGKAFIHSSSLRYHERIHTGEKPYECKQCGKAFRSSSHLQLHGRTHTGEKPYECQECGKAFRSMKNLQSHERTQTHVRIHSGERPYKCKLCGKGFYCPKSLQRHEKTHTGEKLYECKQCGEAFSSSSSFRYHERTHTGEKPYKCKQCGKAFRAASVLRMHGRTHPEDKPYECKQ

SEQ ID NO: 70786 - protein, 686 aa, Homo sapiens
MEVVTFGDVAVHFSREEWQCLDPGQRALYREVMLENHSSVAGLAGFLVFKPELISRLEQGEEPWVLDLQGAEGTEAPRTSKTDSTIRTENEQACEDMDILKSESYGTVVRISPQDFPQNPGFGDVSDSEVWLDSHLGSPGLKVTGFTFQNNCLNEETVVPKTFTKDAPQGCKELGSSGLDCQPLESQGESAEGMSQRCEECGKGIRATSDIALHWEINTQKISRCQECQKKLSDCLQGKHTNNCHGEKPYECAECGKVFRLCSQLNQHQRIHTGEKPFKCTECGKAFRLSSKLIQHQRIHTGEKPYRCEECGKAFGQSSSLIHHQRIHTGERPYGCRECGKAFSQQSQLVRHQRTHTGERPYPCKECGKAFSQSSTLAQHQRMHTGEKAQILKASDSPSLVAHQRIHAVEKPFKCDECGKAFRWISRLSQHQLIHTGEKPYKCNKCTKAFGCSSRLIRHQRTHTGEKPFKCDECGKGFVQGSHLIQHQRIHTGEKPYVCNDCGKAFSQSSSLIYHQRIHKGEKPYECLQCGKAFSMSTQLTIHQRVHTGERPYKCNECGKAFSQNSTLFQHQIIHAGVKPYECSECGKAFSRSSYLIEHQRIHTRAQWFYEYGNALEGSTFVSRKKVNTIKKLHQCEDCEKIFRWRSHLIIHQRIHTGEKPYKCNDCGKAFNRSSRLTQHQKIHMG

SEQ ID NO: 70787 - protein, 697 aa, Homo sapiens
MGFLGCWCVSFQEVVTFGDVAVHFSREEWQCLDPGQRALYREVMLENHSSVAGLAGFLVFKPELISRLEQGEEPWVLDLQGAEGTEAPRTSKTDSTIRTENEQACEDMDILKSESYGTVVRISPQDFPQNPGFGDVSDSEVWLDSHLGSPGLKVTGFTFQNNCLNEETVVPKTFTKDAPQGCKELGSSGLDCQPLESQGESAEGMSQRCEECGKGIRATSDIALHWEINTQKISRCQECQKKLSDCLQGKHTNNCHGEKPYECAECGKVFRLCSQLNQHQRIHTGEKPFKCTECGKAFRLSSKLIQHQRIHTGEKPYRCEECGKAFGQSSSLIHHQRIHTGERPYGCRECGKAFSQQSQLVRHQRTHTGERPYPCKECGKAFSQSSTLAQHQRMHTGEKAQILKASDSPSLVAHQRIHAVEKPFKCDECGKAFRWISRLSQHQLIHTGEKPYKCNKCTKAFGCSSRLIRHQRTHTGEKPFKCDECGKGFVQGSHLIQHQRIHTGEKPYVCNDCGKAFSQSSSLIYHQRIHKGEKPYECLQCGKAFSMSTQLTIHQRVHTGERPYKCNECGKAFSQNSTLFQHQIIHAGVKPYECSECGKAFSRSSYLIEHQRIHTRAQWFYEYGNALEGSTFVSRKKVNTIKKLHQCEDCEKIFRWRSHLIIHQRIHTGEKPYKCNDCGKAFNRSSRLTQHQKIHMG

SEQ ID NO: 70788 - protein, 148 aa, Homo sapiens
MEVVTFGDVAVHFSREEWQCLDPGQRALYREVMLENHSSVAGLAGFLVFKPELISRLEQGEEPWVLDLQGAEGTEAPRTSKTGFLGRPTMGQEPRHPHAPPATPVPGLPKHCSQRLTLPPPGLSSSPLGHFLVHDQDRRRGTSAIWMV

SEQ ID NO: 70789 - protein, 686 aa, Homo sapiens; identical to SEQ ID NO: 70786

SEQ ID NO: 70790 - protein, 590 aa, Homo sapiens
MDILKSESYGTVVRISPQDFPQNPGFGDVSDSEVWLDSHLGSPGLKVTGFTFQNNCLNEETVVPKTFTKDAPQGCKELGSSGLDCQPLESQGESAEGMSQRCEECGKGIRATSDIALHWEINTQKISRCQECQKKLSDCLQGKHTNNCHGEKPYECAECGKVFRLCSQLNQHQRIHTGEKPFKCTECGKAFRLSSKLIQHQRIHTGEKPYRCEECGKAFGQSSSLIHHQRIHTGERPYGCRECGKAFSQQSQLVRHQRTHTGERPYPCKECGKAFSQSSTLAQHQRMHTGEKAQILKASDSPSLVAHQRIHAVEKPFKCDECGKAFRWISRLSQHQLIHTGEKPYKCNKCTKAFGCSSRLIRHQRTHTGEKPFKCDECGKGFVQGSHLIQHQRIHTGEKPYVCNDCGKAFSQSSSLIYHQRIHKGEKPYECLQCGKAFSMSTQLTIHQRVHTGERPYKCNECGKAFSQNSTLFQHQIIHAGVKPYECSECGKAFSRSSYLIEHQRIHTRAQWFYEYGNALEGSTFVSRKKVNTIKKLHQCEDCEKIFRWRSHLIIHQRIHTGEKPYKCNDCGKAFNRSSRLTQHQKIHMG

SEQ ID NO: 70791 - protein, 489 aa, Homo sapiens
MKELDPKNDISEDKLSVVGEATGGPTRNGARGPGSEGVWEPGSWPERPRGDAGAEWEPLGIPQGNKLLGGSVPACHELKAFANQGCVLVPPRLDDPTEKGACPPVRRGKNFSSTSDLSKPPMPCEEKKTYDCSECGKAFSRSSSLIKHQRIHTGEKPFECDTCGKHFIERSSLTIHQRVHTGEKPYACGDCGKAFSQRMNLTVHQRTHTGEKPYVCDVCGKAFRKTSSLTQHERIHTGEKPYACGDCGKAFSQNMHLIVHQRTHTGEKPYVCPECGRAFSQNMHLTEHQRTHTGEKPYACKECGKAFNKSSSLTLHQRNHTGEKPYVCGECGKAFSQSSYLIQHQRFHIGVKPFECSECGKAFSKNSSLTQHQRIHTGEKPYECYICKKHFTGRSSLIVHQIVHTGEKPYVCGECGKAFSQSAYLIEHQRIHTGEKPYRCGQCGKSFIKNSSLTVHQRIHTGEKPYRCGECGKTFSRNTNLTRHLRIHT

SEQ ID NO: 70792 - protein, 761 aa, Homo sapiens
MDSGGGSLGLHTPDSRMAHTMIMQDFVAGMAGTAHIDGDHIVVSVPEAVLVSDVVTDDGITLDHGLAAEVVHGPDIITETDVVTEGVIVPEAVLEADVAIEEDLEEDDGDHILTSELITETVRVPEQVFVADLVTGPNGHLEHVVQDCVSGVDSPTMVSEEVLVTNSDTETVIQAAGGVPGSTVTIKTEDDDDDDVKSTSEDYLMISLDDVGEKLEHMGNTPLKIGSDGSQEDAKEDGFGSEVIKVYIFKAEAEDDVEIGGTEIVTESEYTSGHSVAGVLDQSRMQREKMVYMAVKDSSQEEDDIRDERRVSRRYEDCQASGNTLDSALESRSSTAAQYLQICDGINTNKVLKQKAKKRRRGETRQWQTAVIIGPDGQPLTVYPCHICTKKFKSRGFLKRHMKNHPDHLMRKKYQCTDCDFTTNKKVSFHNHLESHKLINKVDKTHEFTEYTRRYREASPLSSNKLILRDKEPKMHKCKYCDYETAEQGLLNRHLLAVHSKNFPHVCVECGKGFRHPSELKKHMRTHTGEKPYQCQYCIFRCADQSNLKTHIKSKHGNNLPYKCEHCPQAFGDERELQRHLDLFQGHKTHQCPHCDHKSTNSSDLKRHIISVHTKDFPHKCEVCDKGFHRPSELKKHSDIHKGRKIHQCRHCDFKTSDPFILSGHILSVHTKDQPLKCKRCKRGFRQQNELKKHMKTHTGRKIYQCEYCEYSTTDASGFKRHVISIHTKDYPHRCEFCKKGFRRPSEKNQHIMRHHKEALM

SEQ ID NO: 70793 - protein, 761 aa, Homo sapiens; identical to SEQ ID NO: 70792

SEQ ID NO: 70794 - protein, 769 aa, Homo sapiens
MQDFVAGMAGTAHIDGDHIVVSVPEAVLVSDVVTDDGITLDHGLAAEVVHGPDIITETDVVTEGVIVPEAVLEADVAIEEDLEEDDGDHILTSELITETVRVPEQVFVADLVTGPNGHLEHVVQDCVSGVDSPTMVSEEVLVTNSDTETVIQAAGGVPGSTVTIKTEDDDDDDVKSTSEDYLMISLDDVGEKLEHMGNTPLKIGSDGSQEDAKEDGFGSEVIKVYIFKAEAEDDVEIGGTEIVTESEYTSGHSVAGVLDQSRMQREKMVYMAVKDSSQEEDDISCAEIADEVYMEVIVGEEEGTSLPEIQLEDSDVNKTVVPVVWAAAYGNTLDSALESRSSTAAQYLQICDGINTNKVLKQKAKKRRRGETRQWQTAVIIGPDGQPLTVYPCHICTKKFKSRGFLKRHMKNHPDHLMRKKYQCTDCDFTTNKKVSFHNHLESHKLINKVDKTHEFTEYTRRYREASPLSSNKLILRDKEPKMHKCKYCDYETAEQGLLNRHLLAVHSKNFPHVCVECGKGFRHPSELKKHMRTHTGEKPYQCQYCIFRCADQSNLKTHIKSKHGNNLPYKCEHCPQAFGDERELQRHLDLFQGHKTHQCPHCDHKSTNSSDLKRHIISVHTKDFPHKCEVCDKGFHRPSELKKHSDIHKGRKIHQCRHCDFKTSDPFILSGHILSVHTKDQPLKCKRCKRGFRQQNELKKHMKTHTGRKIYQCEYCEYSTTDASGFKRHVISIHTKDYPHRCEFCKKGFRRPSEKNQHIMRHHKEALM

SEQ ID NO: 70795 - protein, 603 aa, Homo sapiens
MISLDDVGEKLEHMGNTPLKIGSDGSQEDAKEDGFGSEVIKVYIFKAEAEDDVEIGGTEIVTESEYTSGHSVAGVLDQSRMQREKMVYMAVKDSSQEEDDISCAEIADEVYMEVIVGEEEGTSLPEIQLEDSDVNKTVVPVVWAAAYGDERRVSRRYEDCQASGNTLDSALESRSSTAAQYLQICDGINTNKVLKQKAKKRRRGETRQWQTAVIIGPDGQPLTVYPCHICTKKFKSRGFLKRHMKNHPDHLMRKKYQCTDCDFTTNKKVSFHNHLESHKLINKVDKTHEFTEYTRRYREASPLSSNKLILRDKEPKMHKCKYCDYETAEQGLLNRHLLAVHSKNFPHVCVECGKGFRHPSELKKHMRTHTGEKPYQCQYCIFRCADQSNLKTHIKSKHGNNLPYKCEHCPQAFGDERELQRHLDLFQGHKTHQCPHCDHKSTNSSDLKRHIISVHTKDFPHKCEVCDKGFHRPSELKKHSDIHKGRKIHQCRHCDFKTSDPFILSGHILSVHTKDQPLKCKRCKRGFRQQNELKKHMKTHTGRKIYQCEYCEYSTTDASGFKRHVISIHTKDYPHRCEFCKKGFRRPSEKNQHIMRHHKEALM

SEQ ID NO: 70796 - protein, 536 aa, Homo sapiens
MGPLQFRDVAIEFSLEEWHCLDTAQRNLYRNVMLENYRNLVFLGIVVSKPDLITCLEQGKKPLTMKKHEMVANPSVTCSHFARDLWPEQSIKDSFQKVTLRRYENYGHDNLQFKKGCESVDECKVHKRGYNGLNQYLTTTQSKIFQCDKYVKVIHKFSNSNRHKIRHTGKKPFKCIECGKAFNQSSTLTTHKKIHTGEKPFKCEECGKAFNWSSHLTTHKRIHTGEKRYKCEDCGKAFSRFSYLTAHKIIHSGEKPYKCEECGKAFKRSSNLTTHKIIHTGEKPYKCEECGKAFKRSSILTAHKIIHSGEKPYKCEECGKAFKHPSVLTTHKRIHTGEKPYKCEECGRAFKYFSSLTTHKIIHSGEKPYKCEECGKAFNWSSHLTTHKRIHTGEKPYKCEECGEAFKYSSSLTTHKIIHTGQQPFKCEECGKAFKCFSILTTHKRIHTGEKPYKCEECGKAFNSSSHLTAHKRIHTGEKPYKCERCGKAFKRSFILTRHKRIHTGEKPYKCEECGKGFKCPSTLTTHKVIHTGEKL

SEQ ID NO: 70797 - protein, 644 aa, Homo sapiens
MEIPAPEPEKTALSSQDPALSLKENLEDISGWGLPEARSKESVSFKDVAVDFTQEEWGQLDSPQRALYRDVMLENYQNLLALGPPLHKPDVISHLERGEEPWSMQREVPRGPCPEWELKAVPSQQQGICKEEPAQEPIMERPLGGAQAWGRQAGALQRSQAAPWAPAPAMVWDVPVEEFPLRCPLFAQQRVPEGGPLLDTRKNVQATEGRTKAPARLCAGENASTPSEPEKFPQVRRQRGAGAGEGEFVCGECGKAFRQSSSLTLHRRWHSREKAYKCDECGKAFTWSTNLLEHRRIHTGEKPFFCGECGKAFSCHSSLNVHQRIHTGERPYKCSACEKAFSCSSLLSMHLRVHTGEKPYRCGECGKAFNQRTHLTRHHRIHTGEKPYQCGSCGKAFTCHSSLTVHEKIHSGDKPFKCSDCEKAFNSRSRLTLHQRTHTGEKPFKCADCGKGFSCHAYLLVHRRIHSGEKPFKCNECGKAFSSHAYLIVHRRIHTGEKPFDCSQCWKAFSCHSSLIVHQRIHTGEKPYKCSECGRAFSQNHCLIKHQKIHSGEKSFKCEKCGEMFNWSSHLTEHQRLHSEGKPLAIQFNKHLLSTYYVPGSLLGAGDAGLRDVDPIDALDVAKLLCVVPPRAGRNFSLGSKPRN

SEQ ID NO: 70798 - protein, 644 aa, Homo sapiens; identical to SEQ ID NO: 70797

SEQ ID NO: 70799 - protein, 612 aa, Homo sapiens
MEIPAPEPEKTALSSQDPALSLKENLEDISGWGLPEARSKESVSFKDVAVDFTQEEWGQLDSPQRALYRDVMLENYQNLLALEWELKAVPSQQQGICKEEPAQEPIMERPLGGAQAWGRQAGALQRSQAAPWAPAPAMVWDVPVEEFPLRCPLFAQQRVPEGGPLLDTRKNVQATEGRTKAPARLCAGENASTPSEPEKFPQVRRQRGAGAGEGEFVCGECGKAFRQSSSLTLHRRWHSREKAYKCDECGKAFTWSTNLLEHRRIHTGEKPFFCGECGKAFSCHSSLNVHQRIHTGERPYKCSACEKAFSCSSLLSMHLRVHTGEKPYRCGECGKAFNQRTHLTRHHRIHTGEKPYQCGSCGKAFTCHSSLTVHEKIHSGDKPFKCSDCEKAFNSRSRLTLHQRTHTGEKPFKCADCGKGFSCHAYLLVHRRIHSGEKPFKCNECGKAFSSHAYLIVHRRIHTGEKPFDCSQCWKAFSCHSSLIVHQRIHTGEKPYKCSECGRAFSQNHCLIKHQKIHSGEKSFKCEKCGEMFNWSSHLTEHQRLHSEGKPLAIQFNKHLLSTYYVPGSLLGAGDAGLRDVDPIDALDVAKLLCVVPPRAGRNFSLGSKPRN

SEQ ID NO: 70800 - protein, 69 aa, Homo sapiens
MEIPAPEPEKTALSSQDPALSLKENLEDISGWGLPEARSKSLALVTQAGVQWRNLGSLQPPPLGFKQFS

SEQ ID NO: 70801 - protein, 644 aa, Homo sapiens
MAEAVAAPISPWTMAATIQAMERKIESQAARLLSLEGRTGMAEKKLADCEKTAVEFGNQLEGKWAVLGTLLQEYGLLQRRLENVENLLRNRNFWILRLPPGSKGESPKEWGKLEDWQKELYKHVMRGNYETLVSLDYAISKPEVLSQIEQGKEPCNWRRPGPKIPDVPVDPSPGSGPPVPAPDLLMQIKQEGELQLQEQQALGVEAWAAGQPDIGEEPWGLSQLDSGAGDISTDATSGVHSNFSTTIPPTSWQTDLPPHHPSSACSDGTLKLNTAASTEDVKIVIKTEVQEEEVVATPVHPTDLEAHGTLFGPGQATRFFPSPAQEGAWESQGSSFPSQDPVLGLREPARPERDMGELSPAVAQEETPPGDWLFGGVRWGWNFRCKPPVGLNPRTGPEGLPYSSPDNGEAILDPSQAPRPFNEPCKYPGRTKGFGHKPGLKKHPAAPPGGRPFTCATCGKSFQLQVSLSAHQRSCGAPDGSGPGTGGGGSGSGGGGGGSGGGSARDGSALRCGECGRCFTRPAHLIRHRMLHTGERPFPCTECEKRFTERSKLIDHYRTHTGVRPFTCTVCGKSFIRKDHLRKHQRNHAAGAKTPARGQPLPTPPAPPDPFKSPASKGPLASTDLVTDWTCGLSVLGPTDGGDM

SEQ ID NO: 70802 - protein, 645 aa, Homo sapiens
MAEAVAAPISPWTMAATIQAMERKIESQAARLLSLEGRTGMAEKKLADCEKTAVEFGNQLEGKWAVLGTLLQEYGLLQRRLENVENLLRNRNFWILRLPPGSKGESPKEWGKLEDWQKELYKHVMRGNYETLVSLDYAISKPEVLSQIEQGKEPCNWRRPGPKIPDVPVDPSPGSGPPVPAPDLLMQIKQEGELQLQEQQALGVEAWAAGQPDIGEEPWGLSQLDSGAGDISTDATSGVHSNFSTTIPPTSWQTDLPPHHPSSACSDGTLKLNTAASTEADVKIVIKTEVQEEEVVATPVHPTDLEAHGTLFGPGQATRFFPSPAQEGAWESQGSSFPSQDPVLGLREPARPERDMGELSPAVAQEETPPGDWLFGGVRWGWNFRCKPPVGLNPRTGPEGLPYSSPDNGEAILDPSQAPRPFNEPCKYPGRTKGFGHKPGLKKHPAAPPGGRPFTCATCGKSFQLQVSLSAHQRSCGAPDGSGPGTGGGGSGSGGGGGGSGGGSARDGSALRCGECGRCFTRPAHLIRHRMLHTGERPFPCTECEKRFTERSKLIDHYRTHTGVRPFTCTVCGKSFIRKDHLRKHQRNHAAGAKTPARGQPLPTPPAPPDPFKSPASKGPLASTDLVTDWTCGLSVLGPTDGGDM

SEQ ID NO: 70803 - protein, 723 aa, Homo sapiens
MSLLKERKPKKPHYIPRPPGKPFKYKCFQCPFTCNEKSHLFNHMKYGLCKNSITLVSEQDRVPKCPKSNSLDPKQTNQPDATAKPASSKSVANGLSAFDSKLQHSSAREDIKENLELQARGTHRCLGQKPALHRASPCKSPAPEAALGAQPALEGAARPSAFVPVGEHRLKGPDNAEAPETLALHNPTAKAVSFHTKSAFHTPGYPWKAGSPFLPPEFPHKISSTKGLGAISPYMHPTIPEYPPHFYTEHGLATIYSPYLLAGSSPECDAPLLSVYGTQDPRHFLPHPGPIPKHLAPSPATYDHYRFFQQYPSNLPIPYGFYRPESAFSSYGLRLPPVTGLTRDQSSHLLEEATLVYPASSPSRLNPSDPNRKHVEFESPIPEAKDSSKAGQRDTEGSKMSPRAGSAATGSPGRPSPTDFMQTSQTCEGLYDLSNKAASSALGRLYPPEQSLTAFRPVKKSTECLPAQAAETTAESPVSLNVVNGDPPAPTGSASLVSEAAPSSPDDSSGMGPLNLSKKSEINLAATHEPTYQGSPQAETASFSELQDLPLNLSVKDPCNTQAPRPAFPGRPRAAEPAAAVPQKTGTEGSEDGPSHPETKPGSLDGDGAPPTGPGEEAPDACAVDSSEEQKQTAAVALCQLAAYSPRNIRVGDGDAAAPEPACRQDTPTLSSMESQEAQCDLRPKGQKRTSLRDAGKSQQGAKKAKLQDTARVFTLRRRARVS

SEQ ID NO: 70804 - protein, 316 aa, Homo sapiens
MSPRAGSAATGSPGRPSPTDFMQTSQTCEGLYDLSNKAASSALGRLYPPEQSLTAFRPVKKSTECLPAQAAETTAESPVSLNVVNGDPPAPTGSASLVSEAAPSSPDDSSGKSEINLAATHEPTYQGSPQAETASFSELQDLPLNLSVKDPCNTQAPRPAFPGRPRAAEPAAAVPQKTGTEGSEDGPSHPETKPGSLDGDGAPPTGPGEEAPDACAVDSSEEQKQTAAVALCQLAAYSPRNIRVGDGDAAAPEPACRQDTPTLSSMESQEAQCDLRPKGQKRTSLRDAGKSQQGAKKAKLQDTARVFTLRRRARVS

SEQ ID NO: 70805 - protein, 296 aa, Homo sapiens
MYFSQEEWELLDPTQKALYNDVMQENYETVISLALFVLPKPKVISCLEQGEEPWVQVSPEFKDSAGKSPTGLKLKNDTENHQPVSLSDLEIQASAGVISKKAKVKVPQKTAGKENHFDMHRVGKWHQDFPVKKRKKLSTWKQELLKLMDRHKKDCAREKPFKCQECGKTFRVSSDLIKHQRIHTEEKPYKCQQCDKRFRWSSDLNKHLTTHQGIKPYKCSWCGKSFSQNTNLHTHQRTHTGEKPFTCHECGKKFSQNSHLIKHRRTHTGEQPYTCSICRRNFSRRSSLLRHQKLHL

SEQ ID NO: 70806 - protein, 296 aa, Homo sapiens; identical to SEQ ID NO: 70805

SEQ ID NO: 70807 - protein, 415 aa, Homo sapiens
MAMRELNADSCSSPQMGAMWETSGSVKENSSQSKKYSTKIENLGPESACRHFWSFRYHEATGPLETISQLQKLCHQWLRPEIHSKEQILEMLVLEQFLSILPKETQNWVQKHHPQNVKQALVLVEFLQREPDGTKNESLLTFEDVAVYFSEEEWQLLNPLEKTLYNDVMQDIYETVISLGLKLKNDTGNDHPISVSTSEIQTSGCEVSKKTRMKIAQKTMGRENPGDTHSVQKWHRAFPRKKRKKPATCKQELPKLMDLHGKGPTGEKPFKCQECGKSFRVSSDLIKHHRIHTGEKPYKCQQCDRRFRWSSDLNKHFMTHQGIKPYRCSWCGKSFSHNTNLHTHQRIHTGEKPFKCDECGKRFIQNSHLIKHQRTHTGEQPYTCSLCKRNFSRRSSLLRHQKLHRRREACLVSPN

SEQ ID NO: 70808 - protein, 510 aa, Homo sapiens
MAMRELNADSCSSPQMGAMWETSGSVKENSSQSKKYSTKIENLGPESACRHFWSFRYHEATGPLETISQLQKLCHQWLRPEIHSKEQILEMLVLEQFLSILPKETQNWVQKHHPQNVKQALVLVEFLQREPDGTKNEVTAHELGKEAVLLGGTAVAPGFKWKPAEPQPMGVFQKEYWNTYRVLQEQLGWNTHKETQPVYERAVHDQQMLALSEQKRIKHWKMASKLILPESLSLLTFEDVAVYFSEEEWQLLNPLEKTLYNDVMQDIYETVISLGLKLKNDTGNDHPISVSTSEIQTSGCEVSKKTRMKIAQKTMGRENPGDTHSVQKWHRAFPRKKRKKPATCKQELPKLMDLHGKGPTGEKPFKCQECGKSFRVSSDLIKHHRIHTGEKPYKCQQCDRRFRWSSDLNKHFMTHQGIKPYRCSWCGKSFSHNTNLHTHQRIHTGEKPFKCDECGKRFIQNSHLIKHQRTHTGEQPYTCSLCKRNFSRRSSLLRHQKLHRRREACLVSPN

SEQ ID NO: 70809 - protein, 515 aa, Homo sapiens
MESLGLHTVTLSDGTTAYVQQAVKGEKLLEGQVIQLEDGTTAYIHQVTVQKEALSFEDGQPVQLEDGSMAYIHRTPREGYDPSTLEAVQLEDGSTAYIHHPVAVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHCKPYTCSTCGKTYRQTSTLAMHKRSAHGELEATEESEQALYEQQQLEAASAAEESPPPKRPRIAYLSEVKEERDDIPAQVAMVTEEDGAPQVALITQDGAQQVTIITSGAVVAEDSSVASLRHQQVALLATANGTHIAVQLEEQQTLEEAINVATAAMQQGAVTLETTVSESGC

SEQ ID NO: 70810 - protein, 570 aa, Homo sapiens
MESLGLHTVTLSDGTTAYVQQAVKGEKLLEGQVIQLEDGTTAYIHQVTVQKEALSFEDGQPVQLEDGSMAYIHRTPREGYDPSTLEAVQLEDGSTAYIHHPVAVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHCKPYTCSTCGKTYRQTSTLAMHKRSAHGELEATEESEQALYEQQQLEAASAAEESPPPKRPRIAYLSEVKEERDDIPAQVAMVTEEDGAPQVALITQDGAQQVSLSPEDLQALGSAISMVTQHGSTTLTIPSPDADLATSGTHTVTMVSADGTQTQPVTIITSGAVVAEDSSVASLRHQQVALLATANGTHIAVQLEEQQTLEEAINVATAAMQQGAVTLETTVSESGC

SEQ ID NO: 70811 - protein, 428 aa, Homo sapiens
MESLGLHTVTLSDGTTAYVQQAVKGEKLLEGQVIQLEDGTTAYIHQVTVQKEALSFEDGQPVQLEDGSMAYIHRTPREGYDPSTLEAVQLEDGSTAYIHHPVAVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHCKPYTCSTCGKTYRQTSTLAMHKRSGHCGHAARGCDPGDNSVGEWLLSPRGLGPTPCWRKCHLHGHSCPQGPRLWLTHRRWPHRSLG

SEQ ID NO: 70812 - protein, 544 aa, Homo sapiens
MESLGLHTVTLSDGTTAYVQQAVKGEKLLEGQVIQLEDGTTAYIHQVTVQKEGYDPSTLEAVQLEDGSTAYIHHPVAVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHCKPYTCSTCGKTYRQTSTLAMHKRSAHGELEATEESEQALYEQQQLEAASAAEESPPPKRPRIAYLSEVKEERDDIPAQVAMVTEEDGAPQVALITQDGAQQVSLSPEDLQALGSAISMVTQHGSTTLTIPSPDADLATSGTHTVTMVSADGTQTQPVTIITSGAVVAEDSSVASLRHQQVALLATANGTHIAVQLEEQQTLEEAINVATAAMQQGAVTLETTVSESGC

SEQ ID NO: 70813 - protein, 402 aa, Homo sapiens
MESLGLHTVTLSDGTTAYVQQAVKGEKLLEGQVIQLEDGTTAYIHQVTVQKEALSFEDGQPVQLEDGSMAYIHRTPREGYDPSTLEAVQLEDGSTAYIHHPVAVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHHCGHAARGCDPGDNSVGEWLLSPRGLGPTPCWRKCHLHGHSCPQGPRLWLTHRRWPHRSLG

SEQ ID NO: 70814 - protein, 340 aa, Homo sapiens
MESLGLHTVTLSDGTTAYVQQAVKGEKLLEGQVIQLEDGTTAYIHQVTVQKEALSFEDGQPVQLEDGSMAYIHRTPREGYDPSTLEAVQLEDGSTAYIHHPVAVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHT

SEQ ID NO: 70815 - protein, 545 aa, Homo sapiens
MDCVIFEEVAVNFTPEEWALLDHAQRSLYRDVMLETCRNLASLDCYIYVRTSGSSSQRDVFGNGISNDEEIVKFTGSDSWSIFGENWRFDNTGDQHQIPQRHLRSQLGRLCESNEGHQCGETLSQTANLLVHKSYPTEAKPSECTKCGKAFENRQRSHTGQRPCKECGQACSCLSCQSPPMKTQTVEKPCNCQDSRTASVTYVKSLSSKKSYECQKCGKAFICPSSFRGHVNSHHGQKTHACKVCGKTFMYYSYLTRHVRTHTGEKPYECKECGKAFSCPSYFREHVRTHTGEKPYECKHCGKSFSCYSSFRDHVRTHTGEKPCQCKHCGKAFTCYSSLREHGRTHSGEKPYECKECGKAFRYPSSLRAHMRMHTGEKPYVCKQCGKAFGCPTYFRRHVKTHSGVKPYQCKECGKAYSFSSSLRIHVRTHTGEKPFECKHCGKAFSCHSSLREHVRTHSGEKPYECNQCGKAFSHAQYFQKHVRSHSGVKPYECTECGKAYSCSSSLRVHVRTHTGERPYECKQCGKTFRYLASLQAHVRTHAGA

SEQ ID NO: 70816 - protein, 435 aa, Homo sapiens
RLCESNEGHQCGETLSQTANLLVHKSYPTEAKPSECTKCGKTFMYYSYLTRHVRTHTGEKPYECKECGKAFSCPSYFREHVRTHTGEKPYECKHCGKSFSCYSSFRDHVRTHTGEKPCQCKHCGKAFTCYSSLREHGRTHSGEKPYECKECGKAFRYPSSLRAHMRMHTGEKPYVCKQCGKAFGCPTYFRRHVKTHSGVKPYQCKECGKAYSFSSSLRIHVRTHTGEKPFECKHCGKAFSCHSSLREHVRTHSGEKPYECNQCGKAFSHAQYFQKHVRSHSGVKPYECTECGKAYSCSSSLRVHVRTHTGERPYECKQCGKTFSWPSDLRVHMRTHSGEKRCGCKQCGKSFSSPSSFKGHIRTHTGEKLYTCRECGKVFSSPSYFRTQVRIHIGEKPYVCEQRGKVFSWSSSFRGHLRTHSREKPYECKECTKAF

SEQ ID NO: 70817 - protein, 498 aa, Homo sapiens
MLEEGVLPSPGPALPQEENTGEEGMAAGLLTAGPRGSTFFSSVTVAFAQERWRCLVSTPRDRFKEGIPGKSRSLVLLGLPVSQPGMNSQLEQREGAWMLEGEDLRSPSPGWKIISGSPPEQALSEASFQDPCVEMPPGDSDHGTSDLEKSFNLRPVLSPQQRVPVEARPRKCETHTESFKNSEILKPHRAKPYACNECGKAFSYCSSLSQHQKSHTGEKPYECSECGKAFSQSSSLIQHQRIHTGEKPYKCSECGRAFSQNANLTKHQRTHTGEKPYRCSECEKAFSDCSALVQHQRIHTGEKPYECSDCGKAFRHSANLTNHQRTHTGEKPYKCSECGKAFSYCAAFIQHQRIHTGEKPYRCAACGKAFSQSANLTNHQRTHTGEKPYKCSECGKAFSQSTNLIIHQKTHTGEKPYKCNECGKFFSESSALIRHHIIHTGEKPYECNECGKAFNQSSSLSQHQRIHTGVKPYECSECGKAFRCSSAFVRHQRLHAGE

SEQ ID NO: 70818 - protein, 474 aa, Homo sapiens
MAAGLLTAGPRGSTFFSSVTVAFAQERWRCLVSTPRDRFKEGIPGKSRSLVLLGLPVSQPGMNSQLEQREGAWMLEGEDLRSPSPGWKIISGSPPEQALSEASFQDPCVEMPPGDSDHGTSDLEKSFNLRPVLSPQQRVPVEARPRKCETHTESFKNSEILKPHRAKPYACNECGKAFSYCSSLSQHQKSHTGEKPYECSECGKAFSQSSSLIQHQRIHTGEKPYKCSECGRAFSQNANLTKHQRTHTGEKPYRCSECEKAFSDCSALVQHQRIHTGEKPYECSDCGKAFRHSANLTNHQRTHTGEKPYKCSECGKAFSYCAAFIQHQRIHTGEKPYRCAACGKAFSQSANLTNHQRTHTGEKPYKCSECGKAFSQSTNLIIHQKTHTGEKPYKCNECGKFFSESSALIRHHIIHTGEKPYECNECGKAFNQSSSLSQHQRIHTGVKPYECSECGKAFRCSSAFVRHQRLHAGE

SEQ ID NO: 70819 - protein, 575 aa, Homo sapiens
MDPEDEGVAGVMSVGPPAARLQEPVTFRDVAVDFTQEEWGQLDPTQRILYRDVMLETFGHLLSIGPELPKPEVISQLEQGTELWVAERGTTQGCHPAWEPRSESQASRKEEGLPEEEPSHVTGREGFPTDAPYPTTLGKDRECQSQSLALKEQNNLKQLEFGLKEAPVQDQGYKTLRLRENCVLSSSPNPFPEISRGEYLYTYDSQITDSEHNSSLVSQQTGSPGKQPGENSDCHRDSSQAIPITELTKSQVQDKPYKCTDCGKSFNHNAHLTVHKRIHTGERPYMCKECGKAFSQNSSLVQHERIHTGDKPYKCAECGKSFCHSTHLTVHRRIHTGEKPYECQDCGRAFNQNSSLGRHKRTHTGEKPYTCSVCGKSFSRTTCLFLHLRTHTEERPYECNHCGKGFRHSSSLAQHQRKHAGEKPFECRQRLIFEQTPALTKHEWTEALGCDPPLSQDERTHRSDRPFKCNQCGKCFIQSSHLIRHQITHTREEQPHGRSRRREQSSSRNSHLVQHQHPNSRKSSAGGAKAGQPESRALALFDIQKIMQEKNPVHVIGVEEPSVGASMLFDIREST

SEQ ID NO: 70820 - protein, 172 aa, Homo sapiens
MDPEDEGVAGVMSVGPPAARLQVTITTITTAAGSGQASPAQTDPFTSRRDESGTAVNALDTWGNSDAGRGVVTVLAGQRGGRDSNQAPGPRMRMLHAALSSPAPRSPCPGAWAQPLGGNDGSPRTECDESDHQGRPLRDCGRTAVQGGQCLQGHLAIRAPLSRQSGCGLCSP

SEQ ID NO: 70821 - protein, 290 aa, Homo sapiens
MCKECGKAFSQNSSLVQHERIHTGDKPYKCAECGKSFCHSTHLTVHRRIHTGEKPYECQDCGRAFNQNSSLGRHKRTHTGEKPYTCSVCGKSFSRTTCLFLHLRTHTEERPYECNHCGKGFRHSSSLAQHQRKHAGEKPFECRQRLIFEQTPALTKHEWTEALGCDPPLSQDERTHRSDRPFKCNQCGKCFIQSSHLIRHQITHTREEQPHGRSRRREQSSSRNSHLVQHQHPNSRKSSAGGAKAGQPESRALALFDIQKIMQEKNPVHVIGVEEPSVGASMLFDIREST

SEQ ID NO: 70822 - protein, 273 aa, Homo sapiens
MSPKRDGLGTGDGLHSQVLQEQVSTGDNLHECDSQGPSKDTLVREGKTYKCKECGSVFNKNSLLVRHQQIHTGVKPYECQECGKAFPEKVDFVRPMRIHTGEKPCKCVECGKVFNRRSHLLCYRQIHTGEKPYECSECGKTFSYHSVFIQHRVTHTGEKLFGCKECGKTFYYNSSLTRHMKIHTGEKPCKCSECGKTFTYRSVFFRHSMTHTAGKPYECKECGKGFYYSYSLTRHTRSHTGEKPYECLEHRKDFGYHSAFAQQSKIHSGGKNL

SEQ ID NO: 70823 - protein, 273 aa, Homo sapiens; identical to SEQ ID NO: 70822

SEQ ID NO: 70824 - protein, 1209 aa, Homo sapiens
MECYYIVISSTHLSNGHFRNIKGVFRGPLSKNGNKTLDYAEKENTIAKALEDLKANFYCELCDKQYYKHQEFDNHINSYDHAHKQRLKELKQREFARNVASKSRKDERKQEKALQRLHKLAELRKETVCAPGSGPMFKSTTVTVRENCNEISQRVVVDSVNNQQDFKYTLIHSEENTKDATTVAEDPESANNYTAKNNQVGDQAQGIHRHKIGFSFAFPKKASVKLESSAAAFSEYSDDASVGKGFSRKSRFVPSACHLQQSSPTDVLLSSEEKTNSFHPPEAMCRDKETVQTQEIKEVSSEKDALLLPSFCKFQLQLSSDADNCQNSVPLADQIPLESVVINEDIPVSGNSFELLGNKSTVLDMSNDCISVQATTEENVKHNEASTTEVENKNGPETLAPSNTEEVNITIHKKTNFCKRQCEPFVPVLNKHRSTVLQWPSEMLVYTTTKPSISYSCNPLCFDFKSTKVNNNLDKNKPDLKDLCSQQKQEDICMGPLSDYKDVSTEGLTDYEIGSSKNKCSQVTPLLADDILSSSCDSGKNENTGQRYKNISCKIRETEKYNFTKSQIKQDTLDEKYNKIRLKETHEYWFHKSRRKKKRKKLCQHHHMEKTKESETRCKMEAENSYTENAGKYLLEPISEKQYLAAEQLLDSHQLLDKRPKSESISLSDNEEMCKTWNTEYNTYDTISSKNHCKKNTILLNGQSNATMIHSGKHNLTYSRTYCCWKTKMSSCSQDHRSLVLQNDMKHMSQNQAVKRGYNSVMNESERFYRKRRQHSHSYSSDESLNRQNHLPEEFLRPPSTSVAPCKPKKKRRRKRGRFHPGFETLELKENTDYPVKDNSSLNPLDRLISEDKKEKMKPQEVAKIERNSEQTNQLRNKLSFHPNNLLPSETNGETEHLEMETTSGELSDVSNDPTTSVCVASAPTKEAIDNTLLEHKERSENINLNEKQIPFQVPNIERNFRQSQPKSYLCHYELAEALPQGKMNETPTEWLRYNSGILNTQPPLPFKEAHVSGHTFVTAEQILAPLALPEQALLIPLENHDKFKNVPCEVYQHILQPNMLANKVKFTFPPAALPPPSTPLQPLPLQQSLCSTSVTTIHHTVLQQHAAAAAAAAAAAAAGTFKVLQPHQQFLSQIPALTRTSLPQLSVGPVGPRLCPGNQPTFVAPPQMPIIPASVLHPSHLAFPSLPHALFPSLLSPHPTVIPLQPLF

SEQ ID NO: 70825 - protein, 69 aa, Homo sapiens
MPANEDAPQPGEHGSACEVSVSFEDVTVDFSREEWQQLDSTQRRLYQDVMLENYSHLLSVGKDNHPVKL

SEQ ID NO: 70826 - protein, 661 aa, Homo sapiens
MPANEDAPQPGEHGSACEVSVSFEDVTVDFSREEWQQLDSTQRRLYQDVMLENYSHLLSVGFEVPKPEVIFKLEQGEGPWTLEGEAPHQSCSDGKFGIKPSQRRISGKSTFHSEMEGEDTRDDSLYSILEELWQDAEQIKRCQEKHNKLLSRTTFLNKKILNTEWDYEYKDFGKFVHPSPNLILSQKRPHKRDSFGKSFKHNLDLHIHNKSNAAKNLDKTIGHGQVFTQNSSYSHHENTHTGVKFCERNQCGKVLSLKHSLSQNVKFPIGEKANTCTEFGKIFTQRSHFFAPQKIHTVEKPHELSKCVNVFTQKPLLSIYLRVHRDEKLYICTKCGKAFIQNSELIMHEKTHTREKPYKCNECGKSFFQVSSLLRHQTTHTGEKLFECSECGKGFSLNSALNIHQKIHTGERHHKCSECGKAFTQKSTLRMHQRIHTGERSYICTQCGQAFIQKAHLIAHQRIHTGEKPYECSDCGKSFPSKSQLQMHKRIHTGEKPYICTECGKAFTNRSNLNTHQKSHTGEKSYICAECGKAFTDRSNFNKHQTIHTGEKPYVCADCGRAFIQKSELITHQRIHTTEKPYKCPDCEKSFSKKPHLKVHQRIHTGEKPYICAECGKAFTDRSNFNKHQTIHTGDKPYKCSDCGKGFTQKSVLSMHRNIHT

SEQ ID NO: 70827 - protein, 103 aa, Homo sapiens
MPANEDAPQPGEHGSACEVSVSFEDVTVDFSREEWQQLDSTQRRLYQDVMLENYSHLLSVGFEVPKPEVIFKLEQGEGPWTLEGEAPHQSCSGISTYFVTSTV

SEQ ID NO: 70828 - protein, 661 aa, Homo sapiens; identical to SEQ ID NO: 70826

SEQ ID NO: 70829 - protein, 122 aa, Homo sapiens
MPANEDAPQPGEHGSACEVSVSFEDVTVDFSREEWQQLDSTQRRLYQDVMLENYSHLLSVGFEVPKPEVIFKLEQGEGPWTLEGEAPHQSCSDGKFGIKPSQRRISGKSTFHSEMEGEDTLC

SEQ ID NO: 70830 - protein, 516 aa, Homo sapiens
MHGRKDDAQKQPVKNQLGLNPQSHLPELQLFQAEGKIYKYDHMEKSVNSSSLVSPPQRISSTVKTHISHTYECNFVDSLFTQKEKANIGTEHYKCSERGKAFHQGLHFTIHQIIHTKETQFKCDICGKIFNKKSNLASHQRIHTGEKPYKCNECGKVFHNMSHLAQHRRIHTGEKPYKCNECGKVFNQISHLAQHQRIHTGEKPYKCNECGKVFHQISHLAQHRTIHTGEKPYECNKCGKVFSRNSYLVQHLIIHTGEKPYRCNVCGKVFHHISHLAQHQRIHTGEKPYKCNECGKVFSHKSSLVNHWRIHTGEKPYKCNECGKVFSHKSSLVNHWRIHTGEKPYKCNECGKVFSRNSYLAQHLIIHAGEKPYKCDECDKAFSQNSHLVQHHRIHTGEKPYKCDECGKVFSQNSYLAYHWRIHTGEKAYKCNECGKVFGLNSSLAHHRKIHTGEKPFKCNECGKAFSMRSSLTNHHAIHTGEKHFKCNECGKLFRDNSYLVRHQRFHAGKKSNTCN

SEQ ID NO: 70831 - protein, 488 aa, Homo sapiens
MHGRKDDAQKQPVKNQLGLNPQSHLPELQLFQAEGKIYKYDHMEKSVNSSSLVSPPQRISSTVKTHISHTYECNFVDSLFTQKEKANIGTEHYKCSERGKAFHQGLHFTIHQIIHTKETQFKCDICGKIFNKKSNLASHQRIHTGEKPYKCNECGKVFHNMSHLAQHRRIHTGEKPYKCNECGKVFNQISHLAQHQRIHTGEKPYKCNECGKVFHQISHLAQHRTIHTGEKPYECNKCGKVFSRNSYLVQHLIIHTGEKPYRCNVCGKVFSHKSSLVNHWRIHTGEKPYKCNECGKVFSHKSSLVNHWRIHTGEKPYKCNECGKVFSRNSYLAQHLIIHAGEKPYKCDECDKAFSQNSHLVQHHRIHTGEKPYKCDECGKVFSQNSYLAYHWRIHTGEKAYKCNECGKVFGLNSSLAHHRKIHTGEKPFKCNECGKAFSMRSSLTNHHAIHTGEKHFKCNECGKLFRDNSYLVRHQRFHAGKKSNTCN

SEQ ID NO: 70832 - protein, 488 aa, Homo sapiens; identical to SEQ ID NO: 70831

SEQ ID NO: 70833 - protein, 516 aa, Homo sapiens; identical to SEQ ID NO: 70830

SEQ ID NO: 70834 - protein, 516 aa, Homo sapiens; identical to SEQ ID NO: 70830

SEQ ID NO: 70835 - protein, 516 aa, Homo sapiens; identical to SEQ ID NO: 70830

SEQ ID NO: 70836 - protein, 516 aa, Homo sapiens; identical to SEQ ID NO: 70830

SEQ ID NO: 70837 - protein, 1677 aa, Homo sapiens
MEVPEPTCPAPPARDQPAPTPGPPGAPGGQASPHLTLGPVLLPPEQGLAPPTVFLKALPIPLYHTVPPGGLQPRAPLVTGSLDGGNVPFILSPVLQPEGPGPTQVGKPAAPTLTVNIVGTLPVLSPGLGPTLGSPGKVRNAGKYLCPHCGRDCLKPSVLEKHIRSHTGERPFPCATCGIAFKTQSNLYKHRRTQTHLNNSRLSSESEGAGGGLLEEGDKAGEPPRPEGRGESRCQGMHEGASERPLSPGAHVPLLAKNLDVRTEAAPCPGSAFADREAPWDSAPMASPGLPAASTQPWRKLPEQKSPTAGKPCALQRQQATAAEKPWDAKAPEGRLRKCESTDSGYLSRSDSAEQPHAPCSPLHSLSEHSAESEGEGGPGPGPGVAGAEPGAREAGLELEKKRLEERIAQLISHNQAVVDDAQLDNVRPRKTGLSKQGSIDLPTPYTYKDSFHFDIRALEPGRRRAPGPVRSTWTPPDKSRPLFFHSVPTQLSTTVECVPVTRSNSLPFVEGSRTWLEPREPRDPWSRTQKPLSPRPGPARLGCRSGLSSTDVPSGHPRALVRQAAVEDLPGTPIGDALVPAEDTDAKRTAAREAMAGKGRAGGRKCGQRRLKMFSQEKWQVYGDETFKRIYQKMKASPHGGKKAREVGMGSGAELGFPLQKEAAGSSGTVPTQDRRTPVHEDISAGATPEPWGNPPALEASLVTEPTKHGETVARRGDSDRPRVEEAVSSPALGGRDSPCSGSRSPLVSPNGRLELGWQMPPAPGPLKGGDVEAPRPVWPDPKLEGGARGVGDVQETCLWAQTVLRWPSRGSGEDKLPSERKKLKVEDLHSWKQPEPVSAETPGGPTQPASLSSQKQDADPGEVPGGSKESARQVGEPLESSGASLAAASVALKRVGPRDKATPLHPAAPAPAEHPSLATPPQAPRVLSALADNAFSPKYLLRLPQAETPLPLPIPWGPRHSQDSLCSSGWPEERASFVGSGLGTPLSPSPASGPSPGEADSILEDPSCSRPQDGRKGAQLGGDKGDRMATSRPAARELPISAPGAPREATSSPPTPTCEAHLVQDMEGDSHRIHRLCMGSTLARARLSGDVLNPWVPNWELGEPPGNAPEDPSSGPLVGPDPCSPLQPGSFLTALTRPQGVPPGWPELALSSHSGTSRSHSTRSPHSTQNPFPSLKAEPRLTWCCLSRSVPLPAEQKAKAASVYLAVHFPGSSLRDEGPNGPPGSNGGWTWTSPGEGGPAQMSKFSYPTVPGVMPQHQVSEPEWKKGLPWRAKMSRGNSKQRKLKINPKRYKGNFLQSCVQLRASRLRTPTWVRRRSRHPPALEGLKPCRTPGQTSSEIAGLNLQEEPSCATSESPPCCGKEEKKEGDCRQTLGTLSLGTSSRIVREMDKRTVKDISPSAGEHGDCTTHSTAATSGLSLQSDTCLAVVNDVPLPPGKGLDLGLLETQLLASQDSVSTDPKPYIFSDAQRPSSFGSKGTFPHHDIATSVAAVCISLPVRTDHIAQEIHSAESRDHSQTAGRTLTSSSPDSKVTEEGRAQTLLPGRPSSGQRISDSVPLESTEKTHLEIPASGPSSASSHHKEGRHKTFFPSRGQYGCGEMTVPCPSLGSDGRKRQVSGLITRKDSVVPSKPEQPIEIPEAPSKSLKKRSLEGMRKQTRVEFSDTSSDDEDRLVIEI

SEQ ID NO: 70838 - protein, 87 aa, Homo sapiens
MGPLTFRDVAIEFSLKEWQCLDTAQRNLYRNVMLENYRNLVFLGITVSKPDLITCLEQGKEAWSMKRHEIMVAKPTESYSVTQSGMQ

SEQ ID NO: 70839 - protein, 595 aa, Homo sapiens
MGPLTFRDVAIEFSLKEWQCLDTAQRNLYRNVMLENYRNLVFLGITVSKPDLITCLEQGKEAWSMKRHEIMVAKPTVMCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGEKPYKCEECGKAFKQSSNLTTHKIIHTGEKPYKCKKCGKAFNQSAHLTTHEVIHTGEKPYKCEKCGKAFNHFSHLTTHKIIHTGEKPYKCKECGKAFKHSSTLTKHKIIHTGEKPYKCKECEKAFNQSSKLTEHKKIHTGEKPYECEKCGKAFNQSSNLTRHKKSHTEEKPYKCEECGKGFKWPSTLTIHKIIHTGEKPYKCEECGKAFNQSSKLTKHKKIHTGEKPYTCEECGKAFNQSSNLTKHKRIHTGEKPYKCEECDKAFKWSSVLTKHKIIHTGEKLQI

SEQ ID NO: 70840 - protein, 562 aa, Homo sapiens
MGPLTFRDVAIEFSLKEWQCLDTAQRNLYRNVMLENYRNLVFLVMCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGEKPYKCEECGKAFKQSSNLTTHKIIHTGEKPYKCKKCGKAFNQSAHLTTHEVIHTGEKPYKCEKCGKAFNHFSHLTTHKIIHTGEKPYKCKECGKAFKHSSTLTKHKIIHTGEKPYKCKECEKAFNQSSKLTEHKKIHTGEKPYECEKCGKAFNQSSNLTRHKKSHTEEKPYKCEECGKGFKWPSTLTIHKIIHTGEKPYKCEECGKAFNQSSKLTKHKKIHTGEKPYTCEECGKAFNQSSNLTKHKRIHTGEKPYKCEECDKAFKWSSVLTKHKIIHTGEKLQI

SEQ ID NO: 70841 - protein, 470 aa, Homo sapiens
MHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGEKPYKCEECGKAFKQSSNLTTHKIIHTGEKPYKCKKCGKAFNQSAHLTTHEVIHTGEKPYKCEKCGKAFNHFSHLTTHKIIHTGEKPYKCKECGKAFKHSSTLTKHKIIHTGEKPYKCKECEKAFNQSSKLTEHKKIHTGEKPYECEKCGKAFNQSSNLTRHKKSHTEEKPYKCEECGKGFKWPSTLTIHKIIHTGEKPYKCEECGKAFNQSSKLTKHKKIHTGEKPYTCEECGKAFNQSSNLTKHKRIHTGEKPYKCEECDKAFKWSSVLTKHKIIHTGEKLQI

SEQ ID NO: 70842 - protein, 601 aa, Homo sapiens
MGPLEFRDVAIEFSLEEWHCLDTAQQNLYRDVMLENYRHLVFLGIVVTKPDLITCLEQGKKPFTVKRHEMIAKSPVMCFHFAQDLCPEQSLKDSFQKVIVTRYEKREYGNLELKKGCESVDEGKVHKRGYNGLNQCLTATQSKVFQCDTYVKVSHIFSNSNRHKIRDTGKKPFKCIECGKAFNQSSTLATHKKIHTGEITCKCEECGKAFNRSSHLTSHKRIHTGEKRYKCEDCGKELKYSSTLTAHKRIHTGEKRYKCEDCGKELKYSSTLTAHKRIHTGEKPYKCDKCGRAFISSSILYVHKISHTEEKPYKCEECGKAFKLSSILSTHKRIHTGEKPYKCEECGKAFRRSLVLRTHKRIHTGEKPYKCDKCGKAFISSSLLYKHKISHSEKKPYKCEECGKAFKRSSTLTIHKISHTEEKPYKCQECDKVFKRSSALSTHKIIHSGEKPYKCEECGKAFKRSSNLTTHKISHTEEKLYKCQECDKAFKYSSALSTHKIIHSGENPYKCEECGKAFKRSSVLSKHKIIHTGAKPYKCEECGKAFKRSSQLTSHKISHTGEKPYKCEECGKAFNLSSDLNTHKRIHIGQKAYIVKNMANL

SEQ ID NO: 70843 - protein, 122 aa, Homo sapiens
MRKHIKERELSLMEQIKEFILERNTMNVPTVGKPFSGRHSLLSIREFTLGRSPMNVMNVGEPSEKKPTCMIIREFILEKNPILVRNVGKTSAEVQLLLNTREFILEINSRNREIKEFAECFS

SEQ ID NO: 70844 - protein, 636 aa, Homo sapiens
MAPRPPTAAPQESVTFKDVSVDFTQEEWYHVDPAQRSLYRDVMLENYSHLVSLGYQVSKPEVIFKLEQGEEPWISEGEIQRPFYPDWKTRPEVKSSHLQQDVSEVSHCTHDLLHATLEDSWDVSSQLDRQQENWKRHLGSEASTQKKIITPQENFEQNKFGENSRLNTNLVTQLNIPARIRPSECETLGSNLGHNADLLNENNILAKKKPYKCDKCRKAFIHRSSLTKHEKTHKGEGAFPNGTDQGIYPGKKHHECTDCGKTFLWKTQLTEHQRIHTGEKPFECNVCGKAFRHSSSLGQHENAHTGEKPYQCSLCGKAFQRSSSLVQHQRIHTGEKPYRCNLCGRSFRHGTSLTQHEVTHSGEKPFQCKECGKAFSRCSSLVQHERTHTGEKPFECSICGRAFGQSPSLYKHMRIHKRGKPYQSSNYSIDFKHSTSLTQDESTLTEVKSYHCNDCGEDFSHITDFTDHQRIHTAENPYDCEQAFSQQAISHPGEKPYQCNVCGKAFKRSTSFIEHHRIHTGEKPYECNECGEAFSRRSSLTQHERTHTGEKPYECIDCGKAFSQSSSLIQHERTHTGEKPYECNECGRAFRKKTNLHDHQRIHTGEKPYSCKECGKNFSRSSALTKHQRIHTRNKL

SEQ ID NO: 70845 - protein, 1191 aa, Homo sapiens
MPGTPGSLEMGLLTFRDVAIEFSPEEWQCLDTAQQNLYRNVMLENYRNLAFLGIALSKPDLITYLEQGKEPWNMKQHEMVDEPTGICPHFPQDFWPEQSMEDSFQKVLLRKYEKCGHENLQLRKGCKSVDECKVHKEGYNKLNQCLTTAQSKVFQCGKYLKVFYKFLNSNRHTIRHTGKKCFKCKKCVKSFCIRLHKTQHKCVYITEKSCKCKECEKTFHWSSTLTNHKEIHTEDKPYKCEECGKAFKQLSTLTTHKIICAKEKIYKCEECGKAFLWSSTLTRHKRIHTGEKPYKCEECGKAFSHSSTLAKHKRIHTGEKPYKCEECGKAFSRSSTLAKHKRIHTGEKPYKCKECGKAFSNSSTLANHKITHTEEKPYKCKECDKAFKRLSTLTKHKIIHAGEKLYKCEECGKAFNRSSNLTIHKFIHTGEKPYKCEECGKAFNWSSSLTKHKRFHTREKPFKCKECGKAFIWSSTLTRHKRIHTGEKPYKCEECGKAFRQSSTLTKHKIIHTGEKPYKFEECGKAFRQSLTLNKHKIIHSREKPYKCKECGKAFKQFSTLTTHKIIHAGKKLYKCEECGKAFNHSSSLSTHKIIHTGEKSYKCEECGKAFLWSSTLRRHKRIHTGEKPYKCEECGKAFSHSSALAKHKRIHTGEKPYKCKECGKAFSNSSTLANHKITHTEEKPYKCKECDKTFKRLSTLTKHKIIHAGEKLYKCEECGKAFNRSSNLTIHKFIHTGEKPYKCEECGKAFNWSSSLTKHKRIHTREKPFKCKECGKAFIWSSTLTRHKRIHTGEKPYKCEECGKAFSRSSTLTKHKTIHTGEKPYKCKECGKAFKHSSALAKHKIIHAGEKLYKCEECGKAFNQSSNLTTHKIIHTKEKPSKSEECDKAFIWSSTLTEHKRIHTREKTYKCEECGKAFSQPSHLTTHKRMHTGEKPYKCEECGKAFSQSSTLTTHKIIHTGEKPYKCEECGKAFRKSSTLTEHKIIHTGEKPYKCEECGKAFSQSSTLTRHTRMHTGEKPYKCEECGKAFNRSSKLTTHKIIHTGEKPYKCEECGKAFISSSTLNGHKRIHTREKPYKCEECGKAFSQSSTLTRHKRLHTGEKPYKCGECGKAFKESSALTKHKIIHTGEKPYKCEKCGKAFNQSSILTNHKKIHTITPVIPLLWEAEAGGSRGQEMETILANTVKPLLY

SEQ ID NO: 70846 - protein, 1159 aa, Homo sapiens
MPGTPGSLEMGLLTFRDVAIEFSPEEWQCLDTAQQNLYRNVMLENYRNLAFLGICPHFPQDFWPEQSMEDSFQKVLLRKYEKCGHENLQLRKGCKSVDECKVHKEGYNKLNQCLTTAQSKVFQCGKYLKVFYKFLNSNRHTIRHTGKKCFKCKKCVKSFCIRLHKTQHKCVYITEKSCKCKECEKTFHWSSTLTNHKEIHTEDKPYKCEECGKAFKQLSTLTTHKIICAKEKIYKCEECGKAFLWSSTLTRHKRIHTGEKPYKCEECGKAFSHSSTLAKHKRIHTGEKPYKCEECGKAFSRSSTLAKHKRIHTGEKPYKCKECGKAFSNSSTLANHKITHTEEKPYKCKECDKAFKRLSTLTKHKIIHAGEKLYKCEECGKAFNRSSNLTIHKFIHTGEKPYKCEECGKAFNWSSSLTKHKRFHTREKPFKCKECGKAFIWSSTLTRHKRIHTGEKPYKCEECGKAFRQSSTLTKHKIIHTGEKPYKFEECGKAFRQSLTLNKHKIIHSREKPYKCKECGKAFKQFSTLTTHKIIHAGKKLYKCEECGKAFNHSSSLSTHKIIHTGEKSYKCEECGKAFLWSSTLRRHKRIHTGEKPYKCEECGKAFSHSSALAKHKRIHTGEKPYKCKECGKAFSNSSTLANHKITHTEEKPYKCKECDKTFKRLSTLTKHKIIHAGEKLYKCEECGKAFNRSSNLTIHKFIHTGEKPYKCEECGKAFNWSSSLTKHKRIHTREKPFKCKECGKAFIWSSTLTRHKRIHTGEKPYKCEECGKAFSRSSTLTKHKTIHTGEKPYKCKECGKAFKHSSALAKHKIIHAGEKLYKCEECGKAFNQSSNLTTHKIIHTKEKPSKSEECDKAFIWSSTLTEHKRIHTREKTYKCEECGKAFSQPSHLTTHKRMHTGEKPYKCEECGKAFSQSSTLTTHKIIHTGEKPYKCEECGKAFRKSSTLTEHKIIHTGEKPYKCEECGKAFSQSSTLTRHTRMHTGEKPYKCEECGKAFNRSSKLTTHKIIHTGEKPYKCEECGKAFISSSTLNGHKRIHTREKPYKCEECGKAFSQSSTLTRHKRLHTGEKPYKCGECGKAFKESSALTKHKIIHTGEKPYKCEKCGKAFNQSSILTNHKKIHTITPVIPLLWEAEAGGSRGQEMETILANTVKPLLY

SEQ ID NO: 70847 - protein, 586 aa, Homo sapiens
MGPLTFRDVKIEFSLEEWQCLDTAQRNLYRDVMLENYRNLVFLGIAVSKPDLITWLEQGKEPWNLKRHEMVDKTPVMCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNWSSTLTKHKIIHTGEKPYKCEECGKAFNRSSNLTKHKIIHTGEKPYKCEECGKAFNRSSTLTKHKRIHTEEKPYKCEECGKAFNQFSILNKHKRIHMEDKPYKCEECGKAFRVFSILKKHKIIHTGEKPYKCEECGKAFNQFSNLTKHKIIHTGEKPYKCDECGKAFNQSSTLTKHKRIHTGEKPYKCEECGKAFKQSSTLTEHKIIHTGEKPYKCEKCGKAFSWSSAFTKHKRNHMEDKPYKCEECGKAFSVFSTLTKHKIIHTREKPYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 70848 - protein, 554 aa, Homo sapiens
MGPLTFRDVKIEFSLEEWQCLDTAQRNLYRDVMLENYRNLVFLVMCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNWSSTLTKHKIIHTGEKPYKCEECGKAFNRSSNLTKHKIIHTGEKPYKCEECGKAFNRSSTLTKHKRIHTEEKPYKCEECGKAFNQFSILNKHKRIHMEDKPYKCEECGKAFRVFSILKKHKIIHTGEKPYKCEECGKAFNQFSNLTKHKIIHTGEKPYKCDECGKAFNQSSTLTKHKRIHTGEKPYKCEECGKAFKQSSTLTEHKIIHTGEKPYKCEKCGKAFSWSSAFTKHKRNHMEDKPYKCEECGKAFSVFSTLTKHKIIHTREKPYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 70849 - protein, 517 aa, Homo sapiens
MVDKTPVMCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNWSSTLTKHKIIHTGEKPYKCEECGKAFNRSSNLTKHKIIHTGEKPYKCEECGKAFNRSSTLTKHKRIHTEEKPYKCEECGKAFNQFSILNKHKRIHMEDKPYKCEECGKAFRVFSILKKHKIIHTGEKPYKCEECGKAFNQFSNLTKHKIIHTGEKPYKCDECGKAFNQSSTLTKHKRIHTGEKPYKCEECGKAFKQSSTLTEHKIIHTGEKPYKCEKCGKAFSWSSAFTKHKRNHMEDKPYKCEECGKAFSVFSTLTKHKIIHTREKPYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 70850 - protein, 620 aa, Homo sapiens
MGPLQFRDVAIEFSLEEWHCLDTAQRNLYRNVMLENYSNLVFLGIVVSKPDLIAHLEQGKKPLTMKRHEMVANPSVICSHFAQDLWPEQNIKDSFQKVILRRYEKRGHGNLQLIKRCESVDECKVHTGGYNGLNQCSTTTQSKVFQCDKYGKVFHKFSNSNRHNIRHTEKKPFKCIECGKAFNQFSTLITHKKIHTGEKPYICEECGKAFKYSSALNTHKRIHTGEKPYKCDKCDKAFIASSTLSKHEIIHTGKKPYKCEECGKAFNQSSTLTKHKKIHTGEKPYKCEECGKAFNQSSTLTKHKKIHTGEKPYVCEECGKAFKYSRILTTHKRIHTGEKPYKCNKCGKAFIASSTLSRHEFIHMGKKHYKCEECGKAFIWSSVLTRHKRVHTGEKPYKCEECGKAFKYSSTLSSHKRSHTGEKPYKCEECGKAFVASSTLSKHEIIHTGKKPYKCEECGKAFNQSSSLTKHKKIHTGEKPYKCEECGKAFNQSSSLTKHKKIHTGEKPYKCEECGKAFNQSSTLIKHKKIHTREKPYKCEECGKAFHLSTHLTTHKILHTGEKPYRCRECGKAFNHSATLSSHKKIHSGEKPYECDKCGKAFISPSSLSRHEIIHTGEKP

SEQ ID NO: 70851 - protein, 592 aa, Homo sapiens
MGPLQFRDVAIEFSLEEWHCLDTAQRNLYRNVMLENYSNLVFLGIVVSKPDLIAHLEQGKKPLTMKRHEMVANPSVICSHFAQDLWPEQNIKDSFQKVILRRYEKRGHGNLQLIKRCESVDECKVHTGGYNGLNQCSTTTQSKVFQCDKYGKVFHKFSNSNRHNIRHTEKKPFKCIECGKAFNQFSTLITHKKIHTGEKPYICEECGKAFKYSSALNTHKRIHTGEKPYKCDKCDKAFIASSTLSKHEIIHTGKKPYKCEECGKAFNQSSTLTKHKKIHTGEKPYKCEECGKAFNQSSTLTKHKKIHTGEKPYVCEECGKAFKYSRILTTHKRIHTGEKPYKCNKCGKAFIASSTLSRHEFIHMGKKHYKCEECGKAFIWSSVLTRHKRVHTGEKPYKCEECGKAFVASSTLSKHEIIHTGKKPYKCEECGKAFNQSSSLTKHKKIHTGEKPYKCEECGKAFNQSSSLTKHKKIHTGEKPYKCEECGKAFNQSSTLIKHKKIHTREKPYKCEECGKAFHLSTHLTTHKILHTGEKPYRCRECGKAFNHSATLSSHKKIHSGEKPYECDKCGKAFISPSSLSRHEIIHTGEKP

SEQ ID NO: 70852 - protein, 60 aa, Homo sapiens
MVANPSVICSHFAQDLWPEQNIKDSFQKVILRRYEKRGHGNLQLIKRCESTPSEKEKKKK

SEQ ID NO: 70853 - protein, 572 aa, Homo sapiens
MPGPLGSLEMGVLTFRDVALEFSLEEWQCLDTAQQNLYRNVMLENYRNLVFVGIAASKPDLITCLEQGKEPWNVKRHEMVTEPPVVYSYFAQDLWPKQGKKNYFQKVILRTYKKCGRENLQLRKYCKSMDECKVHKECYNGLNQCLTTTQNKIFQYDKYVKVFHKFSNSNRHKIGHTGKKSFKCKECEKSFCMLSHLAQHKRIHSGEKPYKCKECGKAYNEASNLSTHKRIHTGKKPYKCEECGKAFNRLSHLTTHKIIHTGKKPYKCEECGKAFNQSANLTTHKRIHTGEKPYKCEECGRAFSQSSTLTAHKIIHAGEKPYKCEECGKAFSQSSTLTTHKIIHTGEKFYKCEECGKAFSRLSHLTTHKRIHSGEKPYKCEECGKAFKQSSTLTTHKRIHAGEKFYKCEVCSKAFSRFSHLTTHKRIHTGEKPYKCEECGKAFNLSSQLTTHKIIHTGEKPYKCEECGKAFNQSSTLSKHKVIHTGEKPYKCEECGKAFNQSSHLTTHKMIHTGEKPYKCEECGKAFNNSSILNRHKMIHTGEKLYKPESCNNACDNIAKISKYKRNCAGEK

SEQ ID NO: 70854 - protein, 1037 aa, Homo sapiens [sequence omitted]

SEQ ID NO: 70855 - protein, 1006 aa, Homo sapiens
MSRRKQSNPRQIKRSLGDMEAREEVQLVGASHMEQKATAPEAPSPPSADVNSPPPLPPPTSPGGPKELEGQEPEPRPTEEEPGSPWSGPDELEPVVQDGQRRIRARLSLATGLSWGPFHGSVQTRASSPRQAEPSPALTLLLVDEACWLRTLPQALTEAEANTEIHRKDDALWCRVTKPVPAGGLLSVLLTAEPHSTPGHPVKKEPAEPTCPAPAHDLQLLPQQAGMASILATAVINKDVFPCKDCGIWYRSERNLQAHLLYYCASRQGTGSPAAAATDEKPKETYPNERVCPFPQCRKSCPSASSLEIHMRSHSGERPFVCLICLSAFTTKANCERHLKVHTDTLSGVCHSCGFISTTRDILYSHLVTNHMVCQPGSKGEIYSPGAGHPATKLPPDSLGSFQQQHTALQGPLASADLGLAPTPSPGLDRKALAEATNGEARAEPLAQNGGSSEPPAAPRSIKVEAVEEPEAAPILGPGEPGPQAPSRTPSPRSPAPARVKAELSSPTPGSSPVPGELGLAGALFLPQYVFGPDAAPPASEILAKMSELVHSRLQQGAGAGAGGAQTGLFPGAPKGATCFECEITFSNVNNYYVHKRLYCSGRRAPEDAPAARRPKAPPGPARAPPGQPAEPDAPRSSPGPGAREEGAGGAATPEDGAGGRGSEGSQSPGSSVDDAEDDPSRTLCEACNIRFSRHETYTVHKRYYCASRHDPPPRRPAAPPGPPGPAAPPAPSPAAPVRTRRRRKLYELHAAGAPPPPPPGHAPAPESPRPGSGSGSGPGLAPARSPGPAADGPIDLSKKPRRPLPGAPAPALADYHECTACRVSFHSLEAYLAHKKYSCPAAPPPGALGLPAAACPYCPPNGPVRGDLLEHFRLAHGLLLGAPLAGPGVEARTPADRGPSPAPAPAASPQPGSRGPRDGLGPEPQEPPPGPPPSPAAAPEAVPPPPAPPSYSDKGVQTPSKGTPAPLPNGNHRYCRLCNIKFSSLSTFIAHKKYYCSSHAAEHVK

SEQ ID NO: 70856 - protein, 882 aa, Homo sapiens [sequence omitted]

SEQ ID NO: 70857 - protein, 1151 aa, Homo sapiens
MSRRKQSKPRQIKRPLEDAIEDEEEECPSEETDIISKGDFPLEESFSTEFGPENLSCEEVEYFCNKGDDEGIQETAESDGDTQSEKPGQPGVETDDWDGPGELEVFQKDGERKIQSRQQLPVGTTWGPFPGKMDLNNNSLKTKAQVPMVLTAGPKWLLDVTWQGVEDNKNNCIVYSKGGQLWCTTTKAISEGEELIAFVVDFDSRLQAASQMTLTEGMYPARLLDSIQLLPQQAAMASILPTAIVNKDIFPCKSCGIWYRSERNLQAHLMYYCSGRQREAAPVSEENEDSAHQISSLCPFPQCTKSFSNARALEMHLNSHSGVKMEEFLPPGASLKCTVCSYTADSVINFHQHLFSHLTQAAFRCNHCHFGFQTQRELLQHQELHVPSGKLPRESDMEHSPSATEDSLQPATDLLTRSELPQSQKAMQTKDASSDTELDKCEKKTQLFLTNQRPEIQPTTNKQSFSYTKIKSEPSSPRLASSPVQPNIGPSFPVGPFLSQFSFPQDITMVPQASEILAKMSELVHRRLRHGSSSYPPVIYSPLMPKGATCFECNITFNNLDNYLVHKKHYCSSRWQQMAKSPEFPSVSEKMPEALSPNTGQTSINLLNPAAHSADPENPLLQTSCINSSTVLDLIGPNGKGHDKDFSTQTKKLSTSSNNDDKINGKPVDVKNPSVPLVDGESDPNKTTCEACNITFSRHETYMVHKQYYCATRHDPPLKRSASNKVPAMQRTMRTRKRRKMYEMCLPEQEQRPPLVQQRFLDVANLNNPCTSTQEPTEGLGECYHPRCDIFPGIVSKHLETSLTINKCVPVSKCDTTHSSVSCLEMDVPIDLSKKCLSQSERTTTSPKRLLDYHECTVCKISFNKVENYLAHKQNFCPVTAHQRNDLGQLDGKVFPNPESERNSPDVSYERSIIKCEKNGNLKQPSPNGNLFSSHLATLQGLKVFSEAAQLIATKEENRHLFLPQCLYPGAIKKAKGADQLSPYYGIKPSDYISGSLVIHNTDIEQSRNAENESPKGQASSNGCAALKKDSLPLLPKNRGMVIVNGGLKQDERPAANPQQENISQNPQHEDDHKSPSWISENPLAANENVSPGIPSAEEQLSSIAKGVNGSSQAPTSGKYCRLCDIQFNNLSNFITHKKFYCSSHAAEHVK

SEQ ID NO: 70858 - protein, 1019 aa, Homo sapiens
MDLNNNSLKTKAQVPMVLTAGPKWLLDVTWQGVEDNKNNCIVYSKGGQLWCTTTKAISEGEELIAFVVDFDSRLQAASQMTLTEGMYPARLLDSIQLLPQQAAMASILPTAIVNKDIFPCKSCGIWYRSERNLQAHLMYYCSGRQREAAPVSEENEDSAHQISSLCPFPQCTKSFSNARALEMHLNSHSGVKMEEFLPPGASLKCTVCSYTADSVINFHQHLFSHLTQAAFRCNHCHFGFQTQRELLQHQELHVPSGKLPRESDMEHSPSATEDSLQPATDLLTRSELPQSQKAMQTKDASSDTELDKCEKKTQLFLTNQRPEIQPTTNKQSFSYTKIKSEPSSPRLASSPVQPNIGPSFPVGPFLSQFSFPQDITMVPQASEILAKMSELVHRRLRHGSSSYPPVIYSPLMPKGATCFECNITFNNLDNYLVHKKHYCSSRWQQMAKSPEFPSVSEKMPEALSPNTGQTSINLLNPAAHSADPENPLLQTSCINSSTVLDLIGPNGKGHDKDFSTQTKKLSTSSNNDDKINGKPVDVKNPSVPLVDGESDPNKTTCEACNITFSRHETYMVHKQYYCATRHDPPLKRSASNKVPAMQRTMRTRKRRKMYEMCLPEQEQRPPLVQQRFLDVANLNNPCTSTQEPTEGLGECYHPRCDIFPGIVSKHLETSLTINKCVPVSKCDTTHSSVSCLEMDVPIDLSKKCLSQSERTTTSPKRLLDYHECTVCKISFNKVENYLAHKQNFCPVTAHQRNDLGQLDGKVFPNPESERNSPDVSYERSIIKCEKNGNLKQPSPNGNLFSSHLATLQGLKVFSEAAQLIATKEENRHLFLPQCLYPGAIKKAKGADQLSPYYGIKPSDYISGSLVIHNTDIEQSRNAENESPKGQASSNGCAALKKDSLPLLPKNRGMVIVNGGLKQDERPAANPQQENISQNPQHEDDHKSPSWISENPLAANENVSPGIPSAEEQLSSIAKGVNGSSQAPTSGKYCRLCDIQFNNLSNFITHKKFYCSSHAAEHVK

SEQ ID NO: 70859 - protein, 1019 aa, Homo sapiens; identical to SEQ ID NO: 70858

SEQ ID NO: 70860 - protein, 805 aa, Homo sapiens
MDEDGLELQQEPNSFFDATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLTGDSIHVSDVGHVGHVGHVEHVVHDSVVEAEIVTDPLTTDVVSEEVLVADCASEAVIDANGIPVDQQDDDKGNCEDYLMISLDDAGKIEHDGSSGMTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 70861 - protein, 755 aa, Homo sapiens
MDEDGLELQQEPNSFFDATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLTGDSIHVSDVGHVGHVGHVEHVVHDSVVEAEIVTDPLTTDVVSEEVLVADCASEAVIDANGIPVDQQDDDKGNCEDYLMISCGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 70862 - protein, 805 aa, Homo sapiens; identical to SEQ ID NO: 70860

SEQ ID NO: 70863 - protein, 805 aa, Homo sapiens; identical to SEQ ID NO: 70860

SEQ ID NO: 70864 - protein, 32 aa, Homo sapiens
MDEDGLELQQEPNSFFDATGADGTHMDGDQIV

SEQ ID NO: 70865 - protein, 135 aa, Homo sapiens
MDEDGLELQQEPNSFFDATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLT

SEQ ID NO: 70866 - protein, 527 aa, Homo sapiens
MDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 70867 - protein, 262 aa, Homo sapiens
MDEDGLELQQEPNSFFDATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLTGDSIHVSDVGHVGHVGHVEHVVHDSVVEAEIVTDPLTTDVVSEEVLVADCASEAVIDANGIPVDQQDDDKGNCEDYLMISCNNSDGIENRNGTASALLHIDESAGLGRLAKQKPKKRRRPDSRQYQT

SEQ ID NO: 70868 - protein, 576 aa, Homo sapiens
MTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 70869 - protein, 844 aa, Homo sapiens
MDEDGLELQQEPNSFFDATDRVSFCHPGWSTVAPSGSTATSASQAQVICSASRVTGATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLTGDSIHVSDVGHVGHVGHVEHVVHDSVVEAEIVTDPLTTDVVSEEVLVADCASEAVIDANGIPVDQQDDDKGNCEDYLMISLDDAGKIEHDGSSGMTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 70870 - protein, 173 aa, Homo sapiens
GGCSQYLLLFVDDAGKIEHDGSSGMTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTA

SEQ ID NO: 70871 - protein, 801 aa, Homo sapiens
MDEDEFELQPQEPNSFFDGIGADATHMDGDQIVVEIQEAVFVSNIVDSDITVHNFVPDDPDSVVIQDVVEDVVIEEDVQCSDILEEADVSENVIIPEQVLDSDVTEEVSLPHCTVPDDVLASDITSTSMSMPEHVLTSESMHVCDIGHVEHMVHDSVVEAEIITDPLTSDIVSEEVLVADCAPEAVIDASGISVDQQDNDKASCEDYLMISLDDAGKIEHDGSTGVTIDAESEMDPCKVDSTCPEVIKVYIFKADPGEDDLGGTVDIVESEPENDHGVELLDQNSSIRVPREKMVYMTVNDSQQEDEDLNVAEIADEVYMEVIVGEEDAAVAAAAAAVHEQQIDEDEMKTFVPIAWAAAYGNNSDGIENRNGTASALLHIDESAGLGRLAKQKPKKKRRPDSRQYQTAIIIGPDGHPLTVYPCMICGKKFKSRGFLKRHMKNHPEHLAKKKYHCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELRKHMRIHTGEKPYQCQYCEYRSADSSNLKTHIKTKHSKEMPFKCDICLLTFSDTKEVQQHTLVHQESKTHQCLHCDHKSSNSSDLKRHVISVHTKDYPHKCEMCEKGFHRPSELKKHVAVHKGKKMHQCRHCDFKIADPFVLSRHILSVHTKDLPFRCKRCRKGFRQQNELKKHMKTHSGRKVYQCEYCEYSTTDASGFKRHVISIHTKDYPHRCEYCKKGFRRPSEKNQHIMRHHKEVGLP

SEQ ID NO: 70872 - protein, 801 aa, Homo sapiens; identical to SEQ ID NO: 70871

SEQ ID NO: 70873 - protein, 610 aa, Homo sapiens
MDEDEFELQPQEPNSFFDGIVDDAGKIEHDGSTGVTIDAESEMDPCKVDSTCPEVIKVYIFKADPGEDDLGGTVDIVESEPENDHGVELLDQNSSIRVPREKMVYMTVNDSQQEDEDLNVAEIADEVYMEVIVGEEDAAVAAAAAAVHEQQIDEDEMKTFVPIAWAAAYGNNSDGIENRNGTASALLHIDESAGLGRLAKQKPKKKRRPDSRQYQTAIIIGPDGHPLTVYPCMICGKKFKSRGFLKRHMKNHPEHLAKKKYHCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELRKHMRIHTGEKPYQCQYCEYRSADSSNLKTHIKTKHSKEMPFKCDICLLTFSDTKEVQQHTLVHQESKTHQCLHCDHKSSNSSDLKRHVISVHTKDYPHKCEMCEKGFHRPSELKKHVAVHKGKKMHQCRHCDFKIADPFVLSRHILSVHTKDLPFRCKRCRKGFRQQNELKKHMKTHSGRKVYQCEYCEYSTTDASGFKRHVISIHTKDYPHRCEYCKKGFRRPSEKNQHIMRHHKEVGLP

SEQ ID NO: 70874 - protein, 91 aa, Homo sapiens
MDEDEFELQPQEPNSFFDGIGADATHMDGDQIVVEIQEAVFVSNIVDSDITVHNFVPDDPDSVVIQDVVEDVVIEEDVQCSDILEEADVSE

SEQ ID NO: 70875 - protein, 724 aa, Homo sapiens
MDGDQIVVEIQEAVFVSNIVDSDITVHNFVPDDPDSVVIQDVVEDVVIEEDVQCSDILEEADVSENVIIPEQVLDSDVTEEVSLPHCTVPDDVLASDITSTSMSMPEHVLTSESMHVCDIGHVEHMVHDSVVEAEIITDPLTSDIVSEEVLVADCAPEAVIDASGISVDQQDNDKASCEDYLMISLDDAGKIEHDGSTGVTIDAESEMDPCKVDSTCPEVIKVYIFKADPGEDDLGGTVDIVESEPENDHGVELLDQNSSIRVPREKMVYMTVNDSQQEDEDLSNNSDGIENRNGTASALLHIDESAGLGRLAKQKPKKKRRPDSRQYQTAIIIGPDGHPLTVYPCMICGKKFKSRGFLKRHMKNHPEHLAKKKYHCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELRKHMRIHTGEKPYQCQYCEYRSADSSNLKTHIKTKHSKEMPFKCDICLLTFSDTKEVQQHTLVHQESKTHQCLHCDHKSSNSSDLKRHVISVHTKDYPHKCEMCEKGFHRPSELKKHVAVHKGKKMHQCRHCDFKIADPFVLSRHILSVHTKDLPFRCKRCRKGFRQQNELKKHMKTHSGRKVYQCEYCEYSTTDASGFKRHVISIHTKDYPHRCEYCKKGFRRPSEKNQHIMRHHKEVGLP

SEQ ID NO: 70876 - protein, 538 aa, Homo sapiens
MARELSESTALDAQSTEDQMELLVIKVEEEEAGFPSSPDLGSEGSRERFRGFRYPEAAGPREALSRLRELCRQWLQPEMHSKEQILELLVLEQFLTILPGNLQSWVREQHPESGEEVVVLLEYLERQLDEPAPQVSGVDQGQELLCCKMALLTPAPGSQSSQFQLMKALLKHESVGSQPLQDRVLQVPVLAHGGCCREDKVVASRLTPESQGLLKVEDVALTLTPEWTQQDSSQGNLCRDEKQENHGSLVSLGDEKQTKSRDLPPAEELPEKEHGKISCHLREDIAQIPTCAEAGEQEGRLQRKQKNATGGRRHICHECGKSFAQSSGLSKHRRIHTGEKPYECEECGKAFIGSSALVIHQRVHTGEKPYECEECGKAFSHSSDLIKHQRTHTGEKPYECDDCGKTFSQSCSLLEHHRIHTGEKPYQCSMCGKAFRRSSHLLRHQRIHTGDKNVQEPEQGEAWKSRMESQLENVETPMSYKCNECERSFTQNTGLIEHQKIHTGEKPYQCNACGKGFTRISYLVQHQRSHVGKNILSQ

SEQ ID NO: 70877 - protein, 390 aa, Homo sapiens
MALLTPAPGSQSSQFQLMKALLKHESVGSQPLQDRVLQVPVLAHGGCCREDKVVASRLTPESQGLLKVEDVALTLTPEWTQQDSSQGNLCRDEKQENHGSLVSLGDEKQTKSRDLPPAEELPEKEHGKISCHLREDIAQIPTCAEAGEQEGRLQRKQKNATGGRRHICHECGKSFAQSSGLSKHRRIHTGEKPYECEECGKAFIGSSALVIHQRVHTGEKPYECEECGKAFSHSSDLIKHQRTHTGEKPYECDDCGKTFSQSCSLLEHHRIHTGEKPYQCSMCGKAFRRSSHLLRHQRIHTGDKNVQEPEQGEAWKSRMESQLENVETPMSYKCNECERSFTQNTGLIEHQKIHTGEKPYQCNACGKGFTRISYLVQHQRSHVGKNILSQ

SEQ ID NO: 70878 - protein, 538 aa, Homo sapiens; identical to SEQ ID NO: 70876

SEQ ID NO: 70879 - protein, 178 aa, Homo sapiens
MARELSESTALDAQSTEDQMELLVIKVEEEEAGFPSSPDLGSEGSRERFRGFRYPEAAGPREALSRLRELCRQWLQPEMHSKEQILELLVLEQFLTILPGNLQSWVREQHPESGEEVVVLLEYLERQLDEPAPQVERTGLVSERCGLFPPEIPDQSEGHSFNIQEFFISFLYREPPWQ

SEQ ID NO: 70880 - protein, 330 aa, Homo sapiens
RQRFRGFRYPEAAGPREALSRLRELCGQWLQPEMHSKEQILELLVLEQFLTILPGNLQSWVREQHPESGEEVVVLLEYLERQLDEPAPQVERTGLVSERCARGIPLRSRSSSSLFVLAFLPWQGITHSCRPFVVSGGEIQTKSRDLPPVKKLPEKEHGKICHLREDIAQIPTHAEAGEQEGRLQRKQKNAIGSRRHYCHECGKSFAQSSGLTKHRRIHTGEKPYECEDCGKTFIGSSALVIHQRVHTGEKPYECEECGKVFSHSSNLIKHQRTHTGEKPYECDDCGKTFSQSCSLLEHHKIHTGEKPYQCNMCGKAFRRNSHLLRHQRIH

SEQ ID NO: 70881 - protein, 545 aa, Homo sapiens
MAREPRKNAALDAQSAEDQTGLLTVKVEKEEASALTAEVRAPCSPARGPERSRQRFRGFRYPEAAGPREALSRLRELCGQWLQPEMHSKEQILELLVLEQFLTILPGNLQSWVREQHPESGEEVVVLLEYLERQLDEPAPQVPVGDQGQELLCCKMALLTQTQGSQSSQCQPMKALFKHESLGSQPLHDRVLQVPGLAQGGCCREDAMVASRLTPGSQGLLKMEDVALTLTPGWTQLDSSQVNLYRDEKQENHSSLVSLGGEIQTKSRDLPPVKKLPEKEHGKICHLREDIAQIPTHAEAGEQEGRLQRKQKNAIGSRRHYCHECGKSFAQSSGLTKHRRIHTGEKPYECEDCGKTFIGSSALVIHQRVHTGEKPYECEECGKVFSHSSNLIKHQRTHTGEKPYECDDCGKTFSQSCSLLEHHKIHTGEKPYQCNMCGKAFRRNSHLLRHQRIHGDKNVQNPEHGESWESQGRTESQWENTEAPVSYKCNECERSFTRNRSLIEHQKIHTGEKPYQCDTCGKGFTRTSYLVQHQRSHVGKKTLSQ

SEQ ID NO: 70882 - protein, 390 aa, Homo sapiens
MALLTQTQGSQSSQCQPMKALFKHESLGSQPLHDRVLQVPGLAQGGCCREDAMVASRLTPGSQGLLKMEDVALTLTPGWTQLDSSQVNLYRDEKQENHSSLVSLGGEIQTKSRDLPPVKKLPEKEHGKICHLREDIAQIPTHAEAGEQEGRLQRKQKNAIGSRRHYCHECGKSFAQSSGLTKHRRIHTGEKPYECEDCGKTFIGSSALVIHQRVHTGEKPYECEECGKVFSHSSNLIKHQRTHTGEKPYECDDCGKTFSQSCSLLEHHKIHTGEKPYQCNMCGKAFRRNSHLLRHQRIHGDKNVQNPEHGESWESQGRTESQWENTEAPVSYKCNECERSFTRNRSLIEHQKIHTGEKPYQCDTCGKGFTRTSYLVQHQRSHVGKKTLSQ

SEQ ID NO: 70883 - protein, 166 aa, Homo sapiens
PTHAEAGEQEGRLQRKQKNAIGSRRHYCHECGKSFAQSSGLTKHRRIHTGEKPYECEDCGKTFIGSSALVIHQRVHTGEKPYECEECGKVFSHSSNLIKHQRTHTGEKPYECDDCGKTFSQSCSLLEHHKIHTGEKPYQCNMCGKAFRRNSHLLRHQRIHVVTEIV

SEQ ID NO: 70884 - protein, 145 aa, Homo sapiens
MEFPDLGKHCSEKTCKQLDFLPVKCDACKQDFCKDHFPYAAHKCPFAFQKDVHVPVCPLCNTPIPVKKGQIPDVVVGDHIDRDCDSHPGKKKEKIFTYRCSKEGCKKKEMLQMVCAQCHGNFCIQHRHPLDHSCRHGSRPTIKAG

SEQ ID NO: 70885 - protein, 180 aa, Homo sapiens
MEFPDLGKHCSEKTCKQLDFLPVKCDACKQDFCKDHFPYAAHKCPFAFQKDVHVPVCPLCNTPIPVKKGQIPDVVVGDHIDRDCDSHPGKKKEKIFTYRCSKEGCKKKEMLQMVCAQCHGNFCIQHRHPLDHSCRHGSRPTIKAGCSPMTVSESRPLGDFLTLAPGGLAQRLGYWFTRLM

SEQ ID NO: 70886 - protein, 257 aa, Homo sapiens
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLSEDEALQRALEMSLAETKPQVPSCQEEEDLALAQALSASEAEYQRQQAQSRSSKPSNCSLC

SEQ ID NO: 70887 - protein, 176 aa, Homo sapiens
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSR

SEQ ID NO: 70888 - protein, 257 aa, Homo sapiens; identical to SEQ ID NO: 70886

SEQ ID NO: 70889 - protein, 176 aa, Homo sapiens; identical to SEQ ID NO: 70887

SEQ ID NO: 70890 - protein, 50 aa, Homo sapiens
MEFPDLGAHCSEPSCQRLDFLPLKCDACSGIFCADHVAYAQHHCGSAYQK

SEQ ID NO: 70891 - protein, 225 aa, Homo sapiens
MEFPDLGAHCSEPSCQRLDFLPLKCDACSGIFCADHVAYAQHHCGSAYQKDIQVPVCPLCNVPVPVARGEPPDRAVGEHIDRDCRSDPAQQKRKIFTNKCERAGCRQREMMKLTCERCSRNFCIKHRHPLDHDCSGEGHPTSRAGLAAISRAQAVASTSTVPSPSQTMPSCTSPSRATTRSPSWTAPPVIALQNGLVSWAEVGWTETNTQRVKSKDAGLLSPFVE

SEQ ID NO: 70892 - protein, 227 aa, Homo sapiens
MGDAGSERSKAPSLPPRCPCGFWGSSKTMNLCSKCFADFQKKQPDDDSAPSTSNSQSDLFSEETTSDNNNTSITTPTLSPSQQPLPTELNVTSPSKEECGPCTDTAHVSLITPTKRSCGTDSQSENEASPVKRPRLLENTERSEETSRSKQKSRRRCFQCQTKLELVQQELGSCRCGYVFCMLHRLPEQHDCTFDHMGRGREEAIMKMVKLDRKVGRSCQRIGEGCS

SEQ ID NO: 70893 - protein, 213 aa, Homo sapiens
MAQETNQTPGPMLCSTGCGFYGNPRTNGMCSVCYKEHLQRQQNSGRMSPMGTASGSNSPTSDSASVQRADTSLNNCEGAAGSTSEKSRNVPVAALPVTQQMTEMSISREDKITTPKTEVSEPVVTQPSPSVSQPSTSQSEEKAPELPKPKKNRCFMCRKKVGLTGFDCRCGNLFCGLHRYSDKHNCPYDYKAEAAAKIRKENPVVVAEKIQRI

SEQ ID NO: 70894 - protein, 213 aa, Homo sapiens; identical to SEQ ID NO: 70893

SEQ ID NO: 70895 - protein, 211 aa, Homo sapiens
MAKPEQAADGGVRGRGARPPAQEAQRRRRHPVVVARDLAPGVPGSLHSTQKNMAQETNQTPGPMLCSTGCGFYGNPRTNGMCSVCYKEHLQRQQNSGRMSPMGTASGSNSPTSDSASVQRADTSLNNCEGAAGSTSEKSRNVPVAALPVTQQMTEMSISREDKITTPKTEVSEPVVTQPSPSVSQPSTSQSEEKAPELPKPKKNRCFMCRK

SEQ ID NO: 70896 - protein, 213 aa, Homo sapiens; identical to SEQ ID NO: 70893

SEQ ID NO: 70897 - protein, 213 aa, Homo sapiens; identical to SEQ ID NO: 70893

SEQ ID NO: 70898 - protein, 208 aa, Homo sapiens
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLTGFECRCGNVYCGVHRYSDVHNCSYNYKADAAEKIRKENPVVVGEKIQKI

SEQ ID NO: 70899 - protein, 208 aa, Homo sapiens; identical to SEQ ID NO: 70898

SEQ ID NO: 70900 - protein, 196 aa, Homo sapiens
MAQETNHSQVPMLCSTGCGFYGNPRTNGMCSVCYKEHLQRQNSSNGRISPPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLTGFECRCGNVYCGVHRYSDVHNCSYNYKADAAEKIRKENPVVVGEKIQKI

SEQ ID NO: 70901 - protein, 208 aa, Homo sapiens; identical to SEQ ID NO: 70898

SEQ ID NO: 70902 - protein, 208 aa, Homo sapiens; identical to SEQ ID NO: 70898

SEQ ID NO: 70903 - protein, 208 aa, Homo sapiens; identical to SEQ ID NO: 70898

SEQ ID NO: 70904 - protein, 694 aa, Homo sapiens
MENKSLESSQTDLKLVAHPRAKSKVWKYFGFDTNAEGCILQWKKIYCRICMAQIAYSGNTSNLSYHLEKNHPEEFCEFVKSNTEQMREAFATAFSKLKPESSQQPGQDALAVKAGHGYDSKKQQELTAAVLGLICEGLYPASIVDEPTFKVLLKTADPRYELPSRKYISTKAIPEKYGAVREVILKELAEATWCGISTDMWRSENQNRAYVTLAAHFLGLGAPNCLSMGSRCLKTFEVPEENTAETITRVLYEVFIEWGISAKVFGATTNYGKDIVKACSLLDVAVHMPCLGHTFNAGIQQAFQLPKLGALLSRCRKLVEYFQQSAVAMYMLYEKQKQQNVAHCMLVSNRVSWWGSTLAMLQRLKEQQFVIAGVLVEDSNNHHLMLEASEWATIEGLVELLQPFKQVAEMLSASRYPTISMVKPLLHMLLNTTLNIKETDSKELSMAKEVIAKELSKTYQETPEIDMFLNVATFLDPRYKRLPFLSAFERQQVENRVVEEAKGLLDKVKDGGYRPAEDKIFPVPEEPPVKKLMRTSTPPPASVINNMLAEIFCQTGGVEDQEEWHAQVVEELSNFKSQKVLGLNEDPLKWWSDRLALFPLLPKVLQKYWCVTATRVAPERLFGSAANVVSAKRNRLAPAHVDEQVFLYENARSGAEAEPEDQDEGEWGLDQEQVFSLGDGVSGGFFGIRDSSFL

SEQ ID NO: 70905 - protein, 694 aa, Homo sapiens; identical to SEQ ID NO: 70904

SEQ ID NO: 70906 - protein, 694 aa, Homo sapiens; identical to SEQ ID NO: 70904

SEQ ID NO: 70907 - protein, 272 aa, Homo sapiens
MENKSLESSQTDLKLVAHPRAKSKVWKYFGFDTNAEGCILQWKKIYCRICMAQIAYSGNTSNLSYHLEKNHPEEFCEFVKSNTEQMREAFATAFSKLKPESSQQPGQDALAVKAGHGYDSKKQQELTAAVLGLICEGLYPASIVDEPTFKVLLKTADPRYELPSRKYISTKAIPEKYGAVREVILKELAEATWCGISTDMWRSENQNRAYVTLAAHFLGLGAPNCLSMGSRCLKTFEVPEENTAETITRVLYEVFIEWGISAKVFGATTNYG

SEQ ID NO: 70908 - protein, 1171 aa, Homo sapiens
MENNLKTCPKEDGDFVSDKIKFKIEEEDDDGIPPDSLERMDFKSEQEDMKQTDSGGERAGLGGTGCSCKPPGKYLSAESEDDYGALFSQYSSTLYDVAMEAVTQSLLSSRNMSSRKKSPAWKHFFISPRDSTKAICMYCVKEFSRGKNEKDLSTSCLMRHVRRAHPTVLIQENGSVSAVSSFPSPSLLLPPQPADAGDLSTILSPIKLVQKVASKIPSPDRITEESVSVVSSEEISSDMSVSEKCGREEALVGSSPHLPALHYDEPAENLAEKSLPLPKSTSGSRRRSAVWKHFYLSPLDNSKAVCIHCMNEFSRGKNGKDLGTSCLIRHMWRAHRAIVLQENGGTGIPPLYSTPPTLLPSLLPPEGELSSVSSSPVKPVRESPSASSSPDRLTEDLQSHLNPGDGLMEDVAAFSSSDDIGEASASSPEKQQADGLSPRLFESGAIFQQNKKVMKRLKSEVWHHFSLAPMDSLKAECRYCGCAISRGKKGDVGTSCLMRHLYRRHPEVVGSQKGFLGASLANSPYATLASAESSSSKLTDLPTVVTKNNQVMFPVNSKKTSKLWNHFSICSADSTKVVCLHCGRTISRGKKPTNLGTSCLLRHLQRFHSNVLKTEVSETARPSSPDTRVPRGTELSGASSFDDTNEKFYDSHPVAKKITSLIAEMIALDLQPYSFVDNVGFNRLLEYLKPQYSLPAPSYFSRTAIPGMYDNVKQIIMSHLKEAESGVIHFTSGIWMSNQTREYLTLTAHWVSFESPARPRCDDHHCSALLDVSQVDCDYSGNSIQKQLECWWEAWVTSTGLQVGITVTDNASIGKTLNEGEHSSVQCFSHTVNLIVSEAIKSQRMVQNLLSLARKICERVHRSPKAKEKLAELQREYALPQHHLIQDVPSKWSTSFHMLERLIEQKRAINEMSVECNFRELISCDQWEVMQSVCRALKPFEAASREMSTQMSTLSQVIPMVHILNRKVEMLFEETMGIDTMLRSLKEAMVSRLSATLHDPRYVFATLLDPRYKASLFTEEEAEQYKQDLIRELELMNSTSEDVAASHRCDAGSPSKDSAAEENLWSLVAKVKKKDPREKLPEAMVLAYLEEEVLEHSCDPLTYWNLKKASWPGLSALAVRFLGCPPSIVPSEKLFNTPTENGSLGQSRLMMEHFEKLIFLKVNLPLIYFQY

SEQ ID NO: 70909 - protein, 979 aa, Homo sapiens
MSVCTLSVPVSSLSPGRRCNTFSDSGILGCVPINSNTDEEDVVEEKMVAEGVNKEAKQPAKKKRKKGLRIKGKRRRKKLILAKKFSKDLGSGRPVADAPALLASNDPEQDEESLFESNIEKQIYLPSTRAKTSIVWHFFHVDPQYTWRAICNLCEKSVSRGKPGSHLGTSTLQRHLQARHSPHWTRANKFGVASGEEDFTLDVSLSPSSGSNGSFEYIPTDPLDDNRMGKKHDKSASDALRAERGRFLIKSNIVKHALIPGTRAKTSAVWNFFYTDPQHISRAVCNICKRSVSRGRPGSHLGTSTLQRHLQATHPIHWAVANKDSGAVANGLDEAETERSDLLSDTLHGEKSTGSQDLTAEDLSDSDSDEPMLEVENRSESPIPVAEQGTLMRAQERETTCCGNPVSSHISQAIIQMIVEDMHPYNYFSTPAFQRFMQIVAPDYRLPSETYFFTKAVPQLYDCVREKIFLTLENVQSQKIHLTVDIWTHDPSTDYFIVTVHWVSLETASFLNNGRIPDFRKWAVLCVTGLAKDCLITNILQELNDQIGLWLSPNFLIPSFIVSDNSSNVVHAIKDGGFTHVPCFLHCLNMVIQDFFCEHKSIENMLVAARKTCHHFSHSVKARQILQEFQNDHQLPWKNLKQDETGHWISTFYMLKWLLEHCYSVHHSLGRASGVVLTSLQWTLMTYVCDILKPFEEATQKVSVKTAGLNQVLPLIHHLLLSLQKLREDFQVRGITQALNLVDSLSLKLETDTLLSAMLKSKPCILATLLDPCFKNSLEDFFPQGADLETYKQFLAEEVCNYMESSPEICQIPTSEASCPSVTVGADSFTSSLKEGTSSSGSVDSSAVDNVALGSKSFMFPSAVAVVDEYFKEKYSEFSGGDDPLIYWQRKISIWPALTQVAIQYLSCPMCSWQSECIFTKNSHFHPKQIMSLDFDNIEQLMFLKMNLKNVNYDYSTLVLSWDPEQNEVVQSSEKEILP

SEQ ID NO: 70910 - protein, 1645 aa, Homo sapiens
MEESKTLKSENHEPKKNVICEESKAVQVIGNQTLKARNDKSVKEIENSSPNRNSSKKNKQNDICIEKTEVKSCKVNAANLPGPKDLGLVLRDQSHCKAKKFPNSPVKAEKATISQAKSEKATSLQAKAEKSPKSPNSVKAEKASSYQMKSEKVPSSPAEAEKGPSLLLKDMRQKTELQQIGKKIPSSFTSVDKVNIEAVGGEKCALQNSPRSQKQQTCTDNTGDSDDSASGIEDVSDDLSKMKNDESNKENSSEMDYLENATVIDESALTPEQRLGLKQAEERLERDHIFRLEKRSPEYTNCRYLCKLCLIHIENIQGAHKHIKEKRHKKNILEKQEESELRSLPPPSPAHLAALSVAVIELAKEHGITDDDLRVRQEIVEEMSKVITTFLPECSLRLYGSSLTRFALKSSDVNIDIKFPPKMNHPDLLIKVLGILKKNVLYVDVESDFHAKVPVVVCRDRKSGLLCRVSAGNDMACLTTDLLTALGKIEPVFIPLVLAFRYWAKLCYIDSQTDGGIPSYCFALMVMFFLQQRKPPLLPCLLGSWIEGFDPKRMDDFQLKGIVEEKFVKWECNSSSATEKNSIAEENKAKADQPKDDTKKTETDNQSNAMKEKHGKSPLALETPNRVSLGQLWLELLKFYTLDFALEEYVICVRIQDILTRENKNWPKRRIAIEDPFSVKRNVARSLNSQLVYEYVVERFRAAYRYFACPQTKGGNKSTVDFKKREKGKISNKKPVKSNNMATNGCILLGETTEKINAEREQPVQCDEMDCTSQRCIIDNNNLLVNELDFADHGQDSSSLSTSKSSEIEPKLDKKQDDLAPSETCLKKELSQCNCIDLSKSPDPDKSTGTDCRSNLETESSHQSVCTDTSATSCNCKATEDASDLNDDDNLPTQELYYVFDKFILTSGKPPTIVCSICKKDGHSKNDCPEDFRKIDLKPLPPMTNRFREILDLVCKRCFDELSPPCSEQHNREQILIGLEKFIQKEYDEKARLCLFGSSKNGFGFRDSDLDICMTLEGHENAEKLNCKEIIENLAKILKRHPGLRNILPITTAKVPIVKFEHRRSGLEGDISLYNTLAQHNTRMLATYAAIDPRVQYLGYTMKVFAKRCDIGDASRGSLSSYAYILMVLYFLQQRKPPVIPVLQEIFDGKQIPQRMVDGWNAFFFDKTEELKKRLPSLGKNTESLGELWLGLLRFYTEEFDFKEYVISIRQKKLLTTFEKQWTSKCIAIEDPFDLNHNLGAGVSRKMTNFIMKAFINGRKLFGTPFYPLIGREAEYFFDSRVLTDGELAPNDRCCRVCGKIGHYMKDCPKRKSSLLFRLKKKDSEEEKEGNEEEKDSRDVLDPRDLHDTRDFRDPRDLRCFICGDAGHVRRECPEVKLARQRNSSVAAAQLVRNLVNAQQVAGSAQQQGDQSIRTRQSSECSESPSYSPQPQPFPQNSSQSAAITQPSSQPGSQPKLGPPQQGAQPPHQVQMPLYNFPQSPPAQYSPMHNMGLLPMHPLQIPAPSWPIHGPVIHSAPGSAPSNIGLNDPSIIFAQPAARPVAIPNTSHDGHWPRTVAPNSLVNSGAVGNSEPGFRGLTPPIPWEHAPRPHFPLVPASWPYGLHQNFMHQGNARFQPNKPFYTQDRCATRRCRERCPHPPRGNVSE

SEQ ID NO: 70911 - protein, 1644 aa, Homo sapiens
MEESKTLKSENHEPKKNVICEESKAVQVIGNQTLKARNDKSVKEIENSSPNRNSSKKNKQNDICIEKTEVKSCKVNAANLPGPKDLGLVLRDQSHCKAKKFPNSPVKAEKATISQAKSEKATSLQAKAEKSPKSPNSVKAEKASSYQMKSEKVPSSPAEAEKGPSLLLKDMRQKTELQQIGKKIPSSFTSVDKVNIEAVGGEKCALQNSPRSQKQQTCTDNTGDSDDSASGIEDVSDDLSKMKNDESNKENSSEMDYLENATVIDESALTPEQRLGLKQAEERLERDHIFRLEKRSPEYTNCRYLCKLCLIHIENIQGAHKHIKEKRHKKNILEKQEESELRSLPPPSPAHLAALSVAVIELAKEHGITDDDLRVRQEIVEEMSKVITTFLPECSLRLYGSSLTRFALKSSDVNIDIKFPPKMNHPDLLIKVLGILKKNVLYVDVESDFHAKVPVVVCRDRKSGLLCRVSAGNDMACLTTDLLTALGKIEPVFIPLVLAFRYWAKLCYIDSQTDGGIPSYCFALMVMFFLQQRKPPLLPCLLGSWIEGFDPKRMDDFQLKGIVEEKFVKWECNSSSATEKNSIAEENKAKADQPKDDTKKTETDNQSNAMKEKHGKSPLALETPNRVSLGQLWLELLKFYTLDFALEEYVICVRIQDILTRENKNWPKRRIAIEDPFSVKRNVARSLNSQLVYEYVVERFRAAYRYFACPQTKGGNKSTVDFKKREKGKISNKKPVKSNNMATNGCILLGETTEKINAEREQPVQCDEMDCTSQRCIIDNNNLLVNELDFADHGQDSSSLSTSKSSEIEPKLDKKQDDLAPSETCLKKELSQCNCIDLSKSPDPDKSTGTDCRSNLETESSHQSVCTDTSATSCNCKATEDASDLNDDDNLPTQELYYVFDKFILTSGKPPTIVCSICKKDGHSKNDCPEDFRKIDLKPLPPMTNRFREILDLVCKRCFDELSPPCSEQHNREQILIGLEKFIQKEYDEKARLCLFGSSKNGFGFRDSDLDICMTLEGHENAEKLNCKEIIENLAKILKRHPGLRNILPITTAKVPIVKFEHRRSGLEGDISLYNTLAQHNTRMLATYAAIDPRVQYLGYTMKVFAKRCDIGDASRGSLSSYAYILMVLYFLQQRKPPVIPVLQEIFDGKQIPQRMVDGWNAFFFDKTEELKKRLPSLGKNTESLGELWLGLLRFYTEEFDFKEYVISIRQKKLLTTFEKQWTSKCIAIEDPFDLNHNLGAGVSRKMTNFIMKAFINGRKLFGTPFYPLIGREAEYFFDSRVLTDGELAPNDRCCRVCGKIGHYMKDCPKRKSLLFRLKKKDSEEEKEGNEEEKDSRDVLDPRDLHDTRDFRDPRDLRCFICGDAGHVRRECPEVKLARQRNSSVAAAQLVRNLVNAQQVAGSAQQQGDQSIRTRQSSECSESPSYSPQPQPFPQNSSQSAAITQPSSQPGSQPKLGPPQQGAQPPHQVQMPLYNFPQSPPAQYSPMHNMGLLPMHPLQIPAPSWPIHGPVIHSAPGSAPSNIGLNDPSIIFAQPAARPVAIPNTSHDGHWPRTVAPNSLVNSGAVGNSEPGFRGLTPPIPWEHAPRPHFPLVPASWPYGLHQNFMHQGNARFQPNKPFYTQDRCATRRCRERCPHPPRGNVSE

SEQ ID NO: 70912 - protein, 87 aa, Homo sapiens
MEESKTLKSENHEPKKNVICEESKAVQVIGNQTLKARNDKSVKEIENSSPNRNSSKKNKQNDICIEKTEVKSCKVNAANLPGPKDLG

SEQ ID NO: 70913 - protein, 77 aa, Homo sapiens
MEESKTLKSENHEPKKNVICEESKAVQVIGNQTLKARNDKSVKEIENSSPNRNSSKKNKQNDICIEKTEVKSCKVNA

SEQ ID NO: 70914 - protein, 402 aa, Homo sapiens
MASIIARVGNSRRLNAPLPPWAHSMLRSLGRSLGPIMASMADRNMKLFSGRVVPAQGEETFENWLTQVNGVLPDWNMSEEEKLKRLMKTLRGPAREVMRVLQATNPNLSVADFLRAMKLVFGESESSVTAHGKFFNTLQAQGEKASLYVIRLEVQLQNAIQAGIIAEKDANRTRLQQLLLGGELSRDLRLRLKDFLRMYANEQERLPNFLELIRMVREEEDWDDAFIKRKRPKRSESMVERAVSPVAFQGSPPIVIGSADCNVIEIDDTLDDSDEDVILVESQDPPLPSWGAPPLRDRARPQDEVLVIDSPHNSRAQFPSTSGGSGYKNNGPGEMRRARKRKHTIRCSYCGEEGHSKETCDNESDKAQVFENLIITLQELTHTEMERSRVAPGEYNDFSEPL

SEQ ID NO: 70915 - protein, 513 aa, Homo sapiens
MAASRNGFEAVEAEGSAGCRGSSGMEVVLPLDPAVPAPLCPHGPTLLFVKVTQGKEETRRFYACSACRDRKDCNFFQWEDEKLSGARLAAREAHNRRCQPPLSRTQCVERYLKFIELPLTQRKFCQTCQQLLLPDDWGQHSEHQVLGNVSITQLRRPSQLLYPLENKKTNAQYLFADRSCQFLVDLLSALGFRRVLCVGTPRLHELIKLTASGDKKSNIKSLLLDIDFRYSQFYMEDSFCHYNMFNHHFFDGKTALEVCRAFLQEDKGEGIIMVTDPPFGGLVEPLAITFKKLIAMWKEGQSQDDSHKELPIFWIFPYFFESRICQFFPSFQMLDYQVDYDNHALYKHGKTGRKQSPVRIFTNIPPNKIILPTEEGYRFCSPCQRYVSLENQHCELCNSCTSKDGRKWNHCFLCKKCVKPSWIHCSICNHCAVPDHSCEGPKHGCFICGELDHKRSTCPNIATSKRANKAVRKQKQRKSNKMKMETTKGQSMNHTSATRRKKRRERAHQYLGS

SEQ ID NO: 70916 - protein, 127 aa, Homo sapiens [sequence omitted]

SEQ ID NO: 70917 - protein, 492 aa, Homo sapiens
MVILLLQHGADPTLIDGEGFSSIHLAVLFQHMPIIAYLISKGQSVNMTDVNGQTPLMLSAHKVIGPEPTGFLLKFNPSLNVVDKIHQNTPLHWAVAAGNVNAVDKLLEAGSSLDIQNVKGETPLDMALQNKNQLIIHMLKTEAKMRANQKFRLWRWLQKCELFLLLMLSVITMWAIGYILDFNSDSWLLKGCLLVTLFFLTSLFPRFLVGYKNLVYLPTAFLLSSVFWIFMTWFILFFPDLAGAPFYFSFIFSIVAFLYFFYKTWATDPGFTKASEEEKKVNIITLAETGSLDFRTFCTSCLIRKPLRSLHCHVCNCCVARYDQHCLWTGRCIGFGNHHYYIFFLFFLSMVCGWIIYGSFIYLSSHCATTFKEDGLWTYLNQIVACSPWVLYILMLATFHFSWSTFLLLNQLFQIAFLGLTSHERISLQKQSKHMKQTLSLRKTPYNLGFMQNLADFFQCGCFGLVKPCVVDWTSQYTMVFHPAREKVLRSV

SEQ ID NO: 70918 - protein, 622 aa, Homo sapiens
MEGPGLGSQCRNHSHGPHPPGFGRYGICAHENKELANAREALPLIEDSSNCDIVKATQYGIFERCKELVEAGYDVRQPDKENVSLLHWAAINNRLDLVKFYISKGAVVDQLGGDLNSTPLHWAIRQGHLPMVILLLQHGADPTLIDGEGFSSIHLAVLFQHMPIIAYLISKGQSVNMTDVNGQTPLMLSAHKVIGPEPTGFLLKFNPSLNVVDKIHQNTPLHWAVAAGNVNAVDKLLEAGSSLDIQNVKGETPLDMALQNKNQLIIHMLKTEAKMRANQKFRLWRWLQKCELFLLLMLSVITMWAIGYILDFNSDSWLLKGCLLVTLFFLTSLFPRFLVGYKNLVYLPTAFLLSSVFWIFMTWFILFFPDLAGAPFYFSFIFSIVAFLYFFYKTWATDPGFTKASEEEKKVNIITLAETGSLDFRTFCTSCLIRKPLRSLHCHVCNCCVARYDQHCLWTGRCIGFGNHHYYIFFLFFLSMVCGWIIYGSFIYLSSHCATTFKEDGLWTYLNQIVACSPWVLYILMLATFHFSWSTFLLLNQLFQIAFLGLTSHERISLQKQSKHMKQTLSLRKTPYNLGFMQNLADFFQCGCFGLVKPCVVDWTSQYTMVFHPAREKVLRSV

SEQ ID NO: 70919 - protein, 187 aa, Homo sapiens
MRRGWKMALSGGLRCCRRVLSWVPVLVIVLVVLWSYYAYVFELCLVTVLSPAEKVIYLILYHAIFVFFTWTYWKSIFTLPQQPNQKFHLSYTDKERYENEERPEVQKQMLVDMAKKLPVYTRTGSGAVRFCDRCHLIKPDRCHHCSVCAMCVLKMDHHCPWGNYPVFALSSMSFFFSLWPACFLSAL

SEQ ID NO: 70920 - protein, 337 aa, Homo sapiens
MRRGWKMALSGGLRCCRRVLSWVPVLVIVLVVLWSYYAYVFELCLVTVLSPAEKVIYLILYHAIFVFFTWTYWKSIFTLPQQPNQKFHLSYTDKERYENEERPEVQKQMLVDMAKKLPVYTRTGSGAVRFCDRCHLIKPDRCHHCSVCAMCVLKMDHHCPWVNNCIGFSNYKFFLQFLAYSVLYCLYIATTVFSYFIKYWRGELPSVRSKFHVLFLLFVACMFFVSLVILFGYHCWLVSRNKTTLEAFCTPVFTSGPEKNGFNLGFIKNIQQVFGDKKKFWLIPIGSSPGDGHSFPMRSMNESQNPLLANEETWEDNEDDNQDYPEGSSSLAVETET

SEQ ID NO: 70921 - protein, 328 aa, Homo sapiens
MRRGWKMALSGGLRCCRRVLSWVPVLVIVLVVLWSYYAYVFELCLVIYLILYHAIFVFFTWTYWKSIFTLPQQPNQKFHLSYTDKERYENEERPEVQKQMLVDMAKKLPVYTRTGSGAVRFCDRCHLIKPDRCHHCSVCAMCVLKMDHHCPWVNNCIGFSNYKFFLQFLAYSVLYCLYIATTVFSYFIKYWRGELPSVRSKFHVLFLLFVACMFFVSLVILFGYHCWLVSRNKTTLEAFCTPVFTSGPEKNGFNLGFIKNIQQVFGDKKKFWLIPIGSSPGDGHSFPMRSMNESQNPLLANEETWEDNEDDNQDYPEGSSSLAVETET

SEQ ID NO: 70922 - protein, 673 aa, Homo sapiens
MPRSPGTRLKPAKYIPVATAAALLVGSSTLFFVFTCPWLTRAVSPAVPVYNGIIFLFVLANFSMATFMDPGVFPRADEDEDKEDDFRAPLYKNVDVRGIQVRMKWCATCHFYRPPRCSHCSVCDNCVEVTGKFRGGVNPFTRGCCGNVEHVLCSPLAPRYVVEPPRLPLAVSLKPPFLRPELLDRAAPLKVKLSDNGLKAGLGRSKSKGSLDRLDEKPLDLGPPLPPKIEAGTFSSDLQTPRPGSAESALSVQRTSPPTPAMYKFRPAFPTGPKVPFCGPGEQVPGPDSLTLGDDSIRSLDFVSEPSLDLPDYGPGGLHAAYPPSPPLSASDAFSGALRSLSLKASSRRGGDHVALQPLRSEGGPPTPHRSIFAPHALPNRNGSLSYDSLLNPGSPGGHACPAHPAVGVAGYHSPYLHPGATGDPPRPLPRSFSPVLGPRPREPSPVRYDNLSRTIMASIQERKDREERERLLRSQADSLFGDSGVYDAPSSYSLQQASVLSEGPRGPALRYGSRDDLVAGPGFGGARNPALQTSLSSLSSSVSRAPRTSSSSLQADQASSNAPGPRPSSGSHRSPARQGLPSPPGTPHSPSYAGPKAVAFIHTDLPEPPPSLTVQRDHPQLKTPPSKLNGQSPGLARLGPATGPPGPSASPTRHTLVKKVSGVGGTTYEISV

SEQ ID NO: 70923 - protein, 765 aa, Homo sapiens
MPRSPGTRLKPAKYIPVATAAALLVGSSTLFFVFTCPWLTRAVSPAVPVYNGIIFLFVLANFSMATFMDPGVFPRADEDEDKEDDFRAPLYKNVDVRGIQVRMKWCATCHFYRPPRCSHCSVCDNCVEDFDHHCPWVNNCIGRRNYRYFFLFLLSLSAHMVGVVAFGLVYVLNHAEGLGAAHTTITMAVMCVAGLFFIPVIGLTGFHVVLVTRGRTTNEQVTGKFRGGVNPFTRGCCGNVEHVLCSPLAPRYVVEPPRLPLAVSLKPPFLRPELLDRAAPLKVKLSDNGLKAGLGRSKSKGSLDRLDEKPLDLGPPLPPKIEAGTFSSDLQTPRPGSAESALSVQRTSPPTPAMYKFRPAFPTGPKVPFCGPGEQVPGPDSLTLGDDSIRSLDFVSEPSLDLPDYGPGGLHAAYPPSPPLSASDAFSGALRSLSLKASSRRGGDHVALQPLRSEGGPPTPHRSIFAPHALPNRNGSLSYDSLLNPGSPGGHACPAHPAVGVAGYHSPYLHPGATGDPPRPLPRSFSPVLGPRPREPSPVRYDNLSRTIMASIQERKDREERERLLRSQADSLFGDSGVYDAPSSYSLQQASVLSEGPRGPALRYGSRDDLVAGPGFGGARNPALQTSLSSLSSSVSRAPRTSSSSLQADQASSNAPGPRPSSGSHRSPARQGLPSPPGTPHSPSYAGPKAVAFIHTDLPEPPPSLTVQRDHPQLKTPPSKLNGQSPGLARLGPATGPPGPSASPTRHTLVKKVSGVGGTTYEISV

SEQ ID NO: 70924 - protein, 778 aa, Homo sapiens
MPRSPGTRLKPAKYIPVATAAALLVGSSTLFFVFTCPWLTRAVSPAVPVYNGIIFLFVLANFSMATFMDPGVFPRADEDEDKEDDFRAPLYKNVDVRGIQVRMKWCATCHFYRPPRCSHCSVCDNCVEDFDHHCPWVNNCIGRRNYRYFFLFLLSLSAHMVGVVAFGLVYVLNHAEGLGAAHTTITMAVMCVAGLFFIPVIGLTGFHVVLVTRGRTTNEQVTGKFRGGVNPFTRGCCGNVEHVLCSPLAPRYVVEPPRLPLAVSLKPPFLRPELLDRAAPLKVKLSDNGLKAGLGRSKSKGSLDRLDEKPLDLGPPLPPKIEAGTFSSDLQTPRPGSAESALSVQRTSPPTPAMYKFRPAFPTGPKVPFCGPGEQVPGPDSLTLGDDSIRSLDFVSEPSLDLPDYGPGGLHAAYPPSPPLSASDAFSGALRSLSLKASSRRGGDHVALQPLRSEGGPPTPHRSIFAPHALPNRNGSLSYDSLLNPGSPGGHACPAHPAVGVAGYHSPYLHPGATGDPPRPLPRSFSPVLGPRPREPSPVRYDNLSRTIMASIQERKDREERERLLRSQADSLFGDSGVYDAPSSYSLQQASVLSEGPRGPALRYGSRDDLVAGPGFGGARNPALQTSLSSLSSSVSRAPRTSSSSLQADQASSNAPGPRPSSGSHRSPARQGLPSPPGTPHSPSYAGPKAVAFIHTDLPEPPPSLTVQRGRIGTCTRGWGRRGQPWVPPGLHLCHLGRPEDRPPLRAPWSQAAGAPPRGAMCRLHLAASSLFPSLSGP

SEQ ID NO: 70925 - protein, 364 aa, Homo sapiens
MSVMVVRKKVTRKWEKLPGRNTFCCDGRVMMARQKGIFYLTLFLILGTCTLFFAFECRYLAVQLSPAIPVFAAMLFLFSMATLLRTSFSDPGVIPRALPDEAAFIEMEIEATNGAVPQGQRPPPRIKNFQINNQIVKLKYCYTCKIFRPPRASHCSICDNCVERFDHHCPWVGNCVGKRNYRYFYLFILSLSLLTIYVFAFNIVYVALKSLKIGFLETLKETPGTVLEVLICFFTLWSVVGLTGFHTFLVALNQTTNEDIKGSWTGKNRVQNPYSHGNIVKNCCEVLCGPLPPSVLDRRGILPLEESGSRPPSTQETSSSLLPQSPAPTEHLNSNEMPEDSSTPEEMPPPEPPEPPQEAAEAEK

SEQ ID NO: 70926 - protein, 364 aa, Homo sapiens; identical to SEQ ID NO: 70925

SEQ ID NO: 70927 - protein, 170 aa, Homo sapiens
MSVMVVRKKVTRKWEKLPGRNTFCCDGRVMMARQKGIFYLTLFLILGTCTLFFAFECRYLAVQLSPAIPVFAAMLFLFSMATLLRTSFSDPGVIPRALPDEAAFIEMEIEATNGAVPQGQRPPPRIKNFQINNQIVKLKYCYTCKIFRPPRASHCSICDNCVERFDHHCP

SEQ ID NO: 70928 - protein, 194 aa, Homo sapiens
  MOD_RES (1)..(1): Any amino acid
XLFLILGTCTLFFAFECRYLAVQLSPAIPVFAAMLFLFSMATLLRTSFSDPGVIPRALPDEAAFIEMEIEATNGAVPQGQRPPPRIKNFQINNQIVKLKYCYTCKIFRPPRASHCSICDNCVESLKIGFLETLKETPGTVLEVLICFFTLWSVVGLTGFHTFLVALNQTTNEDIKGSWTGKNRVQNPYSHGNIV

SEQ ID NO: 70929 - protein, 252 aa, Homo sapiens
MSSEVSARRDAKKLVRSPSGLRMVPEHRAFGSPFGLEEPQWVPDKECRRCMQCDAKFDFLTRKHHCRRCGKCFCDRCCSQKVPLRRMCFVDPVRQCAECALVSLKEAEFYDKQLKVLLSGATFLVTFGNSEKPETMTCRLSNNQRYLFLDGDSHYEIEIVHISTVQILTEGFPPGEKDIHAYTSLRGSQPASEGGNARATGMFLQYTVPGTEGVTQLKLTVVEDVTVGRRQAVAWLVAMHKAAKLLYESRDQ

SEQ ID NO: 70930 - protein, 234 aa, Homo sapiens
MSSEVSARRDAKKLVRSPSGLRMVPEHRAFGSPFGLEEPQWVPDKECRRCMQCDAKFDFLTRKHHCRRCGKCFCDRCCSQKVPLRRMCFVDPVRQCAECALVSLKEAEFYDKQLKVLLSGATFLVTFGNSEKPETMTCRLSNNQRYLFLDGDSHYEIEIVHISTVQILTEGFPPGGGNARATGMFLQYTVPGTEGVTQLKLTVVEDVTVGRRQAVAWLVAMHKAAKLLYESRDQ

SEQ ID NO: 70931 - protein, 2539 aa, Homo sapiens
MNHPFGKEEAASQKQLFGFFCECLRRGEWELAQACVPQLQEGQGDIPKRVEDILQALVVCPNLLRCGQDINPQRVAWVWLLVLEKWLAREKKLLPVVFRRKLEFLLLSEDLQGDIPENILEELYETLTQGAVGHVPDGNPRRESWTPRLSSEAVSVLWDLLRQSPQPAQALLELLLEEDDGTGLCHWPLQNALVDLIRKALRALQGPDSVPPGVVDAIYGALRTLRCPAEPLGVELHLLCEELLEACRTEGSPLREERLLSCLLHKASRGLLSLYGHTYAEKVTEKPPRATASGKVSPDHLDPERAMLALFSNPNPAEAWKVAYFYCLSNNKHFLEQILVTALTLLKEEDFPNLGCLLDREFRPLSCLLVLLGWTHCQSLESAKRLLQTLHRTQGPGCDELLRDACDGLWAHLEVLEWCIQQSSNPIPKRDLLYHLHGGDSHSVLYTLHHLTNLPALREEDVLKLLQKVPAKDPQQEPDAVDAPVPEHLSQCQNLTLYQGFCAMKYAIYALCVNSHQHSQCQDCKDSLSEDLASATEPANDSLSSPGAANLFSTYLARCQQYLCSIPDSLCLELLENIFSLLLITSADLHPEPHLPEDYAEDDDIEGKSPSGLRSPSESPQHIAHPERKSERGSLGVPKTLAYTMPSHVKAEPKDSYPGPHRHSFLDLKHFTSGISGFLADEFAIGAFLRLLQEQLDEISSRSPPEKPKQESQSCSGSRDGLQSRLHRLSKVVSEAQWRHKVVTSNHRSEEQPSRRYQPATRHPSLRRGRRTRRSQADGRDRGSNPSLESTSSELSTSTSEGSLSAMSGRNELHSRLHPHPQSSLIPMMFSPPESLLASCILRGNFAEAHQVLFTFNLKSSPSSGELMFMERYQEVIQELAQVEHKIENQNSDAGSSTIRRTGSGRSTLQAIGSAAAAGMVFYSISDVTDKLLNTSGDPIPMLQEDFWISTALVEPTAPLREVLEDLSPPAMAAFDLACSQCQLWKTCKQLLETAERRLNSSLERRGRRIDHVLLNADGIRGFPVVLQQISKSLNYLLMSASQTKSESVEEKGGGPPRCSITELLQMCWPSLSEDCVASHTTLSQQLDQVLQSLREALELPEPRTPPLSSLVEQAAQKAPEAEAHPVQIQTQLLQKNLGKQTPSGSRQMDYLGTFFSYCSTLAAVLLQSLSSEPDHVEVKVGNPFVLLQQSSSQLVSHLLFERQVPPERLAALLAQENLSLSVPQVIVSCCCEPLALCSSRQSQQTSSLLTRLGTLAQLHASHCLDDLPLSTPSSPRTTENPTLERKPYSSPRDSSLPALTSSALAFLKSRSKLLATVACLGASPRLKVSKPSLSWKELRGRREVPLAAEQVARECERLLEQFPLFEAFLLAAWEPLRGSLQQGQSLAVNLCGWASLSTVLLGLHSPIALDVLSEAFEESLVARDWSRALQLTEVYGRDVDDLSSIKDAVLSCAVACDKEGWQYLFPVKDASLRSRLALQFVDRWPLESCLEILAYCISDTAVQEGLKCELQRKLAELQVYQKILGLQSPPVWCDWQTLRSCCVEDPSTVMNMILEAQEYELCEEWGCLYPIPREHLISLHQKHLLHLLERRDHDKALQLLRRIPDPTMCLEVTEQSLDQHTSLATSHFLANYLTTHFYGQLTAVRHREIQALYVGSKILLTLPEQHRASYSHLSSNPLFMLEQLLMNMKVDWATVAVQTLQQLLVGQEIGFTMDEVDSLLSRYAEKALDFPYPQREKRSDSVIHLQEIVHQAADPETLPRSPSAEFSPAAPPGISSIHSPSLRERSFPPTQPSQEFVPPATPPARHQWVPDETESICMVCCREHFTMFNRRHHCRRCGRLVCSSCSTKKMVVEGCRENPARVCDQCYSYCNKDVPEEPSEKPEALDSSKNESPPYSFVVRVPKADEVEWILDLKEEENELVRSEFYYEQAPSASLCIAILNLHRDSIACGHQLIEHCCRLSKGLTNPEVDAGLLTDIMKQLLFSAKMMFVKAGQSQDLALCDSYISKVDVLNILVAAAYRHVPSLDQILQPAAVTRLRNQLLEAEYYQLGVEVSTKTGLDTTGAWHAWGMACLKAGNLTAAREKFSRCLKPPFDLNQLNHGSRLVQDVVEYLESTVRPFVSLQDDDYFATLRELEATLRTQSLSLAVIPEGKIMNNTYYQECLFYLHNYSTNLAIISFYVRHSCLREALLHLLNKESPPEVFIEGIFQPSYKSGKLHTLENLLESIDPTLESWGKYLIAACQHLQKKNYYHILYELQQFMKDQVRAAMTCIRFFSHKAKSYTELGEKLSWLLKAKDHLKIYLQETSRSSGRKKTTFFRKKMTAADVSRHMNTLQLQMEVTRFLHRCESAGTSQITTLPLPTLFGNNHMKMDVACKVMLGGKNVEDGFGIAFRVLQDFQLDAAMTYCRAARQLVEKEKYSEIQQLLKCVSESGMAAKSDGDTILLNCLEAFKRIPPQELEGLIQAIHNDDNKVRAYLICCKLRSAYLIAVKQEHSRATALVQQVQQAAKSSGDAVVQDICAQWLLTSHPRGAHGPGSRK

SEQ ID NO: 70932 - protein, 2518 aa, Homo sapiens
MNHPFGKEEAASQKQLFGFFCECLRRGEWELAQACVPQLQEGQGDIPKRVEDILQALVVCPNLLRCGQDINPQRVAWVWLLVLEKWLAREKKLLPVVFRRKLEFLLLSEDLQGDIPENILEELYETLTQGAVGHVPDGNPRRESWTPRLSSEAVSVLWDLLRQSPQPAQALLELLLEEDDGTGLCHWPLQNALVDLIRKALRTLRCPAEPLGVELHLLCEELLEACRTEGSPLREERLLSCLLHKASRGLLSLYGHTYAEKVTEKPPRATASGKVSPDHLDPERAMLALFSNPNPAEAWKVAYFYCLSNNKHFLEQILVTALTLLKEEDFPNLGCLLDREFRPLSCLLVLLGWTHCQSLESAKRLLQTLHRTQGPGCDELLRDACDGLWAHLEVLEWCIQQSSNPIPKRDLLYHLHGGDSHSVLYTLHHLTNLPALREEDVLKLLQKVPAKDPQQEPDAVDAPVPEHLSQCQNLTLYQGFCAMKYAIYALCVNSHQHSQCQDCKDSLSEDLASATEPANDSLSSPGAANLFSTYLARCQQYLCSIPDSLCLELLENIFSLLLITSADLHPEPHLPEDYAEDDDIEGKSPSGLRSPSESPQHIAHPERKSERGSLGVPKTLAYTMPSHVKAEPKDSYPGPHRHSFLDLKHFTSGISGFLADEFAIGAFLRLLQEQLDEISSRSPPEKPKQESQSCSGSRDGLQSRLHRLSKVVSEAQWRHKVVTSNHRSEEQPSRRYQPATRHPSLRRGRRTRRSQADGRDRGSNPSLESTSSELSTSTSEGSLSAMSGRNELHSRLHPHPQSSLIPMMFSPPESLLASCILRGNFAEAHQVLFTFNLKSSPSSGELMFMERYQEVIQELAQVEHKIENQNSDAGSSTIRRTGSGRSTLQAIGSAAAAGMVFYSISDVTDKLLNTSGDPIPMLQEDFWISTALVEPTAPLREVLEDLSPPAMAAFDLACSQCQLWKTCKQLLETAERRLNSSLERRGRRIDHVLLNADGIRGFPVVLQQISKSLNYLLMSASQTKSESVEEKGGGPPRCSITELLQMCWPSLSEDCVASHTTLSQQLDQVLQSLREALELPEPRTPPLSSLVEQAAQKAPEAEAHPVQIQTQLLQKNLGKQTPSGSRQMDYLGTFFSYCSTLAAVLLQSLSSEPDHVEVKVGNPFVLLQQSSSQLVSHLLFERQVPPERLAALLAQENLSLSVPQVIVSCCCEPLALCSSRQSQQTSSLLTRLGTLAQLHASHCLDDLPLSTPSSPRTTENPTLERKPYSSPRDSSLPALTSSALAFLKSRSKLLATVACLGASPRLKVSKPSLSWKELRGRREVPLAAEQVARECERLLEQFPLFEAFLLAAWEPLRGSLQQGQSLAVNLCGWASLSTVLLGLHSPIALDVLSEAFEESLVARDWSRALQLTEVYGRDVDDLSSIKDAVLSCAVACDKEGWQYLFPVKDASLRSRLALQFVDRWPLESCLEILAYCISDTAVQEGLKCELQRKLAELQVYQKILGLQSPPVWCDWQTLRSCCVEDPSTVMNMILEAQEYELCEEWGCLYPIPREHLISLHQKHLLHLLERRDHDKALQLLRRIPDPTMCLEVTEQSLDQHTSLATSHFLANYLTTHFYGQLTAVRHREIQALYVGSKILLTLPEQHRASYSHLSSNPLFMLEQLLMNMKVDWATVAVQTLQQLLVGQEIGFTMDEVDSLLSRYAEKALDFPYPQREKRSDSVIHLQEIVHQAADPETLPRSPSAEFSPAAPPGISSIHSPSLRERSFPPTQPSQEFVPPATPPARHQWVPDETESICMVCCREHFTMFNRRHHCRRCGRLVCSSCSTKKMVVEGCRENPARVCDQCYSYCNKDVPEEPSEKPEALDSSKNESPPYSFVVRVPKADEVEWILDLKEEENELVRSEFYYEQAPSASLCIAILNLHRDSIACGHQLIEHCCRLSKGLTNPEVDAGLLTDIMKQLLFSAKMMFVKAGQSQDLALCDSYISKVDVLNILVAAAYRHVPSLDQILQPAAVTRLRNQLLEAEYYQLGVEVSTKTGLDTTGAWHAWGMACLKAGNLTAAREKFSRCLKPPFDLNQLNHGSRLVQDVVEYLESTVRPFVSLQDDDYFATLRELEATLRTQSLSLAVIPEGKIMNNTYYQECLFYLHNYSTNLAIISFYVRHSCLREALLHLLNKESPPEVFIEGIFQPSYKSGKLHTLENLLESIDPTLESWGKYLIAACQHLQKKNYYHILYELQQFMKDQVRAAMTCIRFFSHKAKSYTELGEKLSWLLKAKDHLKIYLQETSRSSGRKKTTFFRKKMTAADVSRHMNTLQLQMEVTRFLHRCESAGTSQITTLPLPTLFGNNHMKMDVACKVMLGGKNVEDGFGIAFRVLQDFQLDAAMTYCRAARQLVEKEKYSEIQQLLKCVSESGMAAKSDGDTILLNCLEAFKRIPPQELEGLIQAIHNDDNKVRAYLICCKLRSAYLIAVKQEHSRATALVQQVQQAAKSSGDAVVQDICAQWLLTSHPRGAHGPGSRK

SEQ ID NO: 70933 - protein, 372 aa, Homo sapiens
MQTSEREGSGPELSPSVMPEAPLESPPFPTKSPAFDLFNLVLSYKRLEIYLEPLKDAGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 70934 - protein, 416 aa, Homo sapiens
MQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTESLSSQDLTPGSVEEAEEAEPDEEFKDAIEETHLVVLEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 70935 - protein, 318 aa, Homo sapiens
MQTSEREGSGPELSPSVMPEAPLESPPFPTKSPAFDLFNLVLSYKRLEIYLEPLKDAGDGVRYLLSLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 70936 - protein, 404 aa, Homo sapiens
MQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 70937 - protein, 311 aa, Homo sapiens
MISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTESLSSQDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 70938 - protein, 286 aa, Homo sapiens
MQTSEREGSGPELSPSVMPEAPLESPPFPTKSPAFDLFNLVLSYKRLEIYLEPLKDAGDGVRYLLRFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 70939 - protein, 411 aa, Homo sapiens
MQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEETHLVVLEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 70940 - protein, 394 aa, Homo sapiens
LESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTESLSSQDLTPGSVEEAEEAEPDEEFKDAIEETHLVVLEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 70941 - protein, 348 aa, Homo sapiens
MQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGVTGAGSS

SEQ ID NO: 70942 - protein, 887 aa, Homo sapiens
MMNRFRKWLYKPKRSDPQLLARFYYADEELNQVAAELDSLDGRKDPQRCTLLVSQFRSCQDNVLNIINQIMDECIPQDRAPRDFCVKFPEEIRHDNLAGQLWFGAECLAAGSIIMNRELESMAMRPLAKELTRSLEDVRGALRDQALRDLNTYTEKMREALRHFDVLFAEFELSYVSAMVPVKSPREYYVQQEVIVLFCETVERALDFGYLTQDMIDDYEPALMFSIPRLAIVCGLVVYADGPLNLDRKVEDMSELFRPFHTLLRKIRDLLQTLTEEELHTLERNLCISQDVEFPIRADVQGPAALAPALSAPLPPEGPLSAKAKDPDAELACSMQYDDQELEQLSRMVHRAGDEMSSLLSPPIACQSPAHRPGAEGSPGGEASPGRPRLRSGSDEEERVFFMDDVEGTAEALARPESPAGPFGWAGSTWADPQEKGQGGPGGAAGISLPASEKEEDLSNNNLEAEGTDGASLAGTSSCSCLDSRLHLDGWEVGADDAETAEMIAHRTGGMKLSATVIFNPKSPTSLDSAVATQEAASEPVAEGMDGGPHKLSTGATNCLLHSCVCCGSCGDSREDVVERLREKCSPGGVIGASYAAGLAKASDRAPERQEEAPPPSEDASNGREPKAPTSDKCLPHTSGSQVDTASGLQGEAGVAGQQEPEARELHAGSPSAHEAPQALSGSSSSTAGSCSSDKMGPEAAPAATHAAPQATREKIRSRFHGSHDLIHRLFVCISGVADQLQTNYASDLRSILKTLFEVMATKPETDDKEKLRKVTQTLRSAALEDCALCQETLSSSELAAKTRDGDFEDPPEWVPDEACGFCTACKAPFTVIRRKHHCRSCGKIFCSRCSSHSAPLPRYGQVKPVRVCTHCYMFHVTPFYSDKAGL

SEQ ID NO: 70943 - protein, 857 aa, Homo sapiens
MMNRFRKWLYKPKRSDPQLLARFYYADEELNQVAAELDSLDGRKDPQRCTLLVSQFRSCQDNVLNIINQIMDECIPQDRAPRDFCVKFPEEIRHDNLAGQLWFGAECLAAGSIIMNRELESMAMRPLAKELTRSLEDVRGALRDQALRDLNTYTEKMREALRHFDVLFAEFELSYVSAMVPVKSPREYYVQQEVIVLFCETVESGLVVYADGPLNLDRKVEDMSELFRPFHTLLRKIRDLLQTLTEEELHTLERNLCISQDVEFPIRADVQGPAALAPALSAPLPPEGPLSAKAKDPDAELACSMQYDDQELEQLSRMVHRAGDEMSSLLSPPIACQSPAHRPGAEGSPGGEASPGRPRLRSGSDEEERVFFMDDVEGTAEALARPESPAGPFGWAGSTWADPQEKGQGGPGGAAGISLPASEKEEDLSNNNLEAEGTDGASLAGTSSCSCLDSRLHLDGWEVGADDAETAEMIAHRTGGMKLSATVIFNPKSPTSLDSAVATQEAASEPVAEGMDGGPHKLSTGATNCLLHSCVCCGSCGDSREDVVERLREKCSPGGVIGASYAAGLAKASDRAPERQEEAPPPSEDASNGREPKAPTSDKCLPHTSGSQVDTASGLQGEAGVAGQQEPEARELHAGSPSAHEAPQALSGSSSSTAGSCSSDKMGPEAAPAATHAAPQATREKIRSRFHGSHDLIHRLFVCISGVADQLQTNYASDLRSILKTLFEVMATKPETDDKEKLRKVTQTLRSAALEDCALCQETLSSSELAAKTRDGDFEDPPEWVPDEACGFCTACKAPFTVIRRKHHCRSCGKIFCSRCSSHSAPLPRYGQVKPVRVCTHCYMFHVTPFYSDKAGL

SEQ ID NO: 70944 - protein, 817 aa, Homo sapiens
MDECIPQDRAPRDFCVKFPEEIRHDNLAGQLWFGAECLAAGSIIMNRELESMAMRPLAKELTRSLEDVRGALRDQALRDLNTYTEKMREALRHFDVLFAEFELSYVSAMVPVKSPREYYVQQEVIVLFCETVERALDFGYLTQDMIDDYEPALMFSIPRLAIVCGLVVYADGPLNLDRKVEDMSELFRPFHTLLRKIRDLLQTLTEEELHTLERNLCISQDVEFPIRADVQGPAALAPALSAPLPPEGPLSAKAKDPDAELACSMQYDDQELEQLSRMVHRAGDEMSSLLSPPIACQSPAHRPGAEGSPGGEASPGRPRLRSGSDEEERVFFMDDVEGTAEALARPESPAGPFGWAGSTWADPQEKGQGGPGGAAGISLPASEKEEDLSNNNLEAEGTDGASLAGTSSCSCLDSRLHLDGWEVGADDAETAEMIAHRTGGMKLSATVIFNPKSPTSLDSAVATQEAASEPVAEGMDGGPHKLSTGATNCLLHSCVCCGSCGDSREDVVERLREKCSPGGVIGASYAAGLAKASDRAPERQEEAPPPSEDASNGREPKAPTSDKCLPHTSGSQVDTASGLQGEAGVAGQQEPEARELHAGSPSAHEAPQALSGSSSSTAGSCSSDKMGPEAAPAATHAAPQATREKIRSRFHGSHDLIHRLFVCISGVADQLQTNYASDLRSILKTLFEVMATKPETDDKEKLRKVTQTLRSAALEDCALCQETLSSSELAAKTRDGDFEDPPEWVPDEACGFCTACKAPFTVIRRKHHCRSCGKIFCSRCSSHSAPLPRYGQVKPVRVCTHCYMFHVTPFYSDKAGL

SEQ ID NO: 70945 - protein, 403 aa, Homo sapiens
MEPAGPCGFCPAGEVQPARYTCPRCNAPYCSLRCYRTHGTCAENFYRDQVLGELRGCSAPPSRLASALRRLRQQRETEDEPGEAGLSSGPAPGGLSGLWERLAPGEKAAFERLLSRGEAGRLLPPWRPWWWNRGAGPQLLEELDNAPGSDAAELELAPARTPPDSVKDASAAEPAAAERVLGDVPGACTPVVPTRIPAIVSLSRGPVSPLVRFQLPNVLFAYAHTLALYHGGDDALLSDFCATLLGVSGALGAQQVFASAEEALQAAAHVLEAGEHPPGPLGTRGAMHEVARILLGEGPTNQKGYTLAALGDLAQTLGRARKQAVAREERDHLYRARKKCQFLLAWTNENEAALTPLALDCARAHQAHAVVAEEVAALTGELERLWGGPVPPAPRTLIEELPS

SEQ ID NO: 70946 - protein, 155 aa, Homo sapiens
MASLKCSTVVCVICLEKPKYRCPACRVPYCSVVCFRKHKEQCNPETRPVEKKIRSALPTKTVKPVENKDDDDSIADFLNSDEEEDRVSLQNLKNLGESATLRSLLLNPHLRQLMVNLDQGEDKAKLMRAYMQEPLFVEFADCCLGIVEPSQNEES

SEQ ID NO: 70947 - protein, 1377 aa, Homo sapiens
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKVNAGMGNSGITTEPDSEIQIANVTTLETGVSSVNDGQLENTDGRDMNLMITHVTSLQNTNLGDVSNGLQSSNFGVNIQTYTPSLTSQTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSFSHKPAPKKLCVMCKKDITTMKGTIVAQVDSSESFQEFCSTSCLSLYEDKQNPTKGALNKSRCTICGKLTEIRHEVSFKNMTHKLCSDHCFNRYRMANGLIMNCCEQCGEYLPSKGAGNNVLVIDGQQKRFCCQSCVSEYKQVGSHPSFLKEVRDHMQDSFLMQPEKYGKLTTCTGCRTQCRFFDMTQCIGPNGYMEPYCSTACMNSHKTKYAKSQSLGIICHFCKRNSLPQYQATMPDGKLYNFCNSSCVAKFQALSMQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSVIIETDIIGSDLLKNSDPETQSSMPDVPYEPDLDIEIDFPRAAEELDMENEFLLPPVFGEEYEEQPRPRSKKKGAKRKAVSGYQSHDDSSDNSECSFPFKYTYGVNAWKHWVKTRQLDEDLLVLDELKSSKSVKLKEDLLSHTTAELNYGLAHFVNEIRRPNGENYAPDSIYYLCLGIQEYLCGSNRKDNIFIDPGYQTFEQELNKILRSWQPSILPDGSIFSRVEEDYLWRIKQLGSHSPVALLNTLFYFNTKYFGLKTVEQHLRLSFGTVFRHWKKNPLTMENKACLRYQVSSLCGTDNEDKITTGKRKHEDDEPVFEQIENTANPSRCPVKMFECYLSKSPQNLNQRMDVFYLQPECSSSTDSPVWYTSTSLDRNTLENMLVRVLLVKDIYDKDNYELDEDTD

SEQ ID NO: 70948 - protein, 1375 aa, Homo sapiens
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKVNAGMGNSGITTEPDSEIQIANVTTLETGVSSVNDGQLENTDGRDMNLMITHVTSLQNTNLGDVSNGLQSSNFGVNIQTYTPSLTSQTKTGVGPFNPGRMNVAGDVFQNGESATHHNPDSWISQSASFPRNQKQPGVDSLSPVASLPKQIFQPSVQQQPTKPVKVTCANCKKPLQKGQTAYQRKGSAHLFCSTTCLSSFSHKPAPKKLCVMCKKDITTMKGTIVAQVDSSESFQEFCSTSCLSLYEDKQNPTKGALNKSRCTICGKLTEIRHEVSFKNMTHKLCSDHCFNRYRMANGLIMNCCEQCGEYLPSKGAGNNVLVIDGQQKRFCCQSCVSEYKQVGSHPSFLKEVRDHMQDSFLMQPEKYGKLTTCTGCRTQCRFFDMTQCIGPNGYMEPYCSTACMNSHKTKYAKSQSLGIICHFCKRNSLPQYQATMPDGKLYNFCNSSCVAKFQALSMQSSPNGQFVAPSDIQLKCNYCKNSFCSKPEILEWEASLHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKACDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDDTWRTEYVPVPIPVPVYIPVPMHMYSQNIPVPTTVPVPVPVPVFLPAPLDSSEKIPAAIEELKSKVSSDALDTELLTMTDMMSEDEGKTETTNINSVIIETDIIGSDLLKNSDPETQSSMPDVPYEPDLDIEIDFPRAAEELDMENEFLLPPVFGEEYEEQPRPRSKKKGAKRKAVSGYQSHDDSSDNSECSFPFKYTYGVNAWKHWVKTRQLDEDLLVLDELKSSKSVKLKEDLLSHTTAELNYGLAHFVNEIRRPNGENYAPDSIYYLCLGIQEYLCGSNRKDNIFIDPGYQTFEQELNKILRSWQPSILPDGSIFSRVEEDYLWRIKQLGSHSPVALLNTLFYFNTKYFGLKTVEQHLRLSFGTVFRHWKKNPLTMENKACLRYQVSSLCGTDNEDKITTGKRKHEDDEPVFEQIENTANPSRCPVKMFECYLSKSPQNLNQRMDVFYLQPECSSSTDSPVWYTSTSLDRNTLENMLVRVLLVKDIYDKDNYELDEDTD

SEQ ID NO: 70949 - protein, 1375 aa, Homo sapiens; identical to SEQ ID NO: 70948

SEQ ID NO: 70950 - protein, 377 aa, Homo sapiens
MQDSFLMQPEKYGKLTTCTGCRTQCRFFDMTQCIGPNGYMEPYCSTACMNSHKTKYAKSQSLGIICHFCKRNSLPQYQATMPDGKLYNFCNSSCVAKFQALSMQSSPNGQFVAPSDIQLKCNYCKNSFCSKPEILEWENKVHQFCSKTCSDDYKKLHCIVTYCEYCQEEKTLHETVNFSGVKRPFCSEGCKLLYKQDFARRLGLRCVTCNYCSQLCKKGATKELDGVVRDFCSEDCCKKFQDWYYKAARCDCCKSQGTLKERVQWRGEMKHFCDQHCLLRFYCQQNEPNMTTQKGPENLHYDQGCQTSRTKMTGSAPPPSPTPNKEMKNKAVLCKPLTMTKATYCKPHMQTKSCQTDITWRIQHLILNHYDQSLIKA

SEQ ID NO: 70951 - protein, 1377 aa, Homo sapiens; identical to SEQ ID NO: 70947

SEQ ID NO: 70952 - protein, 1370 aa, Homo sapiens
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKKNTRVYPCVWCKTLCKNFEMLSHVDRNGKTSLFCSLCCTTSYKVKQAGLTGPPRPCSFCRRSLSDPCYYNKVDRTVYQFCSPSCWTKFQRTSPEGGIHLSCHYCHSLFSGKPEVLDWQDQVFQFCCRDCCEDFKRLRGVVSQCEHCRQEKLLHEKLRFSGVEKSFCSEGCVLLYKQDFTKKLGLCCITCTYCSQTCQRGVTEQLDGSTWDFCSEDCKSKYLLWYCKAARCHACKRQGKLLETIHWRGQIRHFCNQQCLLRFYSQQNQPNLDTQSGPESLLNSQSPESKPQTPSQTKVENSNTVRTPEENGNLGKIPVKTRSAPTAPTPPPPPPPATPRKNKAAMCKPLMQNRGVSCKVEMKSKGSQTEEWKPQVIVLPIPVPIFVPVPMHLYCQKVPVPFSMPIPVPVPMFLPTTLESTDKIVETIEELKVKIPSNPLEADILAMAEMIAEAEELDKASSDLCDLVSNQSAEGLLEDCDLFGPARDDVLAMAVKMANVLDEPGQDLEADFPKNPLDINPSVDFLFDCGLVGPEDVSTEQDLPRTMRKGQKRLVLSESCSRDSMSSQPSCTGLNYSYGVNAWKCWVQSKYANGETSKGDELRFGPKPMRIKEDILACSAAELNYGLAQFVREITRPNGERYEPDSIYYLCLGIQQYLLENNRMVNIFTDLYYLTFVQELNKSLSTWQPTLLPNNTVFSRVEEEHLWECKQLGVYSPFVLLNTLMFFNTKFFGLQTAEEHMQLSFTNVVRQSRKCTTPRGTTKVVSIRYYAPVRQRKGRDTGPGKRKREDEAPILEQRENRMNPLRCPVKFYEFYLSKCPESLRTRNDVFYLQPERSCIAESPLWYSVIPMDRSMLESMLNRILAVREIYEELGRPGEEDLD

SEQ ID NO: 70953 - protein, 1370 aa, Homo sapiens; identical to SEQ ID NO: 70952

SEQ ID NO: 70954 - protein, 349 aa, Homo sapiens
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERVQKRSERVRRAEPPKPEVVDSTESRRSGTPRTRLWRRLVLEAPSMSSAHPSVSPCMRPSSSARSPSLGIPPTLLAAAYARRLERSCTRSAMAAWYTGSAAILASPNSGPTRD

SEQ ID NO: 70955 - protein, 495 aa, Homo sapiens
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKVGPRE

SEQ ID NO: 70956 - protein, 497 aa, Homo sapiens
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERVQKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKVGPRE

SEQ ID NO: 70957 - protein, 1280 aa, Homo sapiens
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERVQKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKKNTRVYPCVWCKTLCKNFEMLSHVDRNGKTSLFCSLCCTTSYKVKQAGLTGPPRPCSFCRRSLSDPCYYNKVDRTVYQFCSPSCWTKFQRTSPEGGIHLSCHYCHSLFSGKPEVLDWQDQVFQFCCRDCCEDFKRLRGVVSQCEHCRQEKLLHEKLRFSGVEKSFCSEGCVLLYKQDFTKKLGLCCITCTYCSQTCQRGVTEQLDGSTWDFCSEDCKSKYLLWYCKAARCHACKRQGKLLETIHWRGQIRHFCNQQCLLRFYSQQNQPNLDTQSGPESLLNSQSPESKPQTPSQTKVENSNTVRTPEENGNLGKIPVKTRSAPTAPTPPPPPPPATPRKNKAAMCKPLMQNRGVSCKVEMKSKGSQTEEWKPQVIVLPIPVPIFVPVPMHLYCQKVPVPFSMPIPVPVPMFLPTTLESTDKIVETIEELKVKIPSNPLEADILAMAEMIAEAEELDKASSDLCDLVSNQSAEGLLEDCDLFGPARDDVLAMAVKMANVLDEPGQDLEADFPKNPLDINPSVDFLFDCGLVGPEDVSTEQDLPRTMRKGQKRLVLSESCSRDSMSSQPSCTGLNYSYGVNAWKCWVQSKYANGETSKAKPMRIKEDILACSAAELNYGLAQFVREITRPNGERYEPDSIYYLCLGIQQYLLENNRMVNIFTDLYYLTFVQELNKSLSTWQPTLLPNNTGPGKRKREDEAPILEQRENRMNPLRCPVKFYEFYLSKCPESLRTRNDVFYLQPERSCIAESPLWYSVIPMDRSMLESMLNRILAVREIYEELGRPGEEDLD

SEQ ID NO: 70958 - protein, 1372 aa, Homo sapiens
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERVQKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKKNTRVYPCVWCKTLCKNFEMLSHVDRNGKTSLFCSLCCTTSYKVKQAGLTGPPRPCSFCRRSLSDPCYYNKVDRTVYQFCSPSCWTKFQRTSPEGGIHLSCHYCHSLFSGKPEVLDWQDQVFQFCCRDCCEDFKRLRGVVSQCEHCRQEKLLHEKLRFSGVEKSFCSEGCVLLYKQDFTKKLGLCCITCTYCSQTCQRGVTEQLDGSTWDFCSEDCKSKYLLWYCKAARCHACKRQGKLLETIHWRGQIRHFCNQQCLLRFYSQQNQPNLDTQSGPESLLNSQSPESKPQTPSQTKVENSNTVRTPEENGNLGKIPVKTRSAPTAPTPPPPPPPATPRKNKAAMCKPLMQNRGVSCKVEMKSKGSQTEEWKPQVIVLPIPVPIFVPVPMHLYCQKVPVPFSMPIPVPVPMFLPTTLESTDKIVETIEELKVKIPSNPLEADILAMAEMIAEAEELDKASSDLCDLVSNQSAEGLLEDCDLFGPARDDVLAMAVKMANVLDEPGQDLEADFPKNPLDINPSVDFLFDCGLVGPEDVSTEQDLPRTMRKGQKRLVLSESCSRDSMSSQPSCTGLNYSYGVNAWKCWVQSKYANGETSKGDELRFGPKPMRIKEDILACSAAELNYGLAQFVREITRPNGERYEPDSIYYLCLGIQQYLLENNRMVNIFTDLYYLTFVQELNKSLSTWQPTLLPNNTVFSRVEEEHLWECKQLGVYSPFVLLNTLMFFNTKFFGLQTAEEHMQLSFTNVVRQSRKCTTPRGTTKVVSIRYYAPVRQRKGRDTGPGKRKREDEAPILEQRENRMNPLRCPVKFYEFYLSKCPESLRTRNDVFYLQPERSCIAESPLWYSVIPMDRSMLESMLNRILAVREIYEELGRPGEEDLD

SEQ ID NO: 70959 - protein, 1358 aa, Homo sapiens
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERKRSERVRRAEPPKPEVVDSTESIPVSDEDSDAMVDDPNDEDFVPFRPRRSPRMSLRSSVSQRAGRSAVGTKMTCAHCRTPLQKGQTAYQRKGLPQLFCSSSCLTTFSKKPSGKKTCTFCKKEIWNTKDSVVAQTGSGGSFHEFCTSVCLSLYEAQQQRPIPQSGDPADATRCSICQKTGEVLHEVSNGSVVHRLCSDSCFSKFRANKGLKTNCCDQCGAYIYTKTGSPGPELLFHEGQQKRFCNTTCLGAYKKKNTRVYPCVWCKTLCKNFEMLSHVDRNGKTSLFCSLCCTTSYKVKQAGLTGPPRPCSFCRRSLSDPCYYNKVDRTVYQFCSPSCWTKFQRTSPEGGIHLSCHYCHSLFSGKPEVLDWQDQVFQFCCRDCCEDFKRLRGVVSQCEHCRQEKLLHEKLRFSGVEKSFCSEGCVLLYKQDFTKKLGLCCITCTYCSQTCQRGVTEQLDGSTWDFCSEDCKSKYLLWYCKAARCHACKRQGKLLETIHWRGQIRHFCNQQCLLRFYSQQNQPNLDTQSGPESLLNSQSPESKPQTPSQTKVENSNTIPVKTRSAPTAPTPPPPPPPATPRKNKAAMCKPLMQNRGVSCKVEMKSKGSQTEEWKPQVIVLPIPVPIFVPVPMHLYCQKVPVPFSMPIPVPVPMFLPTTLESTDKIVETIEELKVKIPSNPLEADILAMAEMIAEAEELDKASSDLCDLVSNQSAEGLLEDCDLFGPARDDVLAMAVKMANVLDEPGQDLEADFPKNPLDINPSVDFLFDCGLVGPEDVSTEQDLPRTMRKGQKRLVLSESCSRDSMSSQPSCTGLNYSYGVNAWKCWVQSKYANGETSKGDELRFGPKPMRIKEDILACSAAELNYGLAQFVREITRPNGERYEPDSIYYLCLGIQQYLLENNRMVNIFTDLYYLTFVQELNKSLSTWQPTLLPNNTVFSRVEEEHLWECKQLGVYSPFVLLNTLMFFNTKFFGLQTAEEHMQLSFTNVVRQSRKCTTPRGTTKVVSIRYYAPVRQRKGRDTGPGKRKREDEAPILEQRENRMNPLRCPVKFYEFYLSKCPESLRTRNDVFYLQPERSCIAESPLWYSVIPMDRSMLESMLNRILAVREIYEELGRPGEEDLD

SEQ ID NO: 70960 - protein, 703 aa, Homo sapiens; identical to SEQ ID NO: 70244

SEQ ID NO: 70961 - protein, 742 aa, Homo sapiens
MEFVSGYRDEFLDFTALLFGWFRKFVAERGAVGTSLEGRCRQLEAQIRRLPQDPALWVLHVLPNHSVGISLGQGAEPGPGPGLGTAWLLGDNPPLHLRDLSPYISFVSLEDGEEGEEEEEEDEEEEKREDGGAGSTEKVEPEEDRELAPTSRESPQETNPPGESEEAAREAGGGKDGCREDRVENETRPQKRKGQRSEAAPLHVSCLLLVTDEHGTILGIDLLVDGAQGTASWGSGTKDLAPWAYALLCHSMACPMGSGDPRKPRQLTVGDARLHRELESLVPRLGVKLAKTPMRTWGPRPGFTFASLRARTCHVCHRHSFEAKLTPCPQCSAVLYCGEACLRADWQRCPDDVSHRFWCPRLAAFMERAGELATLPFTYTAEVTSETFNKEAFLASRGLTRGYWTQLSMLIPGPGFSRHPRGNTPSLSLLRGGDPYQLLQGDGTALMPPVPPHPPRGVFGSWQDYYTWRGLSLDSPIAVLLTYPLTVYYVITHLVPQSFPELNIQNKQSLKIHVVEAGKEFDLVMVFWELLVLLPHVALELQFVGDGLPPESDEQHFTLQRDSLEVSVRPGSGISARPSSGTKEKGGRRDLQIKVSARPYHLFQGPKPDLVIGFNSGFALKDTWLRSLPRLQSLRVPAFFTESSEYSCVMDGQTMAVATGGGTSPPQPNPFRSPFRLRAADNCMSWYCNAFIFHLVYKPAQGSGARPAPGPPPPSPTPSAPPAPTRRRRGEKKPGRGARRRK

SEQ ID NO: 70962 - protein, 227 aa, Homo sapiens
MTDFKLGIVRLGRVAGKTKYTLIDEQDIPLVESYSFEARMEVDADGNGAKIFAYAFDKNRGRGSGRLLHELLWERHRGGVAPGFQVVHLNAVTVDNRLDNLQLVPWGWRPKAEETSSKQREQSLYWLAIQQLPTDPIEEQFPVLNVTRYYNANGDVVEEEENSCTYYECHYPPCTVIEKQLREFNICGRCQVARYCGSQCQQKDWPAHKKHCRERKRPFQHELEPER

SEQ ID NO: 70963 - protein, 708 aa, Homo sapiens
MSERGIKWACEYCTYENWPSAIKCTMCRAQRPSGTIITEDPFKSGSSDVGRDWDPSSTEGGSSPLICPDSSARPRVKSSYSMENANKWSCHMCTYLNWPRAIRCTQCLSQRRTRSPTESPQSSGSGSRPVAFSVDPCEEYNDRNKLNTRTQHWTCSVCTYENWAKAKRCVVCDHPRPNNIEAIELAETEEASSIINEQDRARWRGSCSSGNSQRRSPPATKRDSEVKMDFQRIELAGAVGSKEELEVDFKKLKQIKNRMKKTDWLFLNACVGVVEGDLAAIEAYKSSGGDIARQLTADEVRLLNRPSAFDVGYTLVHLAIRFQRQDMLAILLTEVSQQAAKCIPAMVCPELTEQIRREIAASLHQRKGDFACYFLTDLVTFTLPADIEDLPPTVQEKLFDEVLDRDVQKELEEESPIINWSLELATRLDSRLYALWNRTAGDCLLDSVLQATWGIYDKDSVLRKALHDSLHDCSHWFYTRWKDWESWYSQSFGLHFSLREEQWQEDWAFILSLASQPGASLEQTHIFVLAHILRRPIIVYGVKYYKSFRGETLGYTRFQGVYLPLLWEQSFCWKSPIALGYTRGHFSALVAMENDGYGNRGAGANLNTDDDVTITFLPLVDSERKLLHVHFLSAQELGNEEQQEKLLREWLDCCVTEGGVLVAMQKSSRRRNHPLVTQMVEKWLDRYRQIRPCTSLSDGEEDEDDEDE

SEQ ID NO: 70964 - protein, 799 aa, Homo sapiens
MEIPKLLPARGTLQGGGGGGIPAGGGRVHRGPDSPAGQVPTRRLLLPRGPQDGGPGRRREEASTASRGPGPSLFAPRPHQPSGGGDDFFLVLLDPVGGDVETAGSGQAAGPVLREEAKAGPGLQGDESGANPAGCSAQGPHCLSAVPTPAPISAPGPAAAFAGTVTIHNQDLLLRFENGVLTLATPPPHAWEPGAAPAQQPRCLIAPQAGFPQAAHPGDCPELRSDLLLAEPAEPAPAPAPQEEAEGLAAALGPRGLLGSGPGVVLYLCPEALCGQTFAKKHQLKMHLLTHSSSQGQRPFKCPLGGCGWTFTTSYKLKRHLQSHDKLRPFGCPAEGCGKSFTTVYNLKAHMKGHEQENSFKCEVCEESFPTQAKLGAHQRSHFEPERPYQCAFSGCKKTFITVSALFSHNRAHFREQELFSCSFPGCSKQYDKACRLKIHLRSHTGERPFLCDFDGCGWNFTSMSKLLRHKRKHDDDRRFMCPVEGCGKSFTRAEHLKGHSITHLGTKPFVCPVAGCCARFSARSSLYIHSKKHLQDVDTWKSRCPISSCNKLFTSKHSMKTHMVKRHKVGQDLLAQLEAANSLTPSSELTSQRQNDLSDAEIVSLFSDVPDSTSAALLDTALVNSGILTIDVASVSSTLAGHLPANNNNSVGQAVDPPSLMATSDPPQSLDTSLFFGTAATGFQQSSLNMDEVSSVSVGPLGSLDSLAMKNSSPEPQALTPSSKLTVDTDTLTPSSTLCENSVSELLTPAKAEWSVHPNSDFFGQEGETQFGFPNAAGNHGSQKERNLITVTGSSFLV

SEQ ID NO: 70965 - protein, 803 aa, Homo sapiens
MEIPKLLPARGTLQGGGGGGIPAGGGRVHRGPDSPAGQVPTRRLLLLRGPQDGGPGRRREEASTASRGPGPSLLAPRTDQPSGGGGGGGDDFFLVLLDPVGGDVETAGSGQAAGPVLREEAEEGPGLQGGESGANPAGPTALGPRCLSAVPTPAPISAPGPAAAFAGTVTIHNQDLLLRFENGVLTLATPPPHAWEPGAAPAQQPGCLIAPQAGFPHAAHPGDCPELPPDLLLAEPAEPAPAPAPEEEAEGPAAALGPRGPLGSGPGVVLYLCPEAQCGQTFAKKHQLKVHLLTHSSSQGQRPFKCPLGGCGWTFTTSYKLKRHLQSHDKLRPFGCPAEGCGKSFTTVYNLKAHMKGHEQENSFKCEVCEESFPTQAKLSAHQRSHFEPERPYQCAFSGCKKTFITVSALFSHNRAHFREQELFSCSFPGCSKQYDKACRLKIHLRSHTGERPFLCDFDGCGWNFTSMSKLLRHKRKHDDDRRFMCPVEGCGKSFTRAEHLKGHSITHLGTKPFVCPVAGCCARFSARSSLYIHSKKHLQDVDTWKSRCPISSCNKLFTSKHSMKTHMVKRHKVGQDLLAQLEAANSLTPSSELTSQRQNDLSDAEIVSLFSDVPDSTSAALLDTALVNSGILTIDVASVSSTLAGHLPANNNNSVGQAVDPPSLMATSDPPQSLDTSLFFGTAATGFQQSSLNMDEVSSVSVGPLGSLDSLAMKNSSPEPQALTPSSKLTVDTDALTPSSTLCENSVSELLTPTKAEWNVHPDSDFFGQEGETQFGFPNAAGNHGSQKETDLITVTGSSFLV

SEQ ID NO: 70966 - protein, 873 aa, Homo sapiens
MASRRKSTTPCMVLASEQDPDLELISDLDEGPPVLTPVENTRAESISSDEEVHESVDSDNQQNKKVEGGYECKYCTFQTPDLNMFTFHVDSEHPNVVLNSSYVCVECNFLTKRYDALSEHNLKYHPGEENFKLTMVKRNNQTIFEQTINDLTFDGSFVKEENAEQAESTEVSSSGISISKTPIMKMMKNKVENKRIAVHHNSVEDVPEEKENEIKPDREEIVENPSSSASESNTSTSIVNRIHPSTASTVVTPAAVLPGLAQVITAVSAQQNSNLIPKVLIPVNSIPTYNAALDNNPLLLNTYNKFPYPTMSEITVLSAQAKYTEEQIKIWFSAQRLKHGVSWTPEEVEEARRKQFNGTVHTVPQTITVIPTHISTGSNGLPSILQTCQIVGQPGLVLTQVAGTNTLPVTAPIALTVAGVPSQNNIQKSQVPAAQPTAETKPATAAVPTSQSVKHETALVNPDSFGIRAKKTKEQLAELKVSYLKNQFPHDSEIIRLMKITGLTKGEIKKWFSDTRYNQRNSKSNQCLHLNNDSSTTIIIDSSDETTESPTVGTAQPKQSWNPFPDFTPQKFKEKTAEQLRVLQASFLNSSVLTDEELNRLRAQTKLTRREIDAWFTEKKKSKALKEEKMEIDESNAGSSKEEAGETSPADESGAPKSGSTGKICKKTPEQLHMLKSAFVRTQWPSPEEYDKLAKESGLARTDIVSWFGDTRYAWKNGNLKWYYYYQSANSSSMNGLSSLRKRGRGRPKGRGRGRPRGRPRGSKRINNWDRGPSLIKFKTGTAILKDYYLKHKFLNEQDLDELVNKSHMGYEQVREWFAERQRRSELGIELFEENEEEDEVIDDQEEDEEETDDSDTWEPPRHVKRKLSKSDD

SEQ ID NO: 70967 - protein, 873 aa, Homo sapiens; identical to SEQ ID NO: 70966

SEQ ID NO: 70968 - protein, 873 aa, Homo sapiens; identical to SEQ ID NO: 70966

SEQ ID NO: 70969 - protein, 498 aa, Homo sapiens
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHMNSEHTDFNKDPTFVCSGCSFLAKTPEGLSLHNATCHSGEASFVWNVAKPDNHVVVEQSIPESTSTPDLAGEPSAEGADGQAEIIITKTPIMKIMKGKAEAKKIHTLKENVPSQPVGEALPKLSTGEMEVREGDHSFINGAVPVSQASASSAKNPHAANGPLIGTVPVLPAGIAQFLSLQQQPPVHAQHHVHQPLPTAKALPKVMIPLSSIPTYNAAMDSNSFLKNSFHKFPYPTKAELCYLTVVTKYPEEQLKIWFTAQRLKQGISWSPEEIEDARKKMFNTVIQSVPQPTITVLNTPLVASAGNVQHLIQAALPGHVVGQPEGTGGGLLVTQPLMANGLQATSSPLPLTVTSVPKQPGVAPINTVCSNTTSAVKVVNAAQSLLTACPSITSQAFLDASIYK

SEQ ID NO: 70970 - protein, 96 aa, Homo sapiens
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHM

SEQ ID NO: 70971 - protein, 747 aa, Homo sapiens
MEVREGDHSFINGAVPVSQASASSAKNPHAANGPLIGTVPVLPAGIAQFLSLQQQPPVHAQHHVHQPLPTAKALPKVMIPLSSIPTYNAAMDSNSFLKNSFHKFPYPTKAELCYLTVVTKYPEEQLKIWFTAQRLKQGISWSPEEIEDARKKMFNTVIQSVPQPTITVLNTPLVASAGNVQHLIQAALPGHVVGQPEGTGGGLLVTQPLMANGLQATSSPLPLTVTSVPKQPGVAPINTVCSNTTSAVKVVNAAQSLLTACPSITSQAFLDASIYKNKKSHEQLSALKGSFCRNQFPGQSEVEHLTKVTGLSTREVRKWFSDRRYHCRNLKGSRAMIPGDHSSIIIDSVPEVSFSPSSKVPEVTCIPTTATLATHPSAKRQSWHQTPDFTPTKYKERAPEQLRALESSFAQNPLPLDEELDRLRSETKMTRREIDSWFSERRKKVNAEETKKAEENASQEEEEAAEDEGGEEDLASELRVSGENGSLEMPSSHILAERKVSPIKINLKNLRVTEANGRNEIPGLGACDPEDDESNKLAEQLPGKVSCKKTAQQRHLLRQLFVQTQWPSNQDYDSIMAQTGLPRPEVVRWFGDSRYALKNGQLKWYEDYKRGNFPPGLLVIAPGNRELLQDYYMTHKMLYEEDLQNLCDKTQMSSQQVKQWFAEKMGEETRAVADTGSEDQGPGTGELTAVHKGMGDTYSEVSENSESWEPRVPEASSEPFDTSSPQAGRQLGSWSLSSQPLPSLLTL

SEQ ID NO: 70972 - protein, 956 aa, Homo sapiens
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHMNSEHTDFNKDPTFVCSGCSFLAKTPEGLSLHNATCHSGEASFVWNVAKPDNHVVVEQSIPESTSTPDLAGEPSAEGADGQAEIIITKTPIMKIMKGKAEAKKIHTLKENVPSQPVGEALPKLSTGEMEVREGDHSFINGAVPVSQASASSAKNPHAANGPLIGTVPVLPAGIAQFLSLQQQPPVHAQHHVHQPLPTAKALPKVMIPLSSIPTYNAAMDSNSFLKNSFHKFPYPTKAELCYLTVVTKYPEEQLKIWFTAQRLKQGISWSPEEIEDARKKMFNTVIQSVPQPTITVLNTPLVASAGNVQHLIQAALPGHVVGQPEGTGGGLLVTQPLMANGLQATSSPLPLTVTSVPKQPGVAPINTVCSNTTSAVKVVNAAQSLLTACPSITSQAFLDASIYKNKKSHEQLSALKGSFCRNQFPGQSEVEHLTKVTGLSTREVRKWFSDRRYHCRNLKGSRAMIPGDHSSIIIDSVPEVSFSPSSKVPEVTCIPTTATLATHPSAKRQSWHQTPDFTPTKYKERAPEQLRALESSFAQNPLPLDEELDRLRSETKMTRREIDSWFSERRKKVNAEETKKAEENASQEEEEAAEDEGGEEDLASELRVSGENGSLEMPSSHILAERKVSPIKINLKNLRVTEANGRNEIPGLGACDPEDDESNKLAEQLPGKVSCKKTAQQRHLLRQLFVQTQWPSNQDYDSIMAQTGLPRPEVVRWFGDSRYALKNGQLKWYEDYKRGNFPPGLLVIAPGNRELLQDYYMTHKMLYEEDLQNLCDKTQMSSQQVKQWFAEKMGEETRAVADTGSEDQGPGTGELTAVHKGMGDTYSEVSENSESWEPRVPEASSEPFDTSSPQAGRQLETD

SEQ ID NO: 70973 - protein, 46 aa, Homo sapiens
MASKRKSTTPCMIPVKTVVLQDASMEAQPAETLPEGPQQDLPPEAS

SEQ ID NO: 70974 - protein, 498 aa, Homo sapiens; identical to SEQ ID NO: 70969

SEQ ID NO: 70975 - protein, 48 aa, Homo sapiens
MASKRKSTTPCMIPVKTVVLQDASMEAQPAETLPEGPQQDLPPEASAA

SEQ ID NO: 70976 - protein, 90 aa, Homo sapiens
MASKRKSTTPCMIPVKTVVLQDASMEAQPAETLPEGPQQDLPPEASAASSEAAQNPSSTDGSTLANGHRSTLDGYLYSCKYCDFRSHDMT

SEQ ID NO: 70977 - protein, 118 aa, Homo sapiens
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHMNSEHTDFNKDPTFVCSGCSFLA

SEQ ID NO: 70978 - protein, 956 aa, Homo sapiens; identical to SEQ ID NO: 70972

SEQ ID NO: 70979 - protein, 969 aa, Homo sapiens
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHMNSEHTDFNKDPTFVCSGCSFLAKTPEGLSLHNATCHSGEASFVWNVAKPDNHVVVEQSIPESTSTPDLAGEPSAEGADGQAEIIITKTPIMKIMKGKAEAKKIHTLKENVPSQPVGEALPKLSTGEMEVREGDHSFINGAVPVSQASASSAKNPHAANGPLIGTVPVLPAGIAQFLSLQQQPPVHAQHHVHQPLPTAKALPKVMIPLSSIPTYNAAMDSNSFLKNSFHKFPYPTKAELCYLTVVTKYPEEQLKIWFTAQRLKQGISWSPEEIEDARKKMFNTVIQSVPQPTITVLNTPLVASAGNVQHLIQAALPGHVVGQPEGTGGGLLVTQPLMANGLQATSSPLPLTVTSVPKQPGVAPINTVCSNTTSAVKVVNAAQSLLTACPSITSQAFLDASIYKNKKSHEQLSALKGSFCRNQFPGQSEVEHLTKVTGLSTREVRKWFSDRRYHCRNLKGSRAMIPGDHSSIIIDSVPEVSFSPSSKVPEVTCIPTTATLATHPSAKRQSWHQTPDFTPTKYKERAPEQLRALESSFAQNPLPLDEELDRLRSETKMTRREIDSWFSERRKKVNAEETKKAEENASQEEEEAAEDEGGEEDLASELRVSGENGSLEMPSSHILAERKVSPIKINLKNLRVTEANGRNEIPGLGACDPEDDESNKLAEQLPGKVSCKKTAQQRHLLRQLFVQTQWPSNQDYDSIMAQTGLPRPEVVRWFGDSRYALKNGQLKWYEDYKRGNFPPGLLVIAPGNRELLQDYYMTHKMLYEEDLQNLCDKTQMSSQQKQTEFDLINVKDWPVWETACHVEEPNPTLCCHMPFPCPAAGHLGELPESSQTAQSLPLPSACPPPSKQQARWGSHQFFLPQCRTFPLPSNG

SEQ ID NO: 70980 - protein, 315 aa, Homo sapiens
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHMNSEHTDFNKDPTFVCSGCSFLAKTPEGLSLHNATCHSGEASFVWNVAKPDNHVVVEQSIPESTSTPDLAGEPSAEGADGQAEIIITKTPIMKIMKGKAEAKKIHTLKENVPSQPVGEALPKLSTGEMEKQTEFDLINVKDWPVWETACHVEEPNPTLCCHMPFPCPAAGHLGELPESSQTAQSLPLPSACPPPSKQQARWGSHQFFLPQCRTFPLPSNG

SEQ ID NO: 70981 - protein, 166 aa, Homo sapiens
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHMNSEHTDFNKDPTFVCSGCSFLAKTPEGLSLHNATCHSGEASFVWNVAKPDNHVVVEQSIPESTSTPDLAG

SEQ ID NO: 70982 - protein, 956 aa, Homo sapiens; identical to SEQ ID NO: 70972

SEQ ID NO: 70983 - protein, 956 aa, Homo sapiens; identical to SEQ ID NO: 70972

SEQ ID NO: 70984 - protein, 166 aa, Homo sapiens; identical to SEQ ID NO: 70981

SEQ ID NO: 70985 - protein, 475 aa, Homo sapiens
MGMWASLDALWEMPAEKRIFGAVLLFSWTVYLWETFLAQRQRRIYKTTTHVPPELGQIMDSETFEKSRLYQLDKSTFSFWSGLYSETEGTLILLFGGIPYLWRLSGRFCGYAGFGPEYEITQSLVFLLLATLFSALTGLPWSLYNTFVIEEKHGFNQQTLGFFMKDAIKKFVVTQCILLPVSSLLLYIIKIGGDYFFIYAWLFTLVVSLVLVTIYADYIAPLFDKFTPLPEGKLKEEIEVMAKSIDFPLTKVYVVEGSKRSSHSNAYFYGFFKNKRIVLFDTLLEEYSVLNKDIQEDSGMEPRNEEEGNSEEIKAKVKNKKQGCKNEEVLAVLGHELGHWKLGHTVKNIIISQMNSFLCFFLFAVLIGRKELFAAFGFYDSQPTLIGLLIIFQFIFSPYNEVLSFCLTVLSRRFEFQADAFAKKLGKAKDLYSALIKLNKDNLGFPVSDWLFSMWHYSHPPLLERLQALKTMKQH

SEQ ID NO: 70986 - protein, 338 aa, Homo sapiens
MMRTCVLLSAVLWCLTGVQCPRFTLFNKKGFIYGKTGQPDKIYVELHQNSPVLICMDFKLSKKEIVDPTYLWIGPNEKTLTGNNRINITETGQLMVKDFLEPLSGLYTCTLSYKTVKAETQEEKTVKKRYDFMVFAYREPDYSYQMAVRFTTRSCIGRYNDVFFRVLKKILDSLISDLSCHVIEPSYKCHSVEIPEHGLIHELFIAFQVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQYED

SEQ ID NO: 70987 - protein, 316 aa, Homo sapiens
MMRTCVLLSAVLWCLTGDKIYVELHQNSPVLICMDFKLSKKEIVDPTYLWIGPNEKTLTGNNRINITETGQLMVKDFLEPLSGLYTCTLSYKTVKAETQEEKTVKKRYDFMVFAYREPDYSYQMAVRFTTRSCIGRYNDVFFRVLKKILDSLISDLSCHVIEPSYKCHSVEIPEHGLIHELFIAFQVNPFAPGWKGACNGSVDCEDTTNHNILQARDRIEDFFRSQAYIFYHNFNKTLPAMHFVDHSLQVVRLDSCRPGFGKNERLHSNCASCCVVCSPATFSPDVNVTCQTCVSVLTYGAKSCPQTSNKNQQYED

SEQ ID NO: 70988 - protein, 638 aa, Homo sapiens
MAGGSATTWGYPVALLLLVATLGLGRWLQPDPGLPGLRHSYDCGIKGMQLLVFPRPGQTLRFKVVDEFGNRFDVNNCSICYHWVTSRPQEPAVFSADYRGCHVLEKDGRFHLRVFMEAVLPNGRVDVAQDATLICPKPDPSRTLDSQLAPPAMFSVSTPQTLSFLPTSGHTSQGSGHAFPSPLDPGHSSVHPTPALPSPGPGPTLATLAQPHWGTLEHWDVNKRDYIGTHLSQEQCQVASGHLPCIVRRTSKEACQQAGCCYDNTREVPCYYGNTATVQCFRDGYFVLVVSQEMALTHRITLANIHLAYAPTSCSPTQHTEAFVVFYFPLTHCGTTMQVAGDQLIYENWLVSGIHIQKGPQGSITRDSTFQLHVRCVFNASDFLPIQASIFPPPSPAPMTQPGPLRLELRIAKDETFSSYYGEDDYPIVRLLREPVHVEVRLLQRTDPNLVLLLHQCWGAPSANPFQQPQWPILSDGCPFKGDSYRTQMVALDGATPFQSHYQRFTVATFALLDSGSQRALRGLVYLFCSTSACHTSGLETCSTACSTGTTRQRRSSGHRNDTARPQDIVSSPGPVGFEDSYGQEPTLGPTDSNGNSSLRPLLWAVLLLPAVALVLGFGVFVGLSQTWAQKLWESNRQ

SEQ ID NO: 70989 - protein, 330 aa, Homo sapiens
MALTHRITLANIHLAYAPTSCSPTQHTEAFVVFYFPLTHCGTTMQVAGDQLIYENWLVSGIHIQKGPQGSITRDSTFQLHVRCVFNASDFLPIQASIFPPPSPAPMTQPGPLRLELRIAKDETFSSYYGEDDYPIVRLLREPVHVEVRLLQRTDPNLVLLLHQCWGAPSANPFQQPQWPILSDGCPFKGDSYRTQMVALDGATPFQSHYQRFTVATFALLDSGSQRALRGLVYLFCSTSACHTSGLETCSTACSTGTTRQRRSSGHRNDTARPQDIVSSPGPVGFEDSYGQEPTLGPTDSNGNSSLRPLLWAVLLLPAVALVLGFGVFVA

SEQ ID NO: 70990 - protein, 745 aa, Homo sapiens
MACRQRGGSWSPSGWFNAGWSTYRSISLFFALVTSGNSIDVSQLVNPAFPGTVTCDEREITVEFPSSPGTKKWHASVVDPLGLDMPNCTYILDPEKLTLRATYDNCTRRVHGGHQMTIRVMNNSAALRHGAVMYQFFCPAMQVEETQGLSASTICQKDFMSFSLPRVFSGLADDSKGTKVQMGWSIEVGDGARAKTLTLPEAMKEGFSLLIDNHRMTFHVPFNATGVTHYVQGNSHLYMVSLKLTFISPGQKVIFSSQAICAPDPVTCNATHMTLTIPEFPGKLKSVSFENQNIDVSQLHDNGIDLEATNGMKLHFSKTLLKTKLSEKCLLHQFYLASLKLTFLLRPETVSMVIYPECLCESPVSIVTGELCTQDGFMDVEVYSYQTQPALDLGTLRVGNSSCQPVFEAQSQGLVRFHIPLNGCGTRYKFEDDKVVYENEIHALWTDFPPSKISRDSEFRMTVKCSYSRNDMLLNINVESLTPPVASVKLGPFTLILQSYPDNSYQQPYGENEYPLVRFLRQPIYMEVRVLNRDDPNIKLVLDDCWATSTMDPDSFPQWNVVVDGCAYDLDNYQTTFHPVGSSVTHPDHYQRFDMKAFAFVSEAHVLSSLVYFHCSALICNRLSPDSPLCSVTCPVSSRHRRATGATEAEKMTVSLPGPILLLSDDSSFRGVGSSDLKASGSSGEKSRSETGEEVGSRGAMDTKGHKTAGDVGSKAVAAVAAFAGVVATLGFIYYLYEKRTVSNH

SEQ ID NO: 70991 - protein, 373 aa, Homo sapiens
MVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 70992 - protein, 424 aa, Homo sapiens
MELSYRLFICLLLWGSTELCYPQPLWLLQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 70993 - protein, 371 aa, Homo sapiens
MELSYRLFICLLLWGSTELCYPQPLWLLQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGTDLPGQEG

SEQ ID NO: 70994 - protein, 540 aa, Homo sapiens
MWLLRCVLLCVSLSLAVSGQHKPEAPDYSSVLHCGPWSFQFAVNLNQEATSPPVLIAWDNQGLLHELQNDSDCGTWIRKGPGSSVVLEATYSSCYVTEWDSHYIMPVGVEGAGAAEHKVVTERKLLKCPMDLLARDAPDTDWCDSIPARDRLPCAPSPISRGDCEGLGCCYSSEEVNSCYYGNTVTLHCTREGHFSIAVSRNVTSPPLLLDSVRLALRNDSACNPVMATQAFVLFQFPFTSCGTTRQITGDRAVYENELVATRDVKNGSRGSVTRDSIFRLHVSCSYSVSSNSLPINVQVFTLPPPFPETQPGPLTLELQIAKDKNYGSYYGVGDYPVVKLLRDPIYVEVSILHRTDPYLGLLLQQCWATPSTDPLSQPQWPILVKGCPYIGDNYQTQLIPVQKALDLPFPSHHQRFSIFTFSFVNPTVEKQALRGPVHLHCSVSVCQPAETPSCVVTCPDLSRRRNFDNSSQNTTASVSSKGPMILLQATKDPPEKLRVPVDSKVLWVAGLSGTLILGALLVSYLAVKKQKSCPDQMCQ

SEQ ID NO: 70995 - protein, 779 aa, Homo sapiens
MASFVTEVLAHSGRLEKEDLGTRISRLTRRVEEIKGEVCNMISKKYSEFLPSMQSAQGLITQVDKLSEDIDLLKSRIESEVRRDLHVSTGEFTDLKQQLERDSVVLSLLKQLQEFSTAIEEYNCALTEKKYVTGAQRLEEAQKCLKLLKSRKCFDLKILKSLSMELTIQKQNILYHLGEEWQKLIVWKFPPSKDTSSLESYLQTELHLYTEQSHKEEKTPMPPISSVLLAFSVLGELHSKLKSFGQMLLKYILRPLASCPSLHAVIESQPNIVIIRFESIMTNLEYPSPSEVFTKIRLVLEVLQKQLLDLPLDTDLENEKTSTVPLAEMLGDMIWEDLSECLIKNCLVYSIPTNSSKLQQYEEIIQSTEEFENALKEMRFLKGDTTDLLKYARNINSHFANKKCQDVIVAARNLMTSEIHNTVKIIPDSKINVPELPTPDEDNKLEVQKVSNTQYHEVMNLEPENTLDQHSFSLPTCRISESVKKLMELAYQTLLEATTSSDQCAVQLFYSVRNIFHLFHDVVPTYHKENLQKLPQLAAIHHNNCMYIAHHLLTLGHQFRLRLAPILCDGTATFVDLVPGFRRLGTECFLAQMRAQKGELLERLSSARNFSNMDDEENYSAASKAVRQVLHQLKRLGIVWQDVLPVNIYCKAMGTLLNTAISEVIGKITALEDISTEDGDRLYSLCKTVMDEGPQVFAPLSEESKNKKYQEEVPVYVPKWMPFKELMMMLQASLQEIGDRWADGKGPLAAAFSSSEVKALIRALFQNTERRAAALAKIK

SEQ ID NO: 70996 - protein, 672 aa, Homo sapiens
MASFVTEVLAHSGRLEKEDLGTRISRLTRRVEEIKGEVCNMISKKYSEFLPSMQSAQGLITQVDKLSEDIDLLKSRIESEVRRDLHVSTGEFTDLKQQLERDSVVLSLLKQLQEFSTAIEEYNCALTEKKYVTGAQRLEEAQKCLKLLKSRKCFDLKILKSLSMELTIQKQNILYHLGEEWQKLIVWKFPPSKDTSSLESYLQTELHLYTEQSHKEEKTPMPPISSVLLAFSVLGELHSKLKSFGQMLLKYILRPLASCPSLHAVIESQPNIVIIRFESIMTNLEYPSPSEVFTKIRLVLEVLQKQLLDLPLDTDLENEKTSTVPLAEMLGDMIWEDLSECLIKNCLVYSIPTNSSKLQQYEEIIQSTEEFENALKEMRFLKGDTTDLLKYARNINSHFANKKCQDVIVAARNLMTSEIHNTVKIIPDSKINVPELPTPDEDNKLEVQKVSNTQYHEVMNLEPENTLDQHSFSLPTCRISESVKKLMELAYQTLLEATTSSDQCAVQLFYSVRNIFHLFHDVVPTYHKENLQKLPQLAAIHHNNCMYIAHHLLTLGHQFRLRLAPILCDGTATFVDLVPGFRRLGTECFLAQMRAQKGELLERLSSARNFSNMDDEENYSAASKAVRQVLHQLKRLGIVWQDVLPVNIYCKAMGTLLNTAISEVIGKITALE

SEQ ID NO: 70997 - protein, 591 aa, Homo sapiens
MWERLNCAAEDFYSRLLQKFNEEKKGIRKDPFLYEADVQVQLISKGQPNPLKNILNENDIVFIVEKVPLEKEETSHIEELQSEETAISDFSTGENVGPLALPVGKARQLIGLYTMAHNPNMTHLKINLPVTALPPLWVRCDSSDPEGTCWLGAELITTNNSITGIVLYVVSCKADKNYSVNLENLKNLHKKRHHLSTVTSKGFAQYELFKSSALDDTITASQTAIALDISWSPVDEILQIPPLSSTATLNIKVESGEPRGPLNHLYRELKFLLVLADGLRTGVTEWLEPLEAKSAVELVQEFLNDLNKLDGFGDSTKKDTEVETLKHDTAAVDRSVKRLFKVRSDLDFAEQLWCKMSSSVISYQDLVKCFTLIIQSLQRGDIQPWLHSGSNSLLSKLIHQSYHGTMDTVSLSGTIPVQMLLEIGLDKLKKDYISFFIGQELASLNHLEYFIAPSVDIQEQVYRVQKLHHILEILVSCMPFIKSQHELLFSLTQICIKYYKQNPLDEQHIFQLPVRPTAVKNLYQSEKPQKWRVEIYSGQKKIKTVWQLSDSSPIDHLNFHKPDFSELTLNGSLEERIFFTNMVTCSQVHFK

SEQ ID NO: 70998 - protein, 477 aa, Homo sapiens
MAHNPNMTHLKINLPVTALPPLWVRCDSSDPEGTCWLGAELITTNNSITGIVLYVVSCKADKNYSVNLENLKNLHKKRHHLSTVTSKGFAQYELFKSSALDDTITASQTAIALDISWSPVDEILQIPPLSSTATLNIKVESGEPRGPLNHLYRELKFLLVLADGLRTGVTEWLEPLEAKSAVELVQEFLNDLNKLDGFGDSTKKDTEVETLKHDTAAVDRSVKRLFKVRSDLDFAEQLWCKMSSSVISYQDLVKCFTLIIQSLQRGDIQPWLHSGSNSLLSKLIHQSYHGTMDTVSLSGTIPVQMLLEIGLDKLKKDYISFFIGQELASLNHLEYFIAPSVDIQEQVYRVQKLHHILEILVSCMPFIKSQHELLFSLTQICIKYYKQNPLDEQHIFQLPVRPTAVKNLYQSEKPQKWRVEIYSGQKKIKTVWQLSDSSPIDHLNFHKPDFSELTLNGSLEERIFFTNMVTCSQVHFK

SEQ ID NO: 70999 - protein, 477 aa, Homo sapiens; identical to SEQ ID NO: 70998

SEQ ID NO: 71000 - protein, 424 aa, Homo sapiens
MAALGDEVLDGYVFPACPPCSYRYPYPAATKGKGAAGGSWQQRGRGCLPASSPCSAGAASLSFPGCGRLTAAEYFDSYQRERLMALLAQVGPGLGPRARRAGSCDVAVQVSPRIDAAVQCSLGRRTLQRRARDPESPAGPGAEGTTGGGSFSQQPSRRGLEQGSPQNGAPRPMRFPRTVAVYSPLALRRLTAFLEGPGPAAGEQRSGASDGERGPPPARLQGPEEGEVWTKKAPRRPQSDDDGEAQAAVRASWEQPADGPELPPREAQEGEAAPRSALRSPGQPPSAGRARDGGDGREAAVAGEGPSPRSPELGKERLRFQFLEQKYGYYHCKDCNIRWESAYVWCVQGTNKVYFKQFCRTCQKSYNPYRVEDITCQSCKQTRCSCPVKLRHVDPKRPHRQDLCGRCKGKRLSCDSTFSFKYII

SEQ ID NO: 71001 - protein, 572 aa, Homo sapiens
MAAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 71002 - protein, 540 aa, Homo sapiens
AAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 71003 - protein, 415 aa, Homo sapiens
MTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 71004 - protein, 485 aa, Homo sapiens
MGRVGEIPPPPPEDFPLPPPPLAGDGDDAEGALGGAFPPPPPPIEESFPPAPLEEEIFPSPPPPPEEEGGPEAPIPPPPQVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 71005 - protein, 164 aa, Homo sapiens
MAAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPF

SEQ ID NO: 71006 - DNA, 852 bp, Artificial Sequence
  Description of Artificial Sequence: Synthetic coding sequence
atggacctgtggcccggcgcctggatgctgctgctgctgctgttcctgctgctgctgttcctgctgcccaccctgtggttctgcagccccagcgccaagtacttcttcaagatggccttctacaacggctggatcctgttcctggccgtgctggccatccccgtgtgcgccgtgagaggcagaaacgtggagaacatgaagatcctgagactgatgctgctgcacatcaagtacctgtacggcatcagagtggaggtgagaggcgcccaccacttcccccccagccagccctacgtggtggtgagcaaccaccagagcagcctggacctgctgggcatgatggaggtgctgcccggcagatgcgtgcccatcgccaagagagagctgctgtgggccggcagcgccggcctggcctgctggctggccggcgtgatcttcatcgacagaaagagaaccggcgacgccatcagcgtgatgagcgaggtggcccagaccctgctgacccaggacgtgagagtgtgggtgttccccgagggcaccagaaaccacaacggcagcatgctgcccttcaagagaggcgccttccacctggccgtgcaggcccaggtgcccatcgtgcccatcgtgatgagcagctaccaggacttctactgcaagaaggagagaagattcaccagcggccagtgccaggtgagagtgctgccccccgtgcccaccgagggcctgacccccgacgacgtgcccgccctggccgacagagtgagacacagcatgctgaccgtgttcagagagatcagcaccgacggcagaggcggcggcgactacctgaagaagcccggcggcggcggctag

SEQ ID NO: 71007 - DNA, 852 bp, Artificial Sequence; identical to SEQ ID NO: 71006
  Description of Artificial Sequence: Synthetic coding sequence

SEQ ID NO: 71008 - DNA, 852 bp, Artificial Sequence; identical to SEQ ID NO: 71006
  Description of Artificial Sequence: Synthetic coding sequence

SEQ ID NO: 71009 - DNA, 852 bp, Artificial Sequence; identical to SEQ ID NO: 71006
  Description of Artificial Sequence: Synthetic coding sequence

SEQ ID NO: 71010 - DNA, 852 bp, Artificial Sequence; identical to SEQ ID NO: 71006
  Description of Artificial Sequence: Synthetic coding sequence

SEQ ID NO: 71011 - DNA, 852 bp, Artificial Sequence; identical to SEQ ID NO: 71006
  Description of Artificial Sequence: Synthetic coding sequence

SEQ ID NO: 71012 - DNA, 852 bp, Artificial Sequence; identical to SEQ ID NO: 71006
  Description of Artificial Sequence: Synthetic coding sequence

SEQ ID NO: 71013 - DNA, 852 bp, Artificial Sequence; identical to SEQ ID NO: 71006
  Description of Artificial Sequence: Synthetic coding sequence

SEQ ID NO: 71014 - DNA, 852 bp, Artificial Sequence; identical to SEQ ID NO: 71006
  Description of Artificial Sequence: Synthetic coding sequence

SEQ ID NO: 71015 - DNA, 852 bp, Artificial Sequence; identical to SEQ ID NO: 71006
  Description of Artificial Sequence: Synthetic coding sequence

SEQ ID NO: 71016 - DNA, 852 bp, Artificial Sequence; identical to SEQ ID NO: 71006
  Description of Artificial Sequence: Synthetic coding sequence

SEQ ID NO: 71017 - DNA, 852 bp, Artificial Sequence; identical to SEQ ID NO: 71006
  Description of Artificial Sequence: Synthetic coding sequence

SEQ ID NO: 71018 - DNA, 516 bp, Artificial Sequence
  Description of Artificial Sequence: Synthetic coding sequence
atgatggaggtgctgcccggcagatgcgtgcccatcgccaagagagagctgctgtgggccggcagcgccggcctggcctgctggctggccggcgtgatcttcatcgacagaaagagaaccggcgacgccatcagcgtgatgagcgaggtggcccagaccctgctgacccaggacgtgagagtgtgggtgttccccgagggcaccagaaaccacaacggcagcatgctgcccttcaagagaggcgccttccacctggccgtgcaggcccaggtgcccatcgtgcccatcgtgatgagcagctaccaggacttctactgcaagaaggagagaagattcaccagcggccagtgccaggtgagagtgctgccccccgtgcccaccgagggcctgacccccgacgacgtgcccgccctggccgacagagtgagacacagcatgctgaccgtgttcagagagatcagcaccgacggcagaggcggcggcgactacctgaagaagcccggcggcggcggctag

SEQ ID NO: 71019 - DNA, 852 bp, Artificial Sequence; identical to SEQ ID NO: 71006
  Description of Artificial Sequence: Synthetic coding sequence

SEQ ID NO: 71020 - DNA, 852 bp, Artificial Sequence; identical to SEQ ID NO: 71006
  Description of Artificial Sequence: Synthetic coding sequence

SEQ ID NO: 71021 - DNA, 852 bp, Artificial Sequence; identical to SEQ ID NO: 71006
  Description of Artificial Sequence: Synthetic coding sequence

SEQ ID NO: 71022 - DNA, 852 bp, Artificial Sequence; identical to SEQ ID NO: 71006
  Description of Artificial Sequence: Synthetic coding sequence

SEQ ID NO: 71023 - DNA, 852 bp, Artificial Sequence; identical to SEQ ID NO: 71006
  Description of Artificial Sequence: Synthetic coding sequence

SEQ ID NO: 71024 - DNA, 852 bp, Artificial Sequence; identical to SEQ ID NO: 71006
  Description of Artificial Sequence: Synthetic coding sequence

SEQ ID NO: 71025 - DNA, 852 bp, Artificial Sequence; identical to SEQ ID NO: 71006
  Description of Artificial Sequence: Synthetic coding sequence

SEQ ID NO: 71026 - DNA, 852 bp, Artificial Sequence; identical to SEQ ID NO: 71006
  Description of Artificial Sequence: Synthetic coding sequence

SEQ ID NO: 71027 - DNA, 852 bp, Artificial Sequence; identical to SEQ ID NO: 71006
  Description of Artificial Sequence: Synthetic coding sequence

SEQ ID NO: 71028 - DNA, 852 bp, Artificial Sequence; identical to SEQ ID NO: 71006
  Description of Artificial Sequence: Synthetic coding sequence

SEQ ID NO: 71029 - DNA, 852 bp, Artificial Sequence; identical to SEQ ID NO: 71006
  Description of Artificial Sequence: Synthetic coding sequence

SEQ ID NO: 71030 - DNA, 852 bp, Artificial Sequence; identical to SEQ ID NO: 71006
  Description of Artificial Sequence: Synthetic coding sequence

SEQ ID NO: 71031 - DNA, 852 bp, Artificial Sequence; identical to SEQ ID NO: 71006
  Description of Artificial Sequence: Synthetic coding sequence

SEQ ID NO: 71032 - DNA, 852 bp, Artificial Sequence; identical to SEQ ID NO: 71006
  Description of Artificial Sequence: Synthetic coding sequence

SEQ ID NO: 71033 - DNA, 852 bp, Artificial Sequence; identical to SEQ ID NO: 71006
  Description of Artificial Sequence: Synthetic coding sequence

SEQ ID NO: 71034 - DNA, 852 bp, Artificial Sequence; identical to SEQ ID NO: 71006
  Description of Artificial Sequence: Synthetic coding sequence

SEQ ID NO: 71035 - DNA, 852 bp, Artificial Sequence; identical to SEQ ID NO: 71006
  Description of Artificial Sequence: Synthetic coding sequence

SEQ ID NO: 71036 - DNA, 852 bp, Artificial Sequence; identical to SEQ ID NO: 71006
  Description of Artificial Sequence: Synthetic coding sequence

SEQ ID NO: 71037 - DNA, 852 bp, Artificial Sequence; identical to SEQ ID NO: 71006
  Description of Artificial Sequence: Synthetic coding sequence

SEQ ID NO: 71038 - DNA, 852 bp, Artificial Sequence; identical to SEQ ID NO: 71006
  Description of Artificial Sequence: Synthetic coding sequence

SEQ ID NO: 71039 - DNA, 852 bp, Artificial Sequence; identical to SEQ ID NO: 71006
  Description of Artificial Sequence: Synthetic coding sequence

SEQ ID NO: 71040 - DNA, 852 bp, Artificial Sequence; identical to SEQ ID NO: 71006
  Description of Artificial Sequence: Synthetic coding sequence

SEQ ID NO: 71041 - DNA, 852 bp, Artificial Sequence; identical to SEQ ID NO: 71006
  Description of Artificial Sequence: Synthetic coding sequence

SEQ ID NO: 71042 - DNA, 852 bp, Artificial Sequence; identical to SEQ ID NO: 71006
  Description of Artificial Sequence: Synthetic coding sequence

SEQ ID NO: 71043 - DNA, 852 bp, Artificial Sequence; identical to SEQ ID NO: 71006
  Description of Artificial Sequence: Synthetic coding sequence

SEQ ID NO: 71044 - DNA, 852 bp, Artificial Sequence; identical to SEQ ID NO: 71006
  Description of Artificial Sequence: Synthetic coding sequence

SEQ ID NO: 71045 - DNA, 852 bp, Artificial Sequence; identical to SEQ ID NO: 71006
  Description of Artificial Sequence: Synthetic coding sequence

SEQ ID NO: 71046 - DNA, 852 bp, Artificial Sequence; identical to SEQ ID NO: 71006
  Description of Artificial Sequence: Synthetic coding sequence

SEQ ID NO: 71047 - DNA, 852 bp, Artificial Sequence; identical to SEQ ID NO: 71006
  Description of Artificial Sequence: Synthetic coding sequence

SEQ ID NO: 71048 - DNA, 852 bp, Artificial Sequence; identical to SEQ ID NO: 71006
  Description of Artificial Sequence: Synthetic coding sequence

SEQ ID NO: 71049 - DNA, 276 bp, Artificial Sequence
  Description of Artificial Sequence: Synthetic coding sequence
cacagcgccagcacccccatcctgacccacagccaccccgcccagggcatgatggaggtgctgcccggcagatgcgtgcccatcgccaagagagagctgctgtgggccggcagcgccggcctggcctgctggctggccggcgtgatcttcatcgacagaaagagaaccggcgacgccatcagcgtgatgagcgaggtggcccagaccctgctgacccaggacgtgagccaccccggcctgctgctgcaggagggcgccagcctgcacctgggctag

SEQ ID NO: 71050 - DNA, 276 bp, Artificial Sequence; identical to SEQ ID NO: 71049
  Description of Artificial Sequence: Synthetic coding sequence

SEQ ID NO: 71051 - DNA, 276 bp, Artificial Sequence; identical to SEQ ID NO: 71049
  Description of Artificial Sequence: Synthetic coding sequence

SEQ ID NO: 71052 - DNA, 516 bp, Artificial Sequence; identical to SEQ ID NO: 71018
  Description of Artificial Sequence: Synthetic coding sequence

SEQ ID NO: 71053 - DNA, 516 bp, Artificial Sequence; identical to SEQ ID NO: 71018
  Description of Artificial Sequence: Synthetic coding sequence

SEQ ID NO: 71054 - DNA, 276 bp, Artificial Sequence; identical to SEQ ID NO: 71049
  Description of Artificial Sequence: Synthetic coding sequence

SEQ ID NO: 71055 - DNA, 276 bp, Artificial Sequence; identical to SEQ ID NO: 71049
  Description of Artificial Sequence: Synthetic coding sequence

SEQ ID NO: 71056 - DNA, 276 bp, Artificial Sequence; identical to SEQ ID NO: 71049
  Description of Artificial Sequence: Synthetic coding sequence

SEQ ID NO: 71057 - DNA, 516 bp, Artificial Sequence; identical to SEQ ID NO: 71018
  Description of Artificial Sequence: Synthetic coding sequence

SEQ ID NO: 71058 - DNA, 516 bp, Artificial Sequence; identical to SEQ ID NO: 71018
  Description of Artificial Sequence: Synthetic coding sequence

SEQ ID NO: 71059 - DNA, 276 bp, Artificial Sequence; identical to SEQ ID NO: 71049
  Description of Artificial Sequence: Synthetic coding sequence

SEQ ID NO: 71060 - DNA, 516 bp, Artificial Sequence; identical to SEQ ID NO: 71018
  Description of Artificial Sequence: Synthetic coding sequence

SEQ ID NO: 71061 - DNA, 516 bp, Artificial Sequence; identical to SEQ ID NO: 71018
  Description of Artificial Sequence: Synthetic coding sequence

SEQ ID NO: 71062 - DNA, 741 bp, Artificial Sequence
  Description of Artificial Sequence: Synthetic coding sequence
atggagctgtggccctgcctggccgccgccctgctgctgctgctgctgctggtgcagctgagcagagccgccgagttctacgccaaggtggccctgtactgcgccctgtgcttcaccgtgagcgccgtggccagcctggtgtgcctgctgagacacggcggcagaaccgtggagaacatgagcatcatcggctggttcgtgagaagcttcaagtacttctacggcctgagattcgaggtgagagaccccagaagactgcaggaggccagaccctgcgtgatcgtgagcaaccaccagagcatcctggacatgatgggcctgatggaggtgctgcccgagagatgcgtgcagatcgccaagagagagctgctgttcctgggccccgtgggcctgatcatgtacctgggcggcgtgttcttcatcaacagacagagaagcagcaccgccatgaccgtgatggccgacctgggcgagagaatggtgagagagaacgtgcccatcgtgcccgtggtgtacagcagcttcagcagcttctacaacaccaagaagaagttcttcaccagcggcaccgtgaccgtgcaggtgctggaggccatccccaccagcggcctgaccgccgccgacgtgcccgccctggtggacacctgccacagagccatgagaaccaccttcctgcacatcagcaagaccccccaggagaacggcgccaccgccggcagcggcgtgcagcccgcccagtag

SEQ ID NO: 71063 - DNA, 837 bp, Artificial Sequence
  Description of Artificial Sequence: Synthetic coding sequence
atggagctgtggccctgcctggccgccgccctgctgctgctgctgctgctggtgcagctgagcagagccgccgagttctacgccaaggtggccctgtactgcgccctgtgcttcaccgtgagcgccgtggccagcctggtgtgcctgctgagacacggcggcagaaccgtggagaacatgagcatcatcggctggttcgtgagaagcttcaagtacttctacggcctgagattcgaggtgagagaccccagaagactgcaggaggccagaccctgcgtgatcgtgagcaaccaccagagcatcctggacatgatgggcctgatggaggtgctgcccgagagatgcgtgcagatcgccaagagagagctgctgttcctgggccccgtgggcctgatcatgtacctgggcggcgtgttcttcatcaacagacagagaagcagcaccgccatgaccgtgatggccgacctgggcgagagaatggtgagagagaacctgaaggtgtggatctaccccgagggcaccagaaacgacaacggcgacctgctgcccttcaagaagggcgccttctacctggccgtgcaggcccaggtgcccatcgtgcccgtggtgtacagcagcttcagcagcttctacaacaccaagaagaagttcttcaccagcggcaccgtgaccgtgcaggtgctggaggccatccccaccagcggcctgaccgccgccgacgtgcccgccctggtggacacctgccacagagccatgagaaccaccttcctgcacatcagcaagaccccccaggagaacggcgccaccgccggcagcggcgtgcagcccgcccagtag

SEQ ID NO: 71064 - DNA, 837 bp, Artificial Sequence; identical to SEQ ID NO: 71063
  Description of Artificial Sequence: Synthetic coding sequence

SEQ ID NO: 71065 - DNA, 1371 bp, Artificial Sequence
  Description of Artificial Sequence: Synthetic coding sequence
atgttcctgctgctgcccttcgacagcctgatcgtgaacctgctgggcatcagcctgaccgtgctgttcaccctgctgctggtgttcatcatcgtgcccgccatcttcggcgtgagcttcggcatcagaaagctgtacatgaagagcctgctgaagatcttcgcctgggccaccctgagaatggagagaggcgccaaggagaagaaccaccagctgtacaagccctacaccaacggcatcatcgccaaggaccccaccagcctggaggaggagatcaaggagatcagaagaagcggcagcagcaaggccctggacaacacccccgagttcgagctgagcgacatcttctacttctgcagaaagggcatggagaccatcatggacgacgaggtgaccaagagattcagcgccgaggagctggagagctggaacctgctgagcagaaccaactacaacttccagtacatcagcctgagactgaccgtgctgtggggcctgggcgtgctgatcagatactgcttcctgctgcccctgagaatcgccctggccttcaccggcatcagcctgctggtggtgggcaccaccgtggtgggctacctgcccaacggcagattcaaggagttcatgagcaagcacgtgcacctgatgtgctacagaatctgcgtgagagccctgaccgccatcatcacctaccacgacagagagaacagacccagaaacggcggcatctgcgtggccaaccacaccagccccatcgacgtgatcatcctggccagcgacggctactacgccatggtgggccaggtgcacggcggcctgatgggcgtgatccagagagccatggtgaaggcctgcccccacgtgtggttcgagagaagcgaggtgaaggacagacacctggtggccaagagactgaccgagcacgtgcaggacaagagcaagctgcccatcctgatcttccccgagggcacctgcatcaacaacaccagcgtgatgatgttcaagaagggcagcttcgagatcggcgccaccgtgtaccccgtggccatcaagtacgacccccagttcggcgacgccttctggaacagcagcaagtacggcatggtgacctacctgctgagaatgatgaccagctgggccatcgtgtgcagcgtgtggtacctgccccccatgaccagagaggccgacgaggacgccgtgcagttcgccaacagagtgaagagcgccatcgccagacagggcggcctggtggacctgctgtgggacggcggcctgaagagagagaaggtgaaggacaccttcaaggaggagcagcagaagctgtacagcaagatgatcgtgggcaaccacaaggacagaagcagaagctag

SEQ ID NO: 71066 - DNA, 1305 bp, Artificial Sequence
  Description of Artificial Sequence: Synthetic coding sequence
atggagggcgccgagctggccggcaagatcctgagcacctggctgaccctggtgctgggcttcatcctgctgcccagcgtgttcggcgtgagcctgggcatcagcgagatctacatgaagatcctggtgaagaccctggagtgggccaccatcagaatcgagaagggcacccccaaggagagcatcctgaagaacagcgccagcgtgggcatcatccagagagacgagagccccatggagaagggcctgagcggcctgagaggcagagacttcgagctgagcgacgtgttctacttcagcaagaagggcctggaggccatcgtggaggacgaggtgacccagagattcagcagcgaggagctggtgagctggaacctgctgaccagaaccaacgtgaacttccagtacatcagcctgagactgaccatggtgtgggtgctgggcgtgatcgtgagatactgcgtgctgctgcccctgagagtgaccctggccttcatcggcatcagcctgctggtgatcggcaccaccctggtgggccagctgcccgacagcagcctgaagaactggctgagcgagctggtgcacctgacctgctgcagaatctgcgtgagagccctgagcggcaccatccactaccacaacaagcagtacagaccccagaagggcggcatctgcgtggccaaccacaccagccccatcgacgtgctgatcctgaccaccgacggctgctacgccatggtgggccaggtgcacggcggcctgatgggcatcatccagagagccatggtgaaggcctgcccccacgtgtggttcgagagaagcgagatgaaggacagacacctggtgaccaagagactgaaggagcacatcgccgacaagaagaagctgcccatcctgatcttccccgagggcacctgcatcaacaacaccagcgtgatgatgttcaagaagggcagcttcgagatcggcggcaccatccaccccgtggccatcaagtacaacccccagttcggcgacgccttctggaacagcagcaagtacaacatggtgagctacctgctgagaatgatgaccagctgggccatcgtgtgcgacgtgtggtacatgccccccatgaccagagaggagggcgaggacgccgtgcagttcgccaacagagtgaagagcgccatcgccatccagggcggcctgaccgagctgccctgggacggcggcctgaagagagccaaggtgaaggacatcttcaaggaggagcagcagaagaactacagcaagatgatcgtgggcaacggcagcctgagctag

SEQ ID NO: 71067 - DNA, 1305 bp, Artificial Sequence; identical to SEQ ID NO: 71066
  Description of Artificial Sequence: Synthetic coding sequence

SEQ ID NO: 71068 - DNA, 1506 bp, Artificial Sequence
  Description of Artificial Sequence: Synthetic coding sequence
atgttcaccctgccccagaaggacttcagagcccccaccacctgcctgggccccacctgcatgcaggacctgggcagcagccacggcgaggacctggagggcgagtgcagcagaaagctggaccagaagctgcccgagctgagaggcgtgggcgaccccgccatgatcagcagcgacaccagctacctgagcagcagaggcagaatgatcaagtggttctgggacagcgccgaggagggctacagaacctaccacatggacgagtacgacgaggacaagaaccccagcggcatcatcaacctgggcaccagcgagaacaagctgtgcttcgacctgctgagctggagactgagccagagagacatgcagagagtggagcccagcctgctgcagtacgccgactggagaggccacctgttcctgagagaggaggtggccaagttcctgagcttctactgcaagagccccgtgcccctgagacccgagaacgtggtggtgctgaacggcggcgccagcctgttcagcgccctggccaccgtgctgtgcgaggccggcgaggccttcctgatccccaccccctactacggcgccatcacccagcacgtgtgcctgtacggcaacatcagactggcctacgtgtacctggacagcgaggtgaccggcctggacaccagacccttccagctgaccgtggagaagctggagatggccctgagagaggcccacagcgagggcgtgaaggtgaagggcctgatcctgatcagcccccagaaccccctgggcgacgtgtacagccccgaggagctgcaggagtacctggtgttcgccaagagacacagactgcacgtgatcgtggacgaggtgtacatgctgagcgtgttcgagaagagcgtgggctacagaagcgtgctgagcctggagagactgcccgacccccagagaacccacgtgatgtgggccaccagcaaggacttcggcatgagcggcctgagattcggcaccctgtacaccgagaaccaggacgtggccaccgccgtggccagcctgtgcagataccacggcctgagcggcctggtgcagtaccagatggcccagctgctgagagacagagactggatcaaccaggtgtacctgcccgagaaccacgccagactgaaggccgcccacacctacgtgagcgaggagctgagagccctgggcatccccttcctgagcagaggcgccggcttcttcatctgggtggacctgagaaagtacctgcccaagggcaccttcgaggaggagatgctgctgtggagaagattcctggacaacaaggtgctgctgagcttcggcaaggccttcgagtgcaaggagcccggctggttcagattcgtgttcagcgaccaggtgcacagactgtgcctgggcatgcagagagtgcagcaggtgctggccggcaagagccaggtggccgaggaccccagacccagccagagccaggagcccagcgaccagagaagatag

SEQ ID NO: 71069 - DNA, 477 bp, Artificial Sequence
  Description of Artificial Sequence: Synthetic coding sequence
atgttcaccctgccccagaaggacttcagagcccccaccacctgcctgggccccacctgcatgcaggacctgggcagcagccacggcgaggacctggagggcgagtgcagcagaaagctggaccagaagctgcccgagctgagaggcgtgggcgaccccgccatgatcagcagcgacaccagctacctgagcagcagaggcagaatgatcaagtggttctgggacagcgccgaggagggctacagaacctaccacatggacgagtacgacgaggacaagaaccccagcggcatcatcaacctgggcaccagcgagaacaagctgtgcttcgacctgctgagctggagaccccccggcggcagcggccaggtgcccgtgttcctgctgcaggagcccagcaccccccagaccagagagtgcggctgccccgagtggtggtgcctggccctgctgtgcagcggccacggcgccgtgtag

SEQ ID NO: 71070 - DNA, 420 bp, Artificial Sequence
  Description of Artificial Sequence: Synthetic coding sequence
atgttcaccctgccccagaaggacttcagagcccccaccacctgcctgggccccacctgcatgcaggacctgggcagcagccacggcgaggacctggagggcgagtgcagcagaaagctggaccagaagctgcccgagctgagaggcgtgggcgaccccgccatgatcagcagcgacaccagctacctgagcagcagaggcagaatgatcaagtggttctgggacagcgccgaggagggctacagaacctaccacatggacgagtacgacgaggacaagaaccccagcggcatcatcaacctgggcaccagcgagaacaagctgtgcttcgacctgctgagctggagactgagccagagagacatgcagagagtggagcccagcctgctgcagtacgccgactggagaggccacctgtag

SEQ ID NO: 71071 - DNA, 234 bp, Artificial Sequence
  Description of Artificial Sequence: Synthetic coding sequence
atgttcaccctgccccagaaggacttcagagcccccaccacctgcctgggccccacctgcatgcaggacctgggcagcagccacggcgaggacctggagggcgagtgcagcagaaagctggaccagaagctgcccgagctgagaggcgtgggcgaccccgccatgatcagcagcgacaccagctacctgagcagcagaggcagaatgatcaagtggttctgggacagcgcctag

SEQ ID NO: 71072 - DNA, 780 bp, Artificial Sequence
  Description of Artificial Sequence: Synthetic coding sequence
atgagcaagtacaagctgatcatgctgagacacggcgagggcgcctggaacaaggagaacagattctgcagctgggtggaccagaagctgaacagcgagggcatggaggaggccagaaactgcggcaagcagctgaaggccctgaacttcgagttcgacctggtgttcaccagcgtgctgaacagaagcatccacaccgcctggctgatcctggaggagctgggccaggagtgggtgcccgtggagagcagctggagactgaacgagagacactacggcgccctgatcggcctgaacagagagcagatggccctgaaccacggcgaggagcaggtgagactgtggagaagaagctacaacgtgacccccccccccatcgaggagagccacccctactaccaggagatctacaacgacagaagatacaaggtgtgcgacgtgcccctggaccagctgcccagaagcgagagcctgaaggacgtgctggagagactgctgccctactggaacgagagaatcgcccccgaggtgctgagaggcaagaccatcctgatcagcgcccacggcaacagcagcagagccctgctgaagcacctggagggcatcagcgacgaggacatcatcaacatcaccctgcccaccggcgtgcccatcctgctggagctggacgagaacctgagagccgtgggcccccaccagttcctgggcgaccaggaggccatccaggccgccatcaagaaggtggaggaccagggcaaggtgaagcaggccaagaagtag

SEQ ID NO: 71073 - DNA, 780 bp, Artificial Sequence; identical to SEQ ID NO: 71072
  Description of Artificial Sequence: Synthetic coding sequence

SEQ ID NO: 71074 - DNA, 780 bp, Artificial Sequence; identical to SEQ ID NO: 71072
  Description of Artificial Sequence: Synthetic coding sequence

SEQ ID NO: 71075 - DNA, 237 bp, Artificial Sequence
  Description of Artificial Sequence: Synthetic coding sequence
atgagcaagtacaagctgatcatgctgagacacggcgagggcgcctggaacaaggagaacagattctgcagctgggtggaccagaagctgaacagcgagggcatggaggaggccagaaactgcggcaagcagctgaaggccctgaacttcgagttcgacctggtgttcaccagcgtgctgaacagaagcatccacaccgcctggctgatcctggaggagctgggccaggagtggtag

SEQ ID NO: 71076 - DNA, 894 bp, Artificial Sequence
  Description of Artificial Sequence: Synthetic coding sequence
atgaacagaggcttcagcagaaagagccacaccttcctgcccaagatcttcttcagaaagatgagcagcagcggcgccaaggacaagcccgagctgcagttccccttcctgcaggacgaggacaccgtggccaccctgctggagtgcaagaccctgttcatcctgagaggcctgcccggcagcggcaagagcaccctggccagagtgatcgtggacaagtacagagacggcaccaagatggtgagcgccgacgcctacaagatcacccccggcgccagaggcgccctgaaggagctgagacagttcgtgcccggcgacgagcccagagagaagatggacctggtgacctacttcggcaagagaccccccggcgtgctgcactgcaccaccaagttctgcgactacggcaaggcccccggcgccgaggagtacgcccagcaggacgtgctgaagaagagctacagcaaggccttcaccctgaccatcagcgccctgttcgtgacccccaagaccaccggcgccagagtggagctgagcgagcagcagctgcagctgtggcccagcgacgtggacaagctgagccccaccgacaacctgcccagaggcagcagagcccacatcaccctgggctgcgccgccgacgtggaggccgtgcagaccggcctggacctgctggagatcctgagacaggagaagggcggcagcagaggcgaggaggtgggcgagctgagcagaggcaagctgtacagcctgggcaacggcagatggatgctgaccctggccaagaacatggaggtgagagccatcttcaccggctactacggcaagggcaagcccgtgcccacccagggcagcagaaagggcggcgccctgcagagctgcaccatcatctag

SEQ ID NO: 71077 - DNA, 1206 bp, Artificial Sequence
  Description of Artificial Sequence: Synthetic coding sequence
atgagcagcagcggcgccaaggacaagcccgagctgcagttccccttcctgcaggacgaggacaccgtggccaccctgctggagtgcaagaccctgttcatcctgagaggcctgcccggcagcggcaagagcaccctggccagagtgatcgtggacaagtacagagacggcaccaagatggtgagcgccgacgcctacaagatcacccccggcgccagaggcgccttcagcgaggagtacaagagactggacgaggacctggccgcctactgcagaagaagagacatcagaatcctggtgctggacgacaccaaccacgagagagagagactggagcagctgttcgagatggccgaccagtaccagtaccaggtggtgctggtggagcccaagaccgcctggagactggactgcgcccagctgaaggagaagaaccagtggcagctgagcgccgacgacctgaagaagctgaagcccggcctggagaaggacttcctgcccctgtacttcggctggttcctgaccaagaagagcagcgagaccctgagaaaggccggccaggtgttcctggaggagctgggcaaccacaaggccttcaagaaggagctgagacagttcgtgcccggcgacgagcccagagagaagatggacctggtgacctacttcggcaagagaccccccggcgtgctgcactgcaccaccaagttctgcgactacggcaaggcccccggcgccgaggagtacgcccagcaggacgtgctgaagaagagctacagcaaggccttcaccctgaccatcagcgccctgttcgtgacccccaagaccaccggcgccagagtggagctgagcgagcagcagctgcagctgtggcccagcgacgtggacaagctgagccccaccgacaacctgcccagaggcagcagagcccacatcaccctgggctgcgccgccgacgtggaggccgtgcagaccggcctggacctgctggagatcctgagacaggagaagggcggcagcagaggcgaggaggtgggcgagctgagcagaggcaagctgtacagcctgggcaacggcagatggatgctgaccctggccaagaacatggaggtgagagccatcttcaccggctactacggcaagggcaagcccgtgcccacccagggcagcagaaagggcggcgccctgcagagctgcaccatcatctag

SEQ ID NO: 71078 - DNA, 1266 bp, Artificial Sequence
  Description of Artificial Sequence: Synthetic coding sequence
atgaacagaggcttcagcagaaagagccacaccttcctgcccaagatcttcttcagaaagatgagcagcagcggcgccaaggacaagcccgagctgcagttccccttcctgcaggacgaggacaccgtggccaccctgctggagtgcaagaccctgttcatcctgagaggcctgcccggcagcggcaagagcaccctggccagagtgatcgtggacaagtacagagacggcaccaagatggtgagcgccgacgcctacaagatcacccccggcgccagaggcgccttcagcgaggagtacaagagactggacgaggacctggccgcctactgcagaagaagagacatcagaatcctggtgctggacgacaccaaccacgagagagagagactggagcagctgttcgagatggccgaccagtaccagtaccaggtggtgctggtggagcccaagaccgcctggagactggactgcgcccagctgaaggagaagaaccagtggcagctgagcgccgacgacctgaagaagctgaagcccggcctggagaaggacttcctgcccctgtacttcggctggttcctgaccaagaagagcagcgagaccctgagaaaggccggccaggtgttcctggaggagctgggcaaccacaaggccttcaagaaggagctgagacagttcgtgcccggcgacgagcccagagagaagatggacctggtgacctacttcggcaagagaccccccggcgtgctgcactgcaccaccaagttctgcgactacggcaaggcccccggcgccgaggagtacgcccagcaggacgtgctgaagaagagctacagcaaggccttcaccctgaccatcagcgccctgttcgtgacccccaagaccaccggcgccagagtggagctgagcgagcagcagctgcagctgtggcccagcgacgtggacaagctgagccccaccgacaacctgcccagaggcagcagagcccacatcaccctgggctgcgccgccgacgtggaggccgtgcagaccggcctggacctgctggagatcctgagacaggagaagggcggcagcagaggcgaggaggtgggcgagctgagcagaggcaagctgtacagcctgggcaacggcagatggatgctgaccctggccaagaacatggaggtgagagccatcttcaccggctactacggcaagggcaagcccgtgcccacccagggcagcagaaagggcggcgccctgcagagctgcaccatcatctag

SEQ ID NO: 71079 - DNA, 174 bp, Artificial Sequence
  Description of Artificial Sequence: Synthetic coding sequence
atgagcagcagcggcgccaaggacaagcccgagctgcagttccccttcctgcaggacgaggacaccgtggccaccctgctggagtgcaagaccctgttcatcctgagaggcctgcccggcagcggcaagagcaccctggccagagtgatcgtggacaagtacagagacggctag

SEQ ID NO: 71080 - DNA, 1419 bp, Artificial Sequence
  Description of Artificial Sequence: Synthetic coding sequence
atgaagttcctgatcttcgccttcttcggcggcgtgcacctgctgagcctgtgcagcggcaaggccatctgcaagaacggcatcagcaagagaaccttcgaggagatcaaggaggagatcgccagctgcggcgacgtggccaaggccatcatcaacctggccgtgtacggcaaggcccagaacagaagctacgagagactggccctgctggtggacaccgtgggccccagactgagcggcagcaagaacctggagaaggccatccagatcatgtaccagaacctgcagcaggacggcctggagaaggtgcacctggagcccgtgagaatcccccactgggagagaggcgaggagagcgccgtgatgctggagcccagaatccacaagatcgccatcctgggcctgggcagcagcatcggcaccccccccgagggcatcaccgccgaggtgctggtggtgaccagcttcgacgagctgcagagaagagccagcgaggccagaggcaagatcgtggtgtacaaccagccctacatcaactacagcagaaccgtgcagtacagaacccagggcgccgtggaggccgccaaggtgggcgccctggccagcctgatcagaagcgtggccagcttcagcatctacagcccccacaccggcatccaggagtaccaggacggcgtgcccaagatccccaccgcctgcatcaccgtggaggacgccgagatgatgagcagaatggccagccacggcatcaagatcgtgatccagctgaagatgggcgccaagacctaccccgacaccgacagcttcaacaccgtggccgagatcaccggcagcaagtaccccgagcaggtggtgctggtgagcggccacctggacagctgggacgtgggccagggcgccatggacgacggcggcggcgccttcatcagctgggaggccctgagcctgatcaaggacctgggcctgagacccaagagaaccctgagactggtgctgtggaccgccgaggagcagggcggcgtgggcgccttccagtactaccagctgcacaaggtgaacatcagcaactacagcctggtgatggagagcgacgccggcaccttcctgcccaccggcctgcagttcaccggcagcgagaaggccagagccatcatggaggaggtgatgagcctgctgcagcccctgaacatcacccaggtgctgagccacggcgagggcaccgacatcaacttctggatccaggccggcgtgcccggcgccagcctgctggacgacctgtacaagtacttcttcttccaccacagccacggcgacaccatgaccgtgatggaccccaagcagatgaacgtggccgccgccgtgtgggccgtggtgagctacgtggtggccgacatggaggagatgctgcccagaagctag

SEQ ID NO: 71081 - DNA, 981 bp, Artificial Sequence
  Description of Artificial Sequence: Synthetic coding sequence
atgagcggcctgggcaagaagcacctgctgctgatgggcgagttcttcagctacggcaccaagatcctgtaccagaacaccgaggccctgcagagcaagttcttcagccccctgcagaaggccatgctgccccccaacagcttccagggcaaggtggccttcatcaccggcggcggcaccggcctgggcaagggcatgaccaccctgctgagcagcctgggcgcccagtgcgtgatcgccagcagaaagatggacgtgctgaaggccaccgccgagcagatcagcagccagaccggcaacaaggtgcacgccatccagtgcgacgtgagagaccccgacatggtgcagaacaccgtgagcgagctgatcaaggtggccggccaccccaacatcgtgatcaacaacgccgccggcaacttcatcagccccaccgagagactgagccccaacgcctggaagaccatcaccgacatcgtgctgaacggcaccgccttcgtgaccctggagatcggcaagcagctgatcaaggcccagaagggcgccgccttcctgagcatcaccaccatctacgccgagaccggcagcggcttcgtggtgcccagcgccagcgccaaggccggcgtggaggccatgagcaagagcctggccgccgagtggggcaagtacggcatgagattcaacgtgatccagcccggccccatcaagaccaagggcgccttcagcagactggaccccaccggcaccttcgagaaggagatgatcggcagaatcccctgcggcagactgggcaccgtggaggagctggccaacctggccgccttcctgtgcagcgactacgccagctggatcaacggcgccgtgatcaagttcgacggcggcgaggaggtgctgatcagcggcgagttcaacgacctgagaaaggtgaccaaggagcagtgggacaccatcgaggagctgatcagaaagaccaagggcagctag

SEQ ID NO: 71082 - DNA, 1551 bp, Artificial Sequence
  Description of Artificial Sequence: Synthetic coding sequence
atggagcccgccgtgagcctggccgtgtgcgccctgctgttcctgctgtgggtgagactgaagggcctggagttcgtgctgatccaccagagatgggtgttcgtgtgcctgttcctgctgcccctgagcctgatcttcgacatctactactacgtgagagcctgggtggtgttcaagctgagcagcgcccccagactgcacgagcagagagtgagagacatccagaagcaggtgagagagtggaaggagcagggcagcaagaccttcatgtgcaccggcagacccggctggctgaccgtgagcctgagagtgggcaagtacaagaagacccacaagaacatcatgatcaacctgatggacatcctggaggtggacaccaagaagcagatcgtgagagtggagcccctggtgaccatgggccaggtgaccgccctgctgaccagcatcggctggaccctgcccgtgctgcccgagctggacgacctgaccgtgggcggcctgatcatgggcaccggcatcgagagcagcagccacaagtacggcctgttccagcacatctgcaccgcctacgagctggtgctggccgacggcagcttcgtgagatgcacccccagcgagaacagcgacctgttctacgccgtgccctggagctgcggcaccctgggcttcctggtggccgccgagatcagaatcatccccgccaagaagtacgtgaagctgagattcgagcccgtgagaggcctggaggccatctgcgccaagttcacccacgagagccagagacaggagaaccacttcgtggagggcctgctgtacagcctggacgaggccgtgatcatgaccggcgtgatgaccgacgaggccgagcccagcaagctgaacagcatcggcaactactacaagccctggttcttcaagcacgtggagaactacctgaagaccaacagagagggcctggagtacatccccctgagacactactaccacagacacaccagaagcatcttctgggagctgcaggacatcatccccttcggcaacaaccccatcttcagatacctgttcggctggatggtgccccccaagatcagcctgctgaagctgacccagggcgagaccctgagaaagctgtacgagcagcaccacgtggtgcaggacatgctggtgcccatgaagtgcctgcagcaggccctgcacaccttccagaacgacatccacgtgtaccccatctggctgtgccccttcatcctgcccagccagcccggcctggtgcaccccaagggcaacgaggccgagctgtacatcgacatcggcgcctacggcgagcccagagtgaagcacttcgaggccagaagctgcatgagacagctggagaagttcgtgagaagcgtgcacggcttccagatgctgtacgccgactgctacatgaacagagaggagttctgggagatgttcgacggcagcctgtaccacaagctgagagagaagctgggctgccaggacgccttccccgaggtgtacgacaagatctgcaaggccgccagacactag

SEQ ID NO: 71083 - DNA, 465 bp, Artificial Sequence
  Description of Artificial Sequence: Synthetic coding sequence
tgaagcctgctgaagctgacccagggcgagaccctgagaaagctgtacgagcagcaccacgtggtgcaggacatgctggtgcccatgaagtgcctgcagcaggccctgcacaccttccagaacgacatccacgtgtaccccatctggctgtgccccttcatcctgcccagccagcccggcctggtgcaccccaagggcaacgaggccgagctgtacatcgacatcggcgcctacggcgagcccagagtgaagcacttcgaggccagaagctgcatgagacagctggagaagttcgtgagaagcgtgcacggcttccagatgctgtacgccgactgctacatgaacagagaggagttctgggagatgttcgacggcagcctgtaccacaagctgagagagaagctgggctgccaggacgccttccccgaggtgtacgacaagatctgcaaggccgccagacactag

SEQ ID NO: 71084 - DNA, 1428 bp, Artificial Sequence
  Description of Artificial Sequence: Synthetic coding sequence
atgggcgccggcgagcagaacagacagagcgcccactgcgtgcagggcatctgcggctacctggagggcgacgaggagggcgaggagggcgaggtgagaagcacccaggtgagagagtggaaggagcagggcagcaagaccttcatgtgcaccggcagacccggctggctgaccgtgagcctgagagtgggcaagtacaagaagacccacaagaacatcatgatcaacctgatggacatcctggaggtggacaccaagaagcagatcgtgagagtggagcccctggtgaccatgggccaggtgaccgccctgctgaccagcatcggctggaccctgcccgtgctgcccgagctggacgacctgaccgtgggcggcctgatcatgggcaccggcatcgagagcagcagccacaagtacggcctgttccagcacatctgcaccgcctacgagctggtgctggccgacggcagcttcgtgagatgcacccccagcgagaacagcgacctgttctacgccgtgccctggagctgcggcaccctgggcttcctggtggccgccgagatcagaatcatccccgccaagaagtacgtgaagctgagattcgagcccgtgagaggcctggaggccatctgcgccaagttcacccacgagagccagagacaggagaaccacttcgtggagggcctgctgtacagcctggacgaggccgtgatcatgaccggcgtgatgaccgacgaggccgagcccagcaagctgaacagcatcggcaactactacaagccctggttcttcaagcacgtggagaactacctgaagaccaacagagagggcctggagtacatccccctgagacactactaccacagacacaccagaagcatcttctgggagctgcaggacatcatccccttcggcaacaaccccatcttcagatacctgttcggctggatggtgccccccaagatcagcctgctgaagctgacccagggcgagaccctgagaaagctgtacgagcagcaccacgtggtgcaggacatgctggtgcccatgaagtgcctgcagcaggccctgcacaccttccagaacgacatccacgtgtaccccatctggctgtgccccttcatcctgcccagccagcccggcctggtgcaccccaagggcaacgaggccgagctgtacatcgacatcggcgcctacggcgagcccagagtgaagcacttcgaggccagaagctgcatgagacagctggagaagttcgtgagaagcgtgcacggcttccagatgctgtacgccgactgctacatgaacagagaggagttctgggagatgttcgacggcagcctgtaccacaagctgagagagaagctgggctgccaggacgccttccccgaggtgtacgacaagatctgcaaggccgccagacactag

SEQ ID NO: 71085 - DNA, 903 bp, Artificial Sequence
  Description of Artificial Sequence: Synthetic coding sequence
atgggcaccggcatcgagagcagcagccacaagtacggcctgttccagcacatctgcaccgcctacgagctggtgctggccgacggcagcttcgtgagatgcacccccagcgagaacagcgacctgttctacgccgtgccctggagctgcggcaccctgggcttcctggtggccgccgagatcagaatcatccccgccaagaagtacgtgaagctgagattcgagcccgtgagaggcctggaggccatctgcgccaagttcacccacgagagccagagacaggagaaccacttcgtggagggcctgctgtacagcctggacgaggccgtgatcatgaccggcgtgatgaccgacgaggccgagcccagcaaggacatcatccccttcggcaacaaccccatcttcagatacctgttcggctggatggtgccccccaagatcagcctgctgaagctgacccagggcgagaccctgagaaagctgtacgagcagcaccacgtggtgcaggacatgctggtgcccatgaagtgcctgcagcaggccctgcacaccttccagaacgacatccacgtgtaccccatctggctgtgccccttcatcctgcccagccagcccggcctggtgcaccccaagggcaacgaggccgagctgtacatcgacatcggcgcctacggcgagcccagagtgaagcacttcgaggccagaagctgcatgagacagctggagaagttcgtgagaagcgtgcacggcttccagatgctgtacgccgactgctacatgaacagagaggagttctgggagatgttcgacggcagcctgtaccacaagctgagagagaagctgggctgccaggacgccttccccgaggtgtacgacaagatctgcaaggccgccagacactag

SEQ ID NO: 71086 - DNA, 729 bp, Artificial Sequence
  Description of Artificial Sequence: Synthetic coding sequence
atggagcccgccgtgagcctggccgtgtgcgccctgctgttcctgctgtgggtgagactgaagggcctggagttcgtgctgatccaccagagatgggtgttcgtgtgcctgttcctgctgcccctgagcctgatcttcgacatctactactacgtgagagcctgggtggtgttcaagctgagcagcgcccccagactgcacgagcagagagtgagagacatccagaagcaggtgagagagtggaaggagcagggcagcaagaccttcatgtgcaccggcagacccggctggctgaccgtgagcctgagagtgggcaagtacaagaagacccacaagaacatcatgatcaacctgatggacatcctggaggtggacaccttccagaacgacatccacgtgtaccccatctggctgtgccccttcatcctgcccagccagcccggcctggtgcaccccaagggcaacgaggccgagctgtacatcgacatcggcgcctacggcgagcccagagtgaagcacttcgaggccagaagctgcatgagacagctggagaagttcgtgagaagcgtgcacggcttccagatgctgtacgccgactgctacatgaacagagaggagttctgggagatgttcgacggcagcctgtaccacaagctgagagagaagctgggctgccaggacgccttccccgaggtgtacgacaagatctgcaaggccgccagacactag

SEQ ID NO: 71087 - DNA, 1203 bp, Artificial Sequence
  Description of Artificial Sequence: Synthetic coding sequence
atgatggacctgagaaacacccccgccaagagcctggacaagttcatcgaggactacctgctgcccgacacctgcttcagaatgcagatcaaccacgccatcgacatcatctgcggcttcctgaaggagagatgcttcagaggcagcagctaccccgtgtgcgtgagcaaggtggtgaagggcggcagcagcggcaagggcaccaccctgagaggcagaagcgacgccgacctggtggtgttcctgagccccctgaccaccttccaggaccagctgaacagaagaggcgagttcatccaggagatcagaagacagctggaggcctgccagagagagagagccttcagcgtgaagttcgaggtgcaggcccccagatggggcaaccccagagccctgagcttcgtgctgagcagcctgcagctgggcgagggcgtggagttcgacgtgctgcccgccttcgacgccctgggccagctgaccggcggctacaagcccaacccccagatctacgtgaagctgatcgaggagtgcaccgacctgcagaaggagggcgagttcagcacctgcttcaccgagctgcagagagacttcctgaagcagagacccaccaagctgaagagcctgatcagactggtgaagcactggtaccagaactgcaagaagaagctgggcaagctgcccccccagtacgccctggagctgctgaccgtgtacgcctgggagagaggcagcatgaagacccacttcaacaccgcccagggcttcagaaccgtgctggagctggtgatcaactaccagcagctgtgcatctactggaccaagtactacgacttcaagaaccccatcatcgagaagtacctgagaagacagctgaccaagcccagacccgtgatcctggaccccgccgaccccaccggcaacctgggcggcggcgaccccaagggctggagacagctggcccaggaggccgaggcctggctgaactacccctgcttcaagaactgggacggcagccccgtgagcagctggatcctgctggccgagagcaacagcgccgacgacgagaccgacgaccccagaagataccagaagtacggctacatcggcacccacgagtacccccacttcagccacagacccagcaccctgcaggccgccagcaccccccaggccgaggaggactggacctgcaccatcctgtag

SEQ ID NO: 71088 - DNA, 1146 bp, Artificial Sequence
  Description of Artificial Sequence: Synthetic coding sequence
atgatggacctgagaaacacccccgccaagagcctggacaagttcatcgaggactacctgctgcccgacacctgcttcagaatgcagatcaaccacgccatcgacatcatctgcggcttcctgaaggagagatgcttcagaggcagcagctaccccgtgtgcgtgagcaaggtggtgaagggcggcagcagcggcaagggcaccaccctgagaggcagaagcgacgccgacctggtggtgttcctgagccccctgaccaccttccaggaccagctgaacagaagaggcgagttcatccaggagatcagaagacagctggaggcctgccagagagagagagccttcagcgtgaagttcgaggtgcaggcccccagatggggcaaccccagagccctgagcttcgtgctgagcagcctgcagctgggcgagggcgtggagttcgacgtgctgcccgccttcgacgccctgggccagctgaccggcggctacaagcccaacccccagatctacgtgaagctgatcgaggagtgcaccgacctgcagaaggagggcgagttcagcacctgcttcaccgagctgcagagagacttcctgaagcagagacccaccaagctgaagagcctgatcagactggtgaagcactggtaccagaactgcaagaagaagctgggcaagctgcccccccagtacgccctggagctgctgaccgtgtacgcctgggagagaggcagcatgaagacccacttcaacaccgcccagggcttcagaaccgtgctggagctggtgatcaactaccagcagctgtgcatctactggaccaagtactacgacttcaagaaccccatcatcgagaagtacctgagaagacagctgaccaagcccagacccgtgatcctggaccccgccgaccccaccggcaacctgggcggcggcgaccccaagggctggagacagctggcccaggaggccgaggcctggctgaactacccctgcttcaagaactgggacggcagccccgtgagcagctggatcctgctggtgaacctgaccctggtgggcagaagaaactacatcatcagcgagcacgccgtgaacctgcagcagaccagaggcgccagcctgagctacagcttccaggtggcctag

SEQ ID NO: 71089 - DNA, 1245 bp, Artificial Sequence
  Description of Artificial Sequence: Synthetic coding sequence
atgatggacctgagaaacacccccgccaagagcctggacaagttcatcgaggactacctgctgcccgacacctgcttcagaatgcagatcaaccacgccatcgacatcatctgcggcttcctgaaggagagatgcttcagaggcagcagctaccccgtgtgcgtgagcaaggtggtgaagggcggcagcagcggcaagggcaccaccctgagaggcagaagcgacgccgacctggtggtgttcctgagccccctgaccaccttccaggaccagctgaacagaagaggcgagttcatccaggagatcagaagacagctggaggcctgccagagagagagagccttcagcgtgaagttcgaggtgcaggcccccagatggggcaaccccagagccctgagcttcgtgctgagcagcctgcagctgggcgagggcgtggagttcgacgtgctgcccgccttcgacgccctgggccagctgaccggcggctacaagcccaacccccagatctacgtgaagctgatcgaggagtgcaccgacctgcagaaggagggcgagttcagcacctgcttcaccgagctgcagagagacttcctgaagcagagacccaccaagctgaagagcctgatcagactggtgaagcactggtaccagaactgcaagaagaagctgggcaagctgcccccccagtacgccctggagctgctgaccgtgtacgcctgggagagaggcagcatgaagacccacttcaacaccgcccagggcttcagaaccgtgctggagctggtgatcaactaccagcagctgtgcatctactggaccaagtactacgacttcaagaaccccatcatcgagaagtacctgagaagacagctgaccaagcccagacccgtgatcctggaccccgccgaccccaccggcaacctgggcggcggcgaccccaagggctggagacagctggcccaggaggccgaggcctggctgaactacccctgcttcaagaactgggacggcagccccgtgagcagctggatcctgctgacccagcacacccccggcagcatccaccccaccggcagaagaggcctggacctgcaccaccccctgaacgccagcgccagctggggcaagggcctgcagtgctacctggaccagttcctgcacttccaggtgggcctgctgatccagagaggccagagcagcagcgtgagctggtgcatcatccaggacagaacccaggtgagctag

SEQ ID NO: 71090 - DNA, 1095 bp, Artificial Sequence
  Description of Artificial Sequence: Synthetic coding sequence
atgatggacctgagaaacacccccgccaagagcctggacaagttcatcgaggactacctgctgcccgacacctgcttcagaatgcagatcaaccacgccatcgacatcatctgcggcttcctgaaggagagatgcttcagaggcagcagctaccccgtgtgcgtgagcaaggtggtgaagggcggcagcagcggcaagggcaccaccctgagaggcagaagcgacgccgacctggtggtgttcctgagccccctgaccaccttccaggaccagctgaacagaagaggcgagttcatccaggagatcagaagacagctggaggcctgccagagagagagagccttcagcgtgaagttcgaggtgcaggcccccagatggggcaaccccagagccctgagcttcgtgctgagcagcctgcagctgggcgagggcgtggagttcgacgtgctgcccgccttcgacgccctgggccagctgaccggcggctacaagcccaacccccagatctacgtgaagctgatcgaggagtgcaccgacctgcagaaggagggcgagttcagcacctgcttcaccgagctgcagagagacttcctgaagcagagacccaccaagctgaagagcctgatcagactggtgaagcactggtaccagaactgcaagaagaagctgggcaagctgcccccccagtacgccctggagctgctgaccgtgtacgcctgggagagaggcagcatgaagacccacttcaacaccgcccagggcttcagaaccgtgctggagctggtgatcaactaccagcagctgtgcatctactggaccaagtactacgacttcaagaaccccatcatcgagaagtacctgagaagacagctgaccaagcccagacccgtgatcctggaccccgccgaccccaccggcaacctgggcggcggcgaccccaagggctggagacagctggcccaggaggccgaggcctggctgaactacccctgcttcaagaactgggacggcagccccgtgagcagctggatcctgctggtgagaccccccgccagcagcctgcccttcatccccgcccccctgcacgaggcctag

SEQ ID NO: 71091 - DNA, 2160 bp, Artificial Sequence
  Description of Artificial Sequence: Synthetic coding sequence
atgggcaacggcgagagccagctgagcagcgtgcccgcccagaagctgggctggttcatccaggagtacctgaagccctacgaggagtgccagaccctgatcgacgagatggtgaacaccatctgcgacgtgctgcaggagcccgagcagttccccctggtgcagggcgtggccatcggcggcagctacggcagaaagaccgtgctgagaggcaacagcgacggcaccctggtgctgttcttcagcgacctgaagcagttccaggaccagaagagaagccagagagacatcctggacaagaccggcgacaagctgaagttctgcctgttcaccaagtggctgaagaacaacttcgagatccagaagagcctggacggcttcaccatccaggtgttcaccaagaaccagagaatcagcttcgaggtgctggccgccttcaacgccctgagcctgaacgacaaccccagcccctggatctacagagagctgaagagaagcctggacaagaccaacgccagccccggcgagttcgccgtgtgcttcaccgagctgcagcagaagttcttcgacaacagacccggcaagctgaaggacctgatcctgctgatcaagcactggcaccagcagtgccagaagaagatcaaggacctgcccagcctgagcccctacgccctggagctgctgaccgtgtacgcctgggagcagggctgcagaaaggacaacttcgacatcgccgagggcgtgagaaccgtgctggagctgatcaagtgccaggagaagctgtgcatctactggatggtgaactacaacttcgaggacgagaccatcagaaacatcctgctgcaccagctgcagagcgccagacccgtgatcctggaccccgtggaccccaccaacaacgtgagcggcgacaagatctgctggcagtggctgaagaaggaggcccagacctggctgaccagccccaacctggacaacgagctgcccgcccccagctggaacgtgctgcccgcccccctgttcaccacccccggccacctgctggacaagttcatcaaggagttcctgcagcccaacaagtgcttcctggagcagatcgacagcgccgtgaacatcatcagaaccttcctgaaggagaactgcttcagacagagcaccgccaagatccagatcgtgagaggcggcagcaccgccaagggcaccgccctgaagaccggcagcgacgccgacctggtggtgttccacaacagcctgaagagctacaccagccagaagaacgagagacacaagatcgtgaaggagatccacgagcagctgaaggccttctggagagagaaggaggaggagctggaggtgagcttcgagccccccaagtggaaggcccccagagtgctgagcttcagcctgaagagcaaggtgctgaacgagagcgtgagcttcgacgtgctgcccgccttcaacgccctgggccagctgagcagcggcagcacccccagccccgaggtgtacgccggcctgatcgacctgtacaagagcagcgacctgcccggcggcgagttcagcacctgcttcaccgtgctgcagagaaacttcatcagaagcagacccaccaagctgaaggacctgatcagactggtgaagcactggtacaaggagtgcgagagaaagctgaagcccaagggcagcctgccccccaagtacgccctggagctgctgaccatctacgcctgggagcagggcagcggcgtgcccgacttcgacaccgccgagggcttcagaaccgtgctggagctggtgacccagtaccagcagctgtgcatcttctggaaggtgaactacaacttcgaggacgagaccgtgagaaagttcctgctgagccagctgcagaagaccagacccgtgatcctggaccccgccgagcccaccggcgacgtgggcggcggcgacagatggtgctggcacctgctggccaaggaggccaaggagtggctgagcagcccctgcttcaaggacggcaccggcaaccccatccccccctggaaggtgcccaccatgcagacccccggcagctgcggcgccagaatccaccccatcgtgaacgagatgttcagcagcagaagccacagaatcctgaacaacaacagcaagagaaacttctag

SEQ ID NO: 71092 - DNA, 2064 bp, Artificial Sequence
  Description of Artificial Sequence: Synthetic coding sequence
atgggcaacggcgagagccagctgagcagcgtgcccgcccagaagctgggctggttcatccaggagtacctgaagccctacgaggagtgccagaccctgatcgacgagatggtgaacaccatctgcgacgtgctgcaggagcccgagcagttccccctggtgcagggcgtggccatcggcggcagctacggcagaaagaccgtgctgagaggcaacagcgacggcaccctggtgctgttcttcagcgacctgaagcagttccaggaccagaagagaagccagagagacatcctggacaagaccggcgacaagctgaagttctgcctgttcaccaagtggctgaagaacaacttcgagatccagaagagcctggacggcttcaccatccaggtgttcaccaagaaccagagaatcagcttcgaggtgctggccgccttcaacgccctgagcctgaacgacaaccccagcccctggatctacagagagctgaagagaagcctggacaagaccaacgccagccccggcgagttcgccgtgtgcttcaccgagctgcagcagaagttcttcgacaacagacccggcaagctgaaggacctgatcctgctgatcaagcactggcaccagcagtgccagaagaagatcaaggacctgcccagcctgagcccctacgccctggagctgctgaccgtgtacgcctgggagcagggctgcagaaaggacaacttcgacatcgccgagggcgtgagaaccgtgctggagctgatcaagtgccaggagaagctgtgcatctactggatggtgaactacaacttcgaggacgagaccatcagaaacatcctgctgcaccagctgcagagcgccagacccgtgatcctggaccccgtggaccccaccaacaacgtgagcggcgacaagatctgctggcagtggctgaagaaggaggcccagacctggctgaccagccccaacctggacaacgagctgcccgcccccagctggaacgtgctgcccgcccccctgttcaccacccccggccacctgctggacaagttcatcaaggagttcctgcagcccaacaagtgcttcctggagcagatcgacagcgccgtgaacatcatcagaaccttcctgaaggagaactgcttcagacagagcaccgccaagatccagatcgtgagaggcggcagcaccgccaagggcaccgccctgaagaccggcagcgacgccgacctggtggtgttccacaacagcctgaagagctacaccagccagaagaacgagagacacaagatcgtgaaggagatccacgagcagctgaaggccttctggagagagaaggaggaggagctggaggtgagcttcgagccccccaagtggaaggcccccagagtgctgagcttcagcctgaagagcaaggtgctgaacgagagcgtgagcttcgacgtgctgcccgccttcaacgccctgggccagctgagcagcggcagcacccccagccccgaggtgtacgccggcctgatcgacctgtacaagagcagcgacctgcccggcggcgagttcagcacctgcttcaccgtgctgcagagaaacttcatcagaagcagacccaccaagctgaaggacctgatcagactggtgaagcactggtacaaggagtgcgagagaaagctgaagcccaagggcagcctgccccccaagtacgccctggagctgctgaccatctacgcctgggagcagggcagcggcgtgcccgacttcgacaccgccgagggcttcagaaccgtgctggagctggtgacccagtaccagcagctgtgcatcttctggaaggtgaactacaacttcgaggacgagaccgtgagaaagttcctgctgagccagctgcagaagaccagacccgtgatcctggaccccgccgagcccaccggcgacgtgggcggcggcgacagatggtgctggcacctgctggccaaggaggccaaggagtggctgagcagcccctgcttcaaggacggcaccggcaaccccatccccccctggaaggtgcccgtgaaggtgatctag

SEQ ID NO: 71093 - DNA, 519 bp, Artificial Sequence
  Description of Artificial Sequence: Synthetic coding sequence
atgggcaacggcgagagccagctgagcagcgtgcccgcccagaagctgggctggttcatccaggagtacctgaagccctacgaggagtgccagaccctgatcgacgagatggtgaacaccatctgcgacgtgctgcaggagcccgagcagttccccctggtgcagggcgtggccatcggcggcagctacggcagaaagaccgtgctgagaggcaacagcgacggcaccctggtgctgttcttcagcgacctgaagcagttccaggaccagaagagaagccagagagacatcctggacaagaccggcgacaagctgaagttctgcctgttcaccaagtggctgaagaacaacttcgagatccagaagagcctggacggcttcaccatccaggtgttcaccaagaaccagagaatcagcttcgaggtgctggccgccttcaacgccctgagcaagcactgctgggtgagcggcgagaagagccagagaagcggctgccagaccgccctgtgcaacctgtag

SEQ ID NO: 71094 - DNA, 1053 bp, Artificial Sequence
  Description of Artificial Sequence: Synthetic coding sequence
atggccaccgtgggcgcccccagacacttctgcagatgcgcctgcttctgcaccgacaacctgtacgtggccagatacggcctgcacgtgagattcagaggcgagcagcagctgagaagagactacggccccatcctgagaagcagaggctgcgtgagcgccaaggacttccagcagctgctggccgagctggagcaggaggtggagagaagacagagactgggccaggagagcgccgccagaaaggccctgatcgccagcagctaccaccccgccagacccgaggtgtacgacagcctgcaggacgccgccctggcccccgagttcctggccgtgaccgagtacagcgtgagccccgacgccgacctgaagggcctgctgcagagactggagaccgtgagcgaggagaagagaatctacagagtgcccgtgttcaccgcccccttctgccaggccctgctggaggagctggagcacttcgagcagagcgacatgcccaagggcagacccaacaccatgaacaactacggcgtgctgctgcacgagctgggcctggacgagcccctgatgacccccctgagagagagattcctgcagcccctgatggccctgctgtaccccgactgcggcggcggcagactggacagccacagagccttcgtggtgaagtacgcccccggccaggacctggagctgggctgccactacgacaacgccgagctgaccctgaacgtggccctgggcaaggtgttcaccggcggcgccctgtacttcggcggcctgttccaggcccccaccgccctgaccgagcccctggaggtggagcacgtggtgggccagggcgtgctgcacagaggcggccagctgcacggcgccagacccctgggcaccggcgagagatggaacctggtggtgtggctgagagccagcgccgtgagaaacagcctgtgccccatgtgctgcagagagcccgacctggtggacgacgagggcttcggcgacggcttcaccagagaggagcccgccaccgtggacgtgtgcgccctgacctag

SEQ ID NO: 71095 - DNA, 3261 bp, Artificial Sequence
  Description of Artificial Sequence: Synthetic coding sequence
atggacctgtacagcacccccgccgccgccctggacagattcgtggccagaagactgcagcccagaaaggagttcgtggagaaggccagaagagccctgggcgccctggccgccgccctgagagagagaggcggcagactgggcgccgccgcccccagagtgctgaagaccgtgaagggcggcagcagcggcagaggcaccgccctgaagggcggctgcgacagcgagctggtgatcttcctggactgcttcaagagctacgtggaccagagagccagaagagccgagatcctgagcgagatgagagccagcctggagagctggtggcagaaccccgtgcccggcctgagactgaccttccccgagcagagcgtgcccggcgccctgcagttcagactgaccagcgtggacctggaggactggatggacgtgagcctggtgcccgccttcaacgtgctgggccaggccggcagcggcgtgaagcccaagccccaggtgtacagcaccctgctgaacagcggctgccagggcggcgagcacgccgcctgcttcaccgagctgagaagaaacttcgtgaacatcagacccgccaagctgaagaacctgatcctgctggtgaagcactggtaccaccaggtgtgcctgcagggcctgtggaaggagaccctgccccccgtgtacgccctggagctgctgaccatcttcgcctgggagcagggctgcaagaaggacgccttcagcctggccgagggcctgagaaccgtgctgggcctgatccagcagcaccagcacctgtgcgtgttctggaccgtgaactacggcttcgaggaccccgccgtgggccagttcctgcagagacagctgaagagacccagacccgtgatcctggaccccgccgaccccacctgggacctgggcaacggcgccgcctggcactgggacctgctggcccaggaggccgccagctgctacgaccacccctgcttcctgagaggcatgggcgaccccgtgcagagctggaagggccccggcctgcccagagccggctgcagcggcctgggccaccccatccagctggaccccaaccagaagacccccgagaacagcaagagcctgaacgccgtgtaccccagagccggcagcaagccccccagctgccccgcccccggccccaccggccagcccgccagcagcagcgtgcccggcatggccctggacctgagccagatccccaccaaggagctggacagattcatccaggaccacctgaagcccagcccccagttccaggagcaggtgaagaaggccatcgacatcatcctgagatgcctgcacgagaactgcgtgcacaaggccagcagagtgagcaagggcggcagcttcggcagaggcaccgacctgagagacggctgcgacgtggagctgatcatcttcctgaactgcttcaccgactacaaggaccagggccccagaagagccgagatcctggacgagatgagagcccagctggagagctggtggcaggaccaggtgcccagcctgagcctgcagttccccgagcagaacgtgcccgaggccctgcagttccagctggtgagcaccgccctgaagagctggaccgacgtgagcctgctgcccgccttcgacgccgtgggccagctgagcagcggcaccaagcccaacccccaggtgtacagcagactgctgaccagcggctgccaggagggcgagcacaaggcctgcttcgccgagctgagaagaaacttcatgaacatcagacccgtgaagctgaagaacctgatcctgctggtgaagcactggtacagacaggtggccgcccagaacaagggcaagggccccgcccccgccagcctgccccccgcctacgccctggagctgctgaccatcttcgcctgggagcagggctgcagacaggactgcttcaacatggcccagggcttcagaaccgtgctgggcctggtgcagcagcaccagcagctgtgcgtgtactggaccgtgaactacagcaccgaggaccccgccatgagaatgcacctgctgggccagctgagaaagcccagacccctggtgctggaccccgccgaccccacctggaacgtgggccacggcagctgggagctgctggcccaggaggccgccgccctgggcatgcaggcctgcttcctgagcagagacggcaccagcgtgcagccctgggacgtgatgcccgccctgctgtaccagacccccgccggcgacctggacaagttcatcagcgagttcctgcagcccaacagacagttcctggcccaggtgaacaaggccgtggacaccatctgcagcttcctgaaggagaactgcttcagaaacagccccatcaaggtgatcaaggtggtgaagggcggcagcagcgccaagggcaccgccctgagaggcagaagcgacgccgacctggtggtgttcctgagctgcttcagccagttcaccgagcagggcaacaagagagccgagatcatcagcgagatcagagcccagctggaggcctgccagcaggagagacagttcgaggtgaagttcgaggtgagcaagtgggagaaccccagagtgctgagcttcagcctgaccagccagaccatgctggaccagagcgtggacttcgacgtgctgcccgccttcgacgccctgggccagctggtgagcggcagcagacccagcagccaggtgtacgtggacctgatccacagctacagcaacgccggcgagtacagcacctgcttcaccgagctgcagagagacttcatcatcagcagacccaccaagctgaagagcctgatcagactggtgaagcactggtaccagcagtgcaccaagatcagcaagggcagaggcagcctgcccccccagcacggcctggagctgctgaccgtgtacgcctgggagcagggcggcaaggacagccagttcaacatggccgagggcttcagaaccgtgctggagctggtgacccagtacagacagctgtgcatctactggaccatcaactacaacgccaaggacaagaccgtgggcgacttcctgaagcagcagctgcagaagcccagacccatcatcctggaccccgccgaccccaccggcaacctgggccacaacgccagatgggacctgctggccaaggaggccgccgcctgcaccagcgccctgtgctgcatgggcagaaacggcatccccatccagccctggcccgtgaaggccgccgtgtag

SEQ ID NO: 71096 - DNA, 1545 bp, Artificial Sequence
  Description of Artificial Sequence: Synthetic coding sequence
atggccctgatgcaggagctgtacagcacccccgccagcagactggacagcttcgtggcccagtggctgcagccccacagagagtggaaggaggaggtgctggacgccgtgagaaccgtggaggagttcctgagacaggagcacttccagggcaagagaggcctggaccaggacgtgagagtgctgaaggtggtgaaggtgggcagcttcggcaacggcaccgtgctgagaagcaccagagaggtggagctggtggccttcctgagctgcttccacagcttccaggaggccgccaagcaccacaaggacgtgctgagactgatctggaagaccatgtggcagagccaggacctgctggacctgggcctggaggacctgagaatggagcagagagtgcccgacgccctggtgttcaccatccagaccagaggcaccgccgagcccatcaccgtgaccatcgtgcccgcctacagagccctgggccccagcctgcccaacagccagcccccccccgaggtgtacgtgagcctgatcaaggcctgcggcggccccggcaacttctgccccagcttcagcgagctgcagagaaacttcgtgaagcacagacccaccaagctgaagagcctgctgagactggtgaagcactggtaccagcagtacgtgaaggccagaagccccagagccaacctgccccccctgtacgccctggagctgctgaccatctacgcctgggagatgggcaccgaggaggacgagaacttcatgctggacgagggcttcaccaccgtgatggacctgctgctggagtacgaggtgatctgcatctactggaccaagtactacaccctgcacaacgccatcatcgaggactgcgtgagaaagcagctgaagaaggagagacccatcatcctggaccccgccgaccccaccctgaacgtggccgagggctacagatgggacatcgtggcccagagagccagccagtgcctgaagcaggactgctgctacgacaacagagagaaccccatcagcagctggaacgtgaagagagccagagacatccacctgaccgtggagcagagaggctaccccgacttcaacctgatcgtgaacccctacgagcccatcagaaaggtgaaggagaagatcagaagaaccagaggctacagcggcctgcagagactgagcttccaggtgcccggcagcgagagacagctgctgagcagcagatgcagcctggccaagtacggcatcttcagccacacccacatctacctgctggagaccatccccagcgagatccaggtgttcgtgaagaaccccgacggcggcagctacgcctacgccatcaaccccaacagcttcatcctgggcctgaagcagcagatcgaggaccagcagggcctgcccaagaagcagcagcagctggagttccagggccaggtgctgcaggactggctgggcctgggcatctacggcatccaggacagcgacaccctgatcctgagcaagaagaagggcgaggccctgttccccgccagctag

SEQ ID NO: 71097 - DNA, 768 bp, Artificial Sequence
  Description of Artificial Sequence: Synthetic coding sequence
atggccctgatgcaggagctgtacagcacccccgccagcagactggacagcttcgtggcccagtggctgcagccccacagagagtggaaggaggaggtgctggacgccgtgagaaccgtggaggagttcctgagacaggagcacttccagggcaagagaggcctggaccaggacgtgagagtgctgaaggtggtgaaggtgggcagcttcggcaacggcaccgtgctgagaagcaccagagaggtggagctggtggccttcctgagctgcttccacagcttccaggaggccgccaagcaccacaaggacgtgctgagactgatctggaagaccatgtggcagagccaggacctgctggacctgggcctggaggacctgagaatggagcagagagtgcccgacgccctggtgttcaccatccagaccagaggcaccgccgagcccatcaccgtgaccatcgtgcccgcctacagagccctgggccccagcctgcccaacagccagcccccccccgaggtgtacgtgagcctgatcaaggcctgcggcggccccggcaacttctgccccagcttcagcgagctgcagagaaacttcgtgaagcacagacccaccaagctgaagagcctgctgagactggtgaagcactggtaccagcaggcccaccaccccggcagcggcagaccccacccccagagaggcagaagagtgcagatgggccacagatgcagcgagggcctgcccgtgcccgagaccggcctgctgctgtag

SEQ ID NO: 71098 - DNA, 1737 bp, Artificial Sequence
  Description of Artificial Sequence: Synthetic coding sequence
atgcccgacagcaacttcgccgagagaagcgaggagcaggtgagcggcgccaaggtgatcgcccaggccctgaagacccaggacgtggagtacatcttcggcatcgtgggcatccccgtgaccgagatcgccatcgccgcccagcagctgggcatcaagtacatcggcatgagaaacgagcaggccgcctgctacgccgccagcgccatcggctacctgaccagcagacccggcgtgtgcctggtggtgagcggccccggcctgatccacgccctgggcggcatggccaacgccaacatgaactgctggcccctgctggtgatcggcggcagcagcgagagaaaccaggagaccatgggcgccttccaggagttcccccaggtggaggcctgcagactgtacaccaagttcagcgccagacccagcagcatcgaggccatccccttcgtgatcgagaaggccgtgagaagcagcatctacggcagacccggcgcctgctacgtggacatccccgccgacttcgtgaacctgcaggtgaacgtgaacagcatcaagtacatggagagatgcatgagcccccccatcagcatggccgagaccagcgccgtgtgcaccgccgccagcgtgatcagaaacgccaagcagcccctgctgatcatcggcaagggcgccgcctacgcccacgccgaggagagcatcaagaagctggtggagcagtacaagctgcccttcctgcccacccccatgggcaagggcgtggtgcccgacaaccacccctactgcgtgggcgccgccagaagcagagccctgcagttcgccgacgtgatcgtgctgttcggcgccagactgaactggatcctgcacttcggcctgccccccagataccagcccgacgtgaagttcatccaggtggacatctgcgccgaggagctgggcaacaacgtgaagcccgccgtgaccctgctgggcaacatccacgccgtgaccaagcagctgctggaggagctggacaagaccccctggcagtacccccccgagagcaagtggtggaagaccctgagagagaagatgaagagcaacgaggccgccagcaaggagctggccagcaagaagagcctgcccatgaactactacaccgtgttctaccacgtgcaggagcagctgcccagagactgcttcgtggtgagcgagggcgccaacaccatggacatcggcagaaccgtgctgcagaactacctgcccagacacagactggacgccggcaccttcggcaccatgggcgtgggcctgggcttcgccatcgccgccgccgtggtggccaaggacagaagccccggccagtggatcatctgcgtggagggcgacagcgccttcggcttcagcggcatggaggtggagaccatctgcagatacaacctgcccatcatcctgctggtggtgaacaacaacggcatctaccagggcttcgacaccgacacctggaaggagatgctgaagttccaggacgccaccgccgtggtgccccccatgtgcctgctgcccaacagccactacgagcaggtgatgaccgccttcggcggcaagggctacttcgtgcagacccccgaggagctgcagaagagcctgagacagagcctggccgacaccaccaagcccagcctgatcaacatcatgatcgagccccaggccaccagaaaggcccaggacttccactggctgaccagaagcaacatgtag

SEQ ID NO: 71099 - DNA, 1563 bp, Artificial Sequence
  Description of Artificial Sequence: Synthetic coding sequence
atgcccggcagcctgcccctgaacgccgaggcctgctggcccaaggacgtgggcatcgtggccctggagatctacttccccagccagtacgtggaccaggccgagctggagaagtacgacggcgtggacgccggcaagtacaccatcggcctgggccaggccaagatgggcttctgcaccgacagagaggacatcaacagcctgtgcatgaccgtggtgcagaacctgatggagagaaacaacctgagctacgactgcatcggcagactggaggtgggcaccgagaccatcatcgacaagagcaagagcgtgaagaccaacctgatgcagctgttcgaggagagcggcaacaccgacatcgagggcatcgacaccaccaacgcctgctacggcggcaccgccgccgtgttcaacgccgtgaactggatcgagagcagcagctgggacggcagatacgccctggtggtggccggcgacatcgccgtgtacgccaccggcaacgccagacccaccggcggcgtgggcgccgtggccctgctgatcggccccaacgcccccctgatcttcgagagaggcctgagaggcacccacatgcagcacgcctacgacttctacaagcccgacatgctgagcgagtaccccatcgtggacggcaagctgagcatccagtgctacctgagcgccctggacagatgctacagcgtgtactgcaagaagatccacgcccagtggcagaaggagggcaacgacaaggacttcaccctgaacgacttcggcttcatgatcttccacagcccctactgcaagctggtgcagaagagcctggccagaatgctgctgaacgacttcctgaacgaccagaacagagacaagaacagcatctacagcggcctggaggccttcggcgacgtgaagctggaggacacctacttcgacagagacgtggagaaggccttcatgaaggccagcagcgagctgttcagccagaagaccaaggccagcctgctggtgagcaaccagaacggcaacatgtacaccagcagcgtgtacggcagcctggccagcgtgctggcccagtacagcccccagcagctggccggcaagagaatcggcgtgttcagctacggcagcggcctggccgccaccctgtacagcctgaaggtgacccaggacgccacccccggcagcgccctggacaagatcaccgccagcctgtgcgacctgaagagcagactggacagcagaaccggcgtggcccccgacgtgttcgccgagaacatgaagctgagagaggacacccaccacctggtgaactacatcccccagggcagcatcgacagcctgttcgagggcacctggtacctggtgagagtggacgagaagcacagaagaacctacgccagaagacccacccccaacgacgacaccctggacgagggcgtgggcctggtgcacagcaacatcgccaccgagcacatccccagccccgccaagaaggtgcccagactgcccgccaccgccgccgagcccgaggccgccgtgatcagcaacggcgagcactag

SEQ ID NO: 71100 - DNA, 1563 bp, Artificial Sequence; identical to SEQ ID NO: 71099
  Description of Artificial Sequence: Synthetic coding sequence

SEQ ID NO: 71101 - DNA, 291 bp, Artificial Sequence
  Description of Artificial Sequence: Synthetic coding sequence
atgcccggcagcctgcccctgaacgccgaggcctgctggcccaaggacgtgggcatcgtggccctggagatctacttccccagccagtacgtggaccaggccgagctggagaagtacgacggcgtggacgccggcaagtacaccatcggcctgggccaggccaagatgggcttctgcaccgacagagaggacatcaacagcctgtgcatgaccgtggtgcagaacctgatggagagaaacaacctgagctacgactgcatcggcagactggaggtgggcaccgagacctag

SEQ ID NO: 71102 - DNA, 1530 bp, Artificial Sequence
  Description of Artificial Sequence: Synthetic coding sequence
atgcccggcagcctgcccctgaacgccgaggcctgctggcccaaggacgtgggcatcgtggccctggagatctacttccccagccagtacgtggaccaggccgagctggagaagtacgacggcgtggacgccggcaagtacaccatcggcctgggccaggccaagatgggcttctgcaccgacagagaggacatcaacagcctgtgcatgaccgtggtgcagaacctgatggagagaaacaacctgagctacgactgcatcggcagactggaggtgggcaccgagaccatcatcgacaagagcaagagcgtgaagaccaacctgatgcagctgttcgaggagagcggcaacaccgacatcgagggcatcgacaccaccaacgccgtgaactggatcgagagcagcagctgggacggcagatacgccctggtggtggccggcgacatcgccgtgtacgccaccggcaacgccagacccaccggcggcgtgggcgccgtggccctgctgatcggccccaacgcccccctgatcttcgagagaggcctgagaggcacccacatgcagcacgcctacgacttctacaagcccgacatgctgagcgagtaccccatcgtggacggcaagctgagcatccagtgctacctgagcgccctggacagatgctacagcgtgtactgcaagaagatccacgcccagtggcagaaggagggcaacgacaaggacttcaccctgaacgacttcggcttcatgatcttccacagcccctactgcaagctggtgcagaagagcctggccagaatgctgctgaacgacttcctgaacgaccagaacagagacaagaacagcatctacagcggcctggaggccttcggcgacgtgaagctggaggacacctacttcgacagagacgtggagaaggccttcatgaaggccagcagcgagctgttcagccagaagaccaaggccagcctgctggtgagcaaccagaacggcaacatgtacaccagcagcgtgtacggcagcctggccagcgtgctggcccagtacagcccccagcagctggccggcaagagaatcggcgtgttcagctacggcagcggcctggccgccaccctgtacagcctgaaggtgacccaggacgccacccccggcagcgccctggacaagatcaccgccagcctgtgcgacctgaagagcagactggacagcagaaccggcgtggcccccgacgtgttcgccgagaacatgaagctgagagaggacacccaccacctggtgaactacatcccccagggcagcatcgacagcctgttcgagggcacctggtacctggtgagagtggacgagaagcacagaagaacctacgccagaagacccacccccaacgacgacaccctggacgagggcgtgggcctggtgcacagcaacatcgccaccgagcacatccccagccccgccaagaaggtgcccagactgcccgccaccgccgccgagcccgaggccgccgtgatcagcaacggcgagcactag

SEQ ID NO: 71103 - DNA, 1527 bp, Artificial Sequence
  Description of Artificial Sequence: Synthetic coding sequence
atgcagagactgctgacccccgtgaagagaatcctgcagctgaccagagccgtgcaggagaccagcctgacccccgccagactgctgcccgtggcccaccagagattcagcaccgccagcgccgtgcccctggccaagaccgacacctggcccaaggacgtgggcatcctggccctggaggtgtacttccccgcccagtacgtggaccagaccgacctggagaagtacaacaacgtggaggccggcaagtacaccgtgggcctgggccagaccagaatgggcttctgcagcgtgcaggaggacatcaacagcctgtgcctgaccgtggtgcagagactgatggagagaatccagctgccctgggacagcgtgggcagactggaggtgggcaccgagaccatcatcgacaagagcaaggccgtgaagaccgtgctgatggagctgttccaggacagcggcaacaccgacatcgagggcatcgacaccaccaacgcctgctacggcggcaccgccagcctgttcaacgccgccaactggatggagagcagcagctgggacggcagatacgccatggtggtgtgcggcgacatcgccgtgtaccccagcggcaacgccagacccaccggcggcgccggcgccgtggccatgctgatcggccccaaggcccccctggccctggagagaggcctgagaggcacccacatggagaacgtgtacgacttctacaagcccaacctggccagcgagtaccccatcgtggacggcaagctgagcatccagtgctacctgagagccctggacagatgctacaccagctacagaaagaagatccagaaccagtggaagcaggccggcagcgacagacccttcaccctggacgacctgcagtacatgatcttccacacccccttctgcaagatggtgcagaagagcctggccagactgatgttcaacgacttcctgagcgccagcagcgacacccagaccagcctgtacaagggcctggaggccttcggcggcctgaagctggaggacacctacaccaacaaggacctggacaaggccctgctgaaggccagccaggacatgttcgacaagaagaccaaggccagcctgtacctgagcacccacaacggcaacatgtacaccagcagcctgtacggctgcctggccagcctgctgagccaccacagcgcccaggagctggccggcagcagaatcggcgccttcagctacggcagcggcctggccgccagcttcttcagcttcagagtgagccaggacgccgcccccggcagccccctggacaagctggtgagcagcaccagcgacctgcccaagagactggccagcagaaagtgcgtgagccccgaggagttcaccgagatcatgaaccagagagagcagttctaccacaaggtgaacttcagcccccccggcgacaccaacagcctgttccccggcacctggtacctggagagagtggacgagcagcacagaagaaagtacgccagaagacccgtgtag

SEQ ID NO: 71104 - DNA, 1401 bp, Artificial Sequence
  Description of Artificial Sequence: Synthetic coding sequence
atgcagagactgctgacccccgtgaagagaatcctgcagctgaccagagccgtgcaggagaccagcctgacccccgccagactgctgcccgtggcccaccagagattcagcaccgccagcgccgtgcccctggccaagaccgacacctggcccaaggacgtgggcatcctggccctggaggtgtacttccccgcccagtacgtggaccagaccgacctggagaagtacaacaacgtggaggccggcaagtacaccgtgggcctgggccagaccagaatgggcttctgcagcgtgcaggaggacatcaacagcctgtgcctgaccgtggtgcagagactgatggagagaatccagctgccctgggacagcgtgggcagactggaggtgggcaccgagaccatcatcgacaagagcaaggccgtgaagaccgtgctgatggagctgttccaggacagcggcaacaccgacatcgagggcatcgacaccaccaacgcctgctacggcggcaccgccagcctgttcaacgccgccaactggatggagagcagcagctgggacggcctgagaggcacccacatggagaacgtgtacgacttctacaagcccaacctggccagcgagtaccccatcgtggacggcaagctgagcatccagtgctacctgagagccctggacagatgctacaccagctacagaaagaagatccagaaccagtggaagcaggccggcagcgacagacccttcaccctggacgacctgcagtacatgatcttccacacccccttctgcaagatggtgcagaagagcctggccagactgatgttcaacgacttcctgagcgccagcagcgacacccagaccagcctgtacaagggcctggaggccttcggcggcctgaagctggaggacacctacaccaacaaggacctggacaaggccctgctgaaggccagccaggacatgttcgacaagaagaccaaggccagcctgtacctgagcacccacaacggcaacatgtacaccagcagcctgtacggctgcctggccagcctgctgagccaccacagcgcccaggagctggccggcagcagaatcggcgccttcagctacggcagcggcctggccgccagcttcttcagcttcagagtgagccaggacgccgcccccggcagccccctggacaagctggtgagcagcaccagcgacctgcccaagagactggccagcagaaagtgcgtgagccccgaggagttcaccgagatcatgaaccagagagagcagttctaccacaaggtgaacttcagcccccccggcgacaccaacagcctgttccccggcacctggtacctggagagagtggacgagcagcacagaagaaagtacgccagaagacccgtgtag

SEQ ID NO: 71105 - DNA, 1161 bp, Artificial Sequence
  Description of Artificial Sequence: Synthetic coding sequence
atgggccagagagagatgtggagactgatgagcagattcaacgccttcaagagaaccaacaccatcctgcaccacctgagaatgagcaagcacaccgacgccgccgaggaggtgctgctggagaagaagggctgcaccggcgtgatcaccctgaacagacccaagttcctgaacgccctgaccctgaacatgatcagacagatctacccccagctgaagaagtgggagcaggaccccgagaccttcctgatcatcatcaagggcgccggcggcaaggccttctgcgccggcggcgacatcagagtgatcagcgaggccgagaaggccaagcagaagatcgcccccgtgttcttcagagaggagtacatgctgaacaacgccgtgggcagctgccagaagccctacgtggccctgatccacggcatcaccatgggcggcggcgtgggcctgagcgtgcacggccagttcagagtggccaccgagaagtgcctgttcgccatgcccgagaccgccatcggcctgttccccgacgtgggcggcggctacttcctgcccagactgcagggcaagctgggctacttcctggccctgaccggcttcagactgaagggcagagacgtgtacagagccggcatcgccacccacttcgtggacagcgagaagctggccatgctggaggaggacctgctggccctgaagagccccagcaaggagaacatcgccagcgtgctggagaactaccacaccgagagcaagatcgacagagacaagagcttcatcctggaggagcacatggacaagatcaacagctgcttcagcgccaacaccgtggaggagatcatcgagaacctgcagcaggacggcagcagcttcgccctggagcagctgaaggtgatcaacaagatgagccccaccagcctgaagatcaccctgagacagctgatggagggcagcagcaagaccctgcaggaggtgctgaccatggagtacagactgagccaggcctgcatgagaggccacgacttccacgagggcgtgagagccgtgctgatcgacaaggaccagagccccaagtggaagcccgccgacctgaaggaggtgaccgaggaggacctgaacaaccacttcaagagcctgggcagcagcgacctgaagttctag

SEQ ID NO: 71106 - DNA, 1017 bp, Artificial Sequence
  Description of Artificial Sequence: Synthetic coding sequence
atgggccagagagagatgtggagactgatgagcagattcaacgccttcaagagaaccaacaccatcctgcaccacctgagaatgagcaagcacaccgacgccgccgaggaggtgctgctggagaagaagggctgcaccggcgtgatcaccctgaacagacccaagttcctgaacgccctgaccctgaacatgatcagacagatctacccccagctgaagaagtgggagcaggaccccgagaccttcctgatcatcatcaagggcgccggcggcaaggccttctgcgccggcggcgacatcagagtgatcagcgaggccgagaaggccaagcagaagatcgcccccgtgttcttcagagaggagtacatgctgaacaacgccgtgggcagctgccagaagccctacgtggccctgatccacggcatcaccatgggcggcggcgtgggcctgagcgtgcacggccagttcagagtggccaccgagaagtgcctgttcgccatgcccgagaccgccatcggcctgttccccgacgtgggcggcggctacttcctgcccagactgcagggcaagctgggctacttcctggccctgaccggcttcagactgaagggcagagacgtgtacagagccggcatcgccacccacttcgtggacagcgagaagctggccatgctggaggaggacctgctggccctgaagagccccagcaaggagaacatcgccagcgtgctggagaactaccacaccgagagcaagatcgacagagacaagagcttcatcctggaggagcacatggacaagatcaacagctgcttcagcgccaacaccgtggaggagatcatcgagaacctgcagcaggacggcagcagcttcgccctggagcagctgaaggtgatcaacaagatgagccccaccagcctgaagatcaccctgagacagctgatggagggcagcagcaagaccctgcaggaggtgctgaccatggagtacagactgagccaggcctgcatgttctag

SEQ ID NO: 71107 - DNA, 117 bp, Artificial Sequence
  Description of Artificial Sequence: Synthetic coding sequence
tgactgatcgacaaggaccagagccccaagtggaagcccgccgacctgaaggaggtgaccgaggaggacctgaacaaccacttcaagagcctgggcagcagcgacctgaagttctag

SEQ ID NO: 71108 - DNA, 903 bp, Artificial Sequence
  Description of Artificial Sequence: Synthetic coding sequence
atgggcaccctgcccaagagagtgaagatcgtggaggtgggccccagagacggcctgcagaacgagaagaacatcgtgagcacccccgtgaagatcaagctgatcgacatgctgagcgaggccggcctgagcgtgatcgagaccaccagcttcgtgagccccaagtgggtgccccagatgggcgaccacaccgaggtgctgaagggcatccagaagttccccggcatcaactaccccgtgctgacccccaacctgaagggcttcgaggccgccgtggccgccggcgccaaggaggtggtgatcttcggcgccgccagcgagctgttcaccaagaagaacatcaactgcagcatcgaggagagcttccagagattcgacgccatcctgaaggccgcccagagcgccaacatcagcgtgagaggctacgtgagctgcgccctgggctgcccctacgagggcaagatcagccccgccaaggtggccgaggtgaccaagaagttctacagcatgggctgctacgagatcagcctgggcgacaccatcggcgtgggcacccccggcatcatgaaggacatgctgagcgccgtgatgcaggaggtgcccctggccgccctggccgtgcactgccacgacacctacggccaggccctggccaacaccctgatggccctgcagatgggcgtgagcgtggtggacagcagcgtggccggcctgggcggctgcccctacgcccagggcgccagcggcaacctggccaccgaggacctggtgtacatgctggagggcctgggcatccacaccggcgtgaacctgcagaagctgctggaggccggcaacttcatctgccaggccctgaacagaaagaccagcagcaaggtggcccaggccacctgcaagctgtag

SEQ ID NO: 71109 - DNA, 978 bp, Artificial Sequence
  Description of Artificial Sequence: Synthetic coding sequence
atggccgccatgagaaaggccctgcccagaagactggtgggcctggccagcctgagagccgtgagcaccagcagcatgggcaccctgcccaagagagtgaagatcgtggaggtgggccccagagacggcctgcagaacgagaagaacatcgtgagcacccccgtgaagatcaagctgatcgacatgctgagcgaggccggcctgagcgtgatcgagaccaccagcttcgtgagccccaagtgggtgccccagatgggcgaccacaccgaggtgctgaagggcatccagaagttccccggcatcaactaccccgtgctgacccccaacctgaagggcttcgaggccgccgtggccgccggcgccaaggaggtggtgatcttcggcgccgccagcgagctgttcaccaagaagaacatcaactgcagcatcgaggagagcttccagagattcgacgccatcctgaaggccgcccagagcgccaacatcagcgtgagaggctacgtgagctgcgccctgggctgcccctacgagggcaagatcagccccgccaaggtggccgaggtgaccaagaagttctacagcatgggctgctacgagatcagcctgggcgacaccatcggcgtgggcacccccggcatcatgaaggacatgctgagcgccgtgatgcaggaggtgcccctggccgccctggccgtgcactgccacgacacctacggccaggccctggccaacaccctgatggccctgcagatgggcgtgagcgtggtggacagcagcgtggccggcctgggcggctgcccctacgcccagggcgccagcggcaacctggccaccgaggacctggtgtacatgctggagggcctgggcatccacaccggcgtgaacctgcagaagctgctggaggccggcaacttcatctgccaggccctgaacagaaagaccagcagcaaggtggcccaggccacctgcaagctgtag

SEQ ID NO: 71110 - DNA, 765 bp, Artificial Sequence
  Description of Artificial Sequence: Synthetic coding sequence
atggccgccatgagaaaggccctgcccagaagactggtgggcctggccagcctgagagccgtgagcaccagcagcatgggcaccctgcccaagagagtgaagatcgtggaggtgggccccagagacggcctgcagaacgagaagaacatcgtgagcacccccgtgaagatcaagctgatcgacatgctgagcgaggccggcctgagcgtgatcgagaccaccagcttcgtgagccccaagtgggtgccccagatgggcgaccacaccgaggtgctgaagggcatccagaagttccccggcatcaactaccccgtgctgacccccaacctgaagggcttcgaggccgccgtgaccaagaagttctacagcatgggctgctacgagatcagcctgggcgacaccatcggcgtgggcacccccggcatcatgaaggacatgctgagcgccgtgatgcaggaggtgcccctggccgccctggccgtgcactgccacgacacctacggccaggccctggccaacaccctgatggccctgcagatgggcgtgagcgtggtggacagcagcgtggccggcctgggcggctgcccctacgcccagggcgccagcggcaacctggccaccgaggacctggtgtacatgctggagggcctgggcatccacaccggcgtgaacctgcagaagctgctggaggccggcaacttcatctgccaggccctgaacagaaagaccagcagcaaggtggcccaggccacctgcaagctgtag

SEQ ID NO: 71111 - DNA, 501 bp, Artificial Sequence
  Description of Artificial Sequence: Synthetic coding sequence
atgggcaccctgcccaagagagtgaagatcgtggaggtgggccccagagacggcctgcagaacgagaagaacatcgtgagcacccccgtgaagatcaagctgatcgacatgctgagcgaggccggcctgagcgtgatcgagaccaccagcttcgtgagccccaagtgggtgccccagatgggcgaccacaccgaggtgctgaagggcatccagaagttccccggcatcaactaccccgtgctgacccccaacctgaagggcttcgaggccgccatgggcgtgagcgtggtggacagcagcgtggccggcctgggcggctgcccctacgcccagggcgccagcggcaacctggccaccgaggacctggtgtacatgctggagggcctgggcatccacaccggcgtgaacctgcagaagctgctggaggccggcaacttcatctgccaggccctgaacagaaagaccagcagcaaggtggcccaggccacctgcaagctgtag

SEQ ID NO: 71112 - DNA, 1563 bp, Artificial Sequence
  Description of Artificial Sequence: Synthetic coding sequence
atggccgccctgaagctgctgagcagcggcctgagactgtgcgccagcgccagaggcagcggcgccacctggtacaagggctgcgtgtgcagcttcagcaccagcgcccacagacacaccaagttctacaccgaccccgtggaggccgtgaaggacatccccgacggcgccaccgtgctggtgggcggcttcggcctgtgcggcatccccgagaacctgatcgacgccctgctgaagaccggcgtgaagggcctgaccgccgtgagcaacaacgccggcgtggacaacttcggcctgggcctgctgctgagaagcaagcagatcaagagaatggtgagcagctacgtgggcgagaacgccgagttcgagagacagtacctgagcggcgagctggaggtggagctgaccccccagggcaccctggccgagagaatcagagccggcggcgccggcgtgcccgccttctacacccccaccggctacggcaccctggtgcaggagggcggcagccccatcaagtacaacaaggacggcagcgtggccatcgccagcaagcccagagaggtgagagagttcaacggccagcacttcatcctggaggaggccatcaccggcgacttcgccctggtgaaggcctggaaggccgacagagccggcaacgtgatcttcagaaagagcgccagaaacttcaacctgcccatgtgcaaggccgccgagaccaccgtggtggaggtggaggagatcgtggacatcggcgccttcgcccccgaggacatccacatcccccagatctacgtgcacagactgatcaagggcgagaagtacgagaagagaatcgagagactgagcatcagaaaggagggcgacggcgaggccaagagcgccaagcccggcgacgacgtgagagagagaatcatcaagagagccgccctggagttcgaggacggcatgtacgccaacctgggcatcggcatccccctgctggccagcaacttcatcagccccaacatcaccgtgcacctgcagagcgagaacggcgtgctgggcctgggcccctaccccagacagcacgaggccgacgccgacctgatcaacgccggcaaggagaccgtgaccatcctgcccggcgccagcttcttcagcagcgacgagagcttcgccatgatcagaggcggccacgtggacctgaccatgctgggcgccatgcaggtgagcaagtacggcgacctggccaactggatgatccccggcaagatggtgaagggcatgggcggcgccatggacctggtgagcagcgccaagaccaaggtggtggtgaccatggagcacagcgccaagggcaacgcccacaagatcatggagaagtgcaccctgcccctgaccggcaagcagtgcgtgaacagaatcatcaccgagaaggccgtgttcgacgtggacaagaagaagggcctgaccctgatcgagctgtgggagggcctgaccgtggacgacgtgcagaagagcaccggctgcgacttcgccgtgagccccaagctgatgcccatgcagcagatcgccaactag

SEQ ID NO: 71113 - DNA, 1005 bp, Artificial Sequence
  Description of Artificial Sequence: Synthetic coding sequence
atgatggtgagagagttcaacggccagcacttcatcctggaggaggccatcaccggcgacttcgccctggtgaaggcctggaaggccgacagagccggcaacgtgatcttcagaaagagcgccagaaacttcaacctgcccatgtgcaaggccgccgagaccaccgtggtggaggtggaggagatcgtggacatcggcgccttcgcccccgaggacatccacatcccccagatctacgtgcacagactgatcaagggcgagaagtacgagaagagaatcgagagactgagcatcagaaaggagggcgacggcgaggccaagagcgccaagcccggcgacgacgtgagagagagaatcatcaagagagccgccctggagttcgaggacggcatgtacgccaacctgggcatcggcatccccctgctggccagcaacttcatcagccccaacatcaccgtgcacctgcagagcgagaacggcgtgctgggcctgggcccctaccccagacagcacgaggccgacgccgacctgatcaacgccggcaaggagaccgtgaccatcctgcccggcgccagcttcttcagcagcgacgagagcttcgccatgatcagaggcggccacgtggacctgaccatgctgggcgccatgcaggtgagcaagtacggcgacctggccaactggatgatccccggcaagatggtgaagggcatgggcggcgccatggacctggtgagcagcgccaagaccaaggtggtggtgaccatggagcacagcgccaagggcaacgcccacaagatcatggagaagtgcaccctgcccctgaccggcaagcagtgcgtgaacagaatcatcaccgagaaggccgtgttcgacgtggacaagaagaagggcctgaccctgatcgagctgtgggagggcctgaccgtggacgacgtgcagaagagcaccggctgcgacttcgccgtgagccccaagctgatgcccatgcagcagatcgccaactag

SEQ ID NO: 71114 - DNA, 372 bp, Artificial Sequence
  Description of Artificial Sequence: Synthetic coding sequence
atgctgggcgccatgcaggtgagcaagtacggcgacctggccaactggatgatccccggcaagatggtgaagggcatgggcggcgccatggacctggtgagcagcgccaagaccaaggtggtggtgaccatggagcacagcgccaagggcaacgcccacaagatcatggagaagtgcaccctgcccctgaccggcaagcagtgcgtgaacagaatcatcaccgagaaggccgtgttcgacgtggacaagaagaagggcctgaccctgatcgagctgtgggagggcctgaccgtggacgacgtgcagaagagcaccggctgcgacttcgccgtgagccccaagctgatgcccatgcagcagatcgccaactag

SEQ ID NO: 71115 - DNA, 372 bp, Artificial Sequence; identical to SEQ ID NO: 71114
  Description of Artificial Sequence: Synthetic coding sequence

SEQ ID NO: 71116 - DNA, 453 bp, Artificial Sequence
  Description of Artificial Sequence: Synthetic coding sequence
agcaacgcctacaaggtggacaacttcggcctgggcctgctgctgagaagcaagcagatcaagagaatggtgagcagctacgtgggcgagaacgccgagttcgagagacagtacctgagcggcgagctggaggtggagctgaccccccagggcaccctggccgagagaatcagagccggcggcgccggcgtgcccgccttctacacccccaccggctacggcaccctggtgcaggagggcggcagccccatcaagtacaacaaggacggcagcgtggccatcgccagcaagcccagagaggtgagagagttcaacggccagcacttcatcctggaggaggccatcaccggcgacttcgccctggtgaaggcctggaaggccgacagagccggcaacgtgatcttcagaaagagcgccagaaacttcaacctgcccatgtgcaaggccgcctag

SEQ ID NO: 71117 - DNA, 1131 bp, Artificial Sequence
  Description of Artificial Sequence: Synthetic coding sequence
atgagcaactgcctgcagaacttcctgaagatcaccagcaccagactgctgtgcagcagactgtgccagcagctgagaagcaagagaaagttcttcggcaccgtgcccatcagcagactgcacagaagagtggtgatcaccggcatcggcctggtgacccccctgggcgtgggcacccacctggtgtgggacagactgatcggcggcgagagcggcatcgtgagcctggtgggcgaggagtacaagagcatcccctgcagcgtggccgcctacgtgcccagaggcagcgacgagggccagttcaacgagcagaacttcgtgagcaagagcgacatcaagagcatgagcagccccaccatcatggccatcggcgccgccgagctggccatgaaggacagcggctggcacccccagagcgaggccgaccaggtggccaccggcgtggccatcggcatgggcatgatccccctggaggtggtgagcgagaccgccctgaacttccagaccaagggctacaacaaggtgagccccttcttcgtgcccaagatcctggtgaacatggccgccggccaggtgagcatcagatacaagctgaagggccccaaccacgccgtgagcaccgcctgcaccaccggcgcccacgccgtgggcgacagcttcagattcatcgcccacggcgacgccggccacatcaccgcccccgaccccgagggcgagggcgccctgagatgcatggccgccgccctgaaggacgccggcgtgcagcccgaggagatcagctacatcaacgcccacgccaccagcacccccctgggcgacgccgccgagaacaaggccatcaagcacctgttcaaggaccacgcctacgccctggccgtgagcagcaccaagggcgccaccggccacctgctgggcgccgccggcgccgtggaggccgccttcaccaccctggcctgctactaccagaagctgccccccaccctgaacctggactgcagcgagcccgagttcgacctgaactacgtgcccctgaaggcccaggagtggaagaccgagaagagattcatcggcctgaccaacagcttcggcttcggcggcaccaacgccaccctgtgcatcgccggcctgtag

SEQ ID NO: 71118 - DNA, 1380 bp, Artificial Sequence
  Description of Artificial Sequence: Synthetic coding sequence
atgagcaactgcctgcagaacttcctgaagatcaccagcaccagactgctgtgcagcagactgtgccagcagctgagaagcaagagaaagttcttcggcaccgtgcccatcagcagactgcacagaagagtggtgatcaccggcatcggcctggtgacccccctgggcgtgggcacccacctggtgtgggacagactgatcggcggcgagagcggcatcgtgagcctggtgggcgaggagtacaagagcatcccctgcagcgtggccgcctacgtgcccagaggcagcgacgagggccagttcaacgagcagaacttcgtgagcaagagcgacatcaagagcatgagcagccccaccatcatggccatcggcgccgccgagctggccatgaaggacagcggctggcacccccagagcgaggccgaccaggtggccaccggcgtggccatcggcatgggcatgatccccctggaggtggtgagcgagaccgccctgaacttccagaccaagggctacaacaaggtgagccccttcttcgtgcccaagatcctggtgaacatggccgccggccaggtgagcatcagatacaagctgaagggccccaaccacgccgtgagcaccgcctgcaccaccggcgcccacgccgtgggcgacagcttcagattcatcgcccacggcgacgccgacgtgatggtggccggcggcaccgacagctgcatcagccccctgagcctggccggcttcagcagagccagagccctgagcaccaacagcgaccccaagctggcctgcagacccttccaccccaagagagacggcttcgtgatgggcgagggcgccgccgtgctggtgctggaggagtacgagcacgccgtgcagagaagagccagaatctacgccgaggtgctgggctacggcctgagcggcgacgccggccacatcaccgcccccgaccccgagggcgagggcgccctgagatgcatggccgccgccctgaaggacgccggcgtgcagcccgaggagatcagctacatcaacgcccacgccaccagcacccccctgggcgacgccgccgagaacaaggccatcaagcacctgttcaaggaccacgcctacgccctggccgtgagcagcaccaagggcgccaccggccacctgctgggcgccgccggcgccgtggaggccgccttcaccaccctggcctgctactaccagaagctgccccccaccctgaacctggactgcagcgagcccgagttcgacctgaactacgtgcccctgaaggcccaggagtggaagaccgagaagagattcatcggcctgaccaacagcttcggcttcggcggcaccaacgccaccctgtgcatcgccggcctgtag

SEQ ID NO: 71119 - DNA, 696 bp, Artificial Sequence
  Description of Artificial Sequence: Synthetic coding sequence
atgagcaactgcctgcagaacttcctgaagatcaccagcaccagactgctgtgcagcagactgtgccagcagctgagaagcaagagaaagttcttcggcaccgtgcccatcagcagactgcacagaagagtggtgatcaccggcatcggcctggtgacccccctgggcgtgggcacccacctggtgtgggacagactgatcggcggcgagagcggcatcgtgagcctggtgggcgaggagtacaagagcatcccctgcagcgtggccgcctacgtgcccagaggcagcgacgagggccagttcaacgagcagaacttcgtgagcaagagcgacatcaagagcatgagcagccccaccatcatggccatcggcgccgccgagctggccatgaaggacagcggctggcacccccagagcgaggccgaccaggtggccaccggcgtggccatcggcatgggcatgatccccctggaggtggtgagcgagaccgccctgaacttccagaccaagggctacaacaaggtgagccccttcttcgtgcccaagatcctggtgaacatggccgccggccaggtgagcatcagatacaagctgaagggccccaaccacgccgtgagcaccgcctgcaccaccggcgcccacgccgtgggcgacagcttcagattcatcgcccacggcgacgccgacgtgatgtag

SEQ ID NO: 71120 - DNA, 663 bp, Artificial Sequence
  Description of Artificial Sequence: Synthetic coding sequence
atgagcaactgcctgcagaacttcctgaagatcaccagcaccagactgctgtgcagcagactgtgccagcagctgagaagcaagagaaagttcttcggcaccgtgcccatcagcagactgcacagaagagtggtgatcaccggcatcggcctggtgacccccctgggcgtgggcacccacctggtgtgggacagactgatcggcggcgagagcggcatcgtgagcctggtgggcgaggagtacaagagcatcccctgcagcgtggccgcctacgtgcccagaggcagcgacgagggccagttcaacgagcagaacttcgtgagcaagagcgacatcaagagcatgagcagccccaccatcatggccatcggcgccgccgagctggccatgaaggacagcggctggcacccccagagcgaggccgaccaggtggccaccggcgtggccatcggcatgggcatgatccccctggaggtggtgagcgagaccgccctgaacttccagaccaagggctacaacaaggtgagccccttcttcgtgcccaagatcctggtgaacatggccgccggccaggtgagcatcagatacaagctgaagggccccaaccacgccgtgagcaccgcctgcaccaccggcgcccacgccgtgggcgacagcttctag

SEQ ID NO: 71121 - DNA, 1875 bp, Artificial Sequence
  Description of Artificial Sequence: Synthetic coding sequence
atggagatccccggcagcctgtgcaagaaggtgaagctgagcaacaacgcccagaactggggcatgcagagagccaccaacgtgacctaccaggcccaccacgtgagcagaaacaagagaggccaggtggtgggcaccagaggcggcttcagaggctgcaccgtgtggctgaccggcctgagcggcgccggcaagaccaccgtgagcatggccctggaggagtacctggtgtgccacggcatcccctgctacaccctggacggcgacaacatcagacagggcctgaacaagaacctgggcttcagccccgaggacagagaggagaacgtgagaagaatcgccgaggtggccaagctgttcgccgacgccggcctggtgtgcatcaccagcttcatcagcccctacacccaggacagaaacaacgccagacagatccacgagggcgccagcctgcccttcttcgaggtgttcgtggacgcccccctgcacgtgtgcgagcagagagacgtgaagggcctgtacaagaaggccagagccggcgagatcaagggcttcaccggcatcgacagcgagtacgagaagcccgaggcccccgagctggtgctgaagaccgacagctgcgacgtgaacgactgcgtgcagcaggtggtggagctgctgcaggagagagacatcgtgcccgtggacgccagctacgaggtgaaggagctgtacgtgcccgagaacaagctgcacctggccaagaccgacgccgagaccctgcccgccctgaagatcaacaaggtggacatgcagtgggtgcaggtgctggccgagggctgggccacccccctgaacggcttcatgagagagagagagtacctgcagtgcctgcacttcgactgcctgctggacggcggcgtgatcaacctgagcgtgcccatcgtgctgaccgccacccacgaggacaaggagagactggacggctgcaccgccttcgccctgatgtacgagggcagaagagtggccatcctgagaaaccccgagttcttcgagcacagaaaggaggagagatgcgccagacagtggggcaccacctgcaagaaccacccctacatcaagatggtgatggagcagggcgactggctgatcggcggcgacctgcaggtgctggacagagtgtactggaacgacggcctggaccagtacagactgacccccaccgagctgaagcagaagttcaaggacatgaacgccgacgccgtgttcgccttccagctgagaaaccccgtgcacaacggccacgccctgctgatgcaggacacccacaagcagctgctggagagaggctacagaagacccgtgctgctgctgcaccccctgggcggctggaccaaggacgacgacgtgcccctgatgtggagaatgaagcagcacgccgccgtgctggaggagggcgtgctgaaccccgagaccaccgtggtggccatcttccccagccccatgatgtacgccggccccaccgaggtgcagtggcactgcagagccagaatggtggccggcgccaacttctacatcgtgggcagagaccccgccggcatgccccaccccgagaccggcaaggacctgtacgagcccagccacggcgccaaggtgctgaccatggcccccggcctgatcaccctggagatcgtgcccttcagagtggccgcctacaacaagaagaagaagagaatggactactacgacagcgagcaccacgaggacttcgagttcatcagcggcaccagaatgagaaagctggccagagagggccagaagccccccgagggcttcatggcccccaaggcctggaccgtgctgaccgagtactacaagagcctggagaaggcctag

SEQ ID NO: 71122 - DNA, 1845 bp, Artificial Sequence
  Description of Artificial Sequence: Synthetic coding sequence
atgagcggcatcaagaagcagaagaccgagaaccagcagaagagcaccaacgtggtgtaccaggcccaccacgtgagcagaaacaagagaggccaggtggtgggcaccagaggcggcttcagaggctgcaccgtgtggctgaccggcctgagcggcgccggcaagaccaccatcagcttcgccctggaggagtacctggtgagccacgccatcccctgctacagcctggacggcgacaacgtgagacacggcctgaacagaaacctgggcttcagccccggcgacagagaggagaacatcagaagaatcgccgaggtggccaagctgttcgccgacgccggcctggtgtgcatcaccagcttcatcagccccttcgccaaggacagagagaacgccagaaagatccacgagagcgccggcctgcccttcttcgagatcttcgtggacgcccccctgaacatctgcgagagcagagacgtgaagggcctgtacaagagagccagagccggcgagatcaagggcttcaccggcatcgacagcgactacgagaagcccgagacccccgagagagtgctgaagaccaacctgagcaccgtgagcgactgcgtgcaccaggtggtggagctgctgcaggagcagaacatcgtgccctacaccatcatcaaggacatccacgagctgttcgtgcccgagaacaagctggaccacgtgagagccgaggccgagaccctgcccagcctgagcatcaccaagctggacctgcagtgggtgcaggtgctgagcgagggctgggccacccccctgaagggcttcatgagagagaaggagtacctgcaggtgatgcacttcgacaccctgctggacgacggcgtgatcaacatgagcatccccatcgtgctgcccgtgagcgccgaggacaagaccagactggagggctgcagcaagttcgtgctggcccacggcggcagaagagtggccatcctgagagacgccgagttctacgagcacagaaaggaggagagatgcagcagagtgtggggcaccacctgcaccaagcacccccacatcaagatggtgatggagagcggcgactggctggtgggcggcgacctgcaggtgctggagaagatcagatggaacgacggcctggaccagtacagactgacccccctggagctgaagcagaagtgcaaggagatgaacgccgacgccgtgttcgccttccagctgagaaaccccgtgcacaacggccacgccctgctgatgcaggacaccagaagaagactgctggagagaggctacaagcaccccgtgctgctgctgcaccccctgggcggctggaccaaggacgacgacgtgcccctggactggagaatgaagcagcacgccgccgtgctggaggagggcgtgctggaccccaagagcaccatcgtggccatcttccccagccccatgctgtacgccggccccaccgaggtgcagtggcactgcagaagcagaatgatcgccggcgccaacttctacatcgtgggcagagaccccgccggcatgccccaccccgagaccaagaaggacctgtacgagcccacccacggcggcaaggtgctgagcatggcccccggcctgaccagcgtggagatcatccccttcagagtggccgcctacaacaaggccaagaaggccatggacttctacgaccccgccagacacaacgagttcgacttcatcagcggcaccagaatgagaaagctggccagagagggcgagaacccccccgacggcttcatggcccccaaggcctggaaggtgctgaccgactactacagaagcctggagaagaactag

SEQ ID NO: 71123 - DNA, 1857 bp, Artificial Sequence
  Description of Artificial Sequence: Synthetic coding sequence
agcggcaagaagcaggagaaggaggagaaccagcagaagagcaccaacgtggtgtaccaggcccaccacgtgagcagaaacaagagaggccaggtggtgggcaccagaggcggcttcagaggctgcaccgtgtggctgaccggcctgagcggcgccggcaagaccaccatcagcttcgccctggaggagtacctggtgagccacgccatcccctgctacagcctggacggcgacaacgtgagacacggcctgaacagaaacctgggcttcagccccggcgacagagaggagaacatcagaagaatcgccgaggtggccaagctgttcgccgacgccggcctggtgtgcatcaccagcttcatcagccccttcgccaaggacagagagaacgccagaaagatccacgagagcgccggcctgcccttcttcgagatcttcgtggacgcccccctgaacatctgcgagagcagagacgtgaagggcctgtacaagagagccagagccggcgagatcaagggcttcaccggcatcgacagcgactacgagaagcccgagacccccgagagagtgctgaagaccaacctgagcaccgtgagcgactgcgtgcaccaggtggtggagctgctgcaggagcagaacatcgtgccctacaccatcatcaaggacatccacgagctgttcgtgcccgagaacaagctggaccacgtgagagccgaggccgagaccctgcccagcctgagcatcaccaagctggacctgcagtgggtgcaggtgctgagcgagggctgggccacccccctgaagggcttcatgagagagaaggagtacctgcaggtgatgcacttcgacaccctgctggacggcatgttcctgctggacggcgtgatcaacatgagcatccccatcgtgctgcccgtgagcgccgaggacaagaccagactggagggctgcagcaagttcgtgctggcccacggcggcagaagagtggccatcctgagagacgccgagttctacgagcacagaaaggaggagagatgcagcagagtgtggggcaccacctgcaccaagcacccccacatcaagatggtgatggagagcggcgactggctggtgggcggcgacctgcaggtgctggagaagatcagatggaacgacggcctggaccagtacagactgacccccctggagctgaagcagaagtgcaaggagatgaacgccgacgccgtgttcgccttccagctgagaaaccccgtgcacaacggccacgccctgctgatgcaggacaccagaagaagactgctggagagaggctacaagcaccccgtgctgctgctgcaccccctgggcggctggaccaaggacgacgacgtgcccctggactggagaatgaagcagcacgccgccgtgctggaggagggcgtgctggaccccaagagcaccatcgtggccatcttccccagccccatgctgtacgccggccccaccgaggtgcagtggcactgcagaagcagaatgatcgccggcgccaacttctacatcgtgggcagagaccccgccggcatgccccaccccgagaccaagaaggacctgtacgagcccacccacggcggcaaggtgctgagcatggcccccggcctgaccagcgtggagatcatccccttcagagtggccgcctacaacaaggccaagaaggccatggacttctacgaccccgccagacacaacgagttcgacttcatcagcggcaccagaatgagaaagctggccagagagggcgagaacccccccgacggcttcatggcccccaaggcctggaaggtgctgaccgactactacagaagcctggagaagaactag

SEQ ID NO: 71124 - DNA, 1857 bp, Artificial Sequence
  Description of Artificial Sequence: Synthetic coding sequence
atgatcgtgctggtgaccgagtgggtggacctgagcctggagaaccagcagaagagcaccaacgtggtgtaccaggcccaccacgtgagcagaaacaagagaggccaggtggtgggcaccagaggcggcttcagaggctgcaccgtgtggctgaccggcctgagcggcgccggcaagaccaccatcagcttcgccctggaggagtacctggtgagccacgccatcccctgctacagcctggacggcgacaacgtgagacacggcctgaacagaaacctgggcttcagccccggcgacagagaggagaacatcagaagaatcgccgaggtggccaagctgttcgccgacgccggcctggtgtgcatcaccagcttcatcagccccttcgccaaggacagagagaacgccagaaagatccacgagagcgccggcctgcccttcttcgagatcttcgtggacgcccccctgaacatctgcgagagcagagacgtgaagggcctgtacaagagagccagagccggcgagatcaagggcttcaccggcatcgacagcgactacgagaagcccgagacccccgagagagtgctgaagaccaacctgagcaccgtgagcgactgcgtgcaccaggtggtggagctgctgcaggagcagaacatcgtgccctacaccatcatcaaggacatccacgagctgttcgtgcccgagaacaagctggaccacgtgagagccgaggccgagaccctgcccagcctgagcatcaccaagctggacctgcagtgggtgcaggtgctgagcgagggctgggccacccccctgaagggcttcatgagagagaaggagtacctgcaggtgatgcacttcgacaccctgctggacgacggcgtgatcaacatgagcatccccatcgtgctgcccgtgagcgccgaggacaagaccagactggagggctgcagcaagttcgtgctggcccacggcggcagaagagtggccatcctgagagacgccgagttctacgagcacagaaaggaggagagatgcagcagagtgtggggcaccacctgcaccaagcacccccacatcaagatggtgatggagagcggcgactggctggtgggcggcgacctgcaggtgctggagaagatcagatggaacgacggcctggaccagtacagactgacccccctggagctgaagcagaagtgcaaggagatgaacgccgacgccgtgttcgccttccagctgagaaaccccgtgcacaacggccacgccctgctgatgcaggacaccagaagaagactgctggagagaggctacaagcaccccgtgctgctgctgcaccccctgggcggctggaccaaggacgacgacgtgcccctggactggagaatgaagcagcacgccgccgtgctggaggagggcgtgctggaccccaagagcaccatcgtggccatcttccccagccccatgctgtacgccggccccaccgaggtgcagtggcactgcagaagcagaatgatcgccggcgccaacttctacatcgtgggcagagaccccgccggcatgccccaccccgagaccaagaaggacctgtacgagcccacccacggcggcaaggtgctgagcatggcccccggcctgaccagcgtggagatcatccccttcagagtggccgcctacaacaaggccaagaaggccatggacttctacgaccccgccagacacaacgagttcgacttcatcagcggcaccagaatgagaaagctggccagagagggcgagaacccccccgacggcttcatggcccccaaggcctggaaggtgctgaccgactactacagaagcctggagaagaactag

SEQ ID NO: 71125 - DNA, 1860 bp, Artificial Sequence
  Description of Artificial Sequence: Synthetic coding sequence
atgagcggcatcaagaagcagaagaccgagaaccagcagaagagcaccaacgtggtgtaccaggcccaccacgtgagcagaaacaagagaggccaggtggtgggcaccagaggcggcttcagaggctgcaccgtgtggctgaccggcctgagcggcgccggcaagaccaccatcagcttcgccctggaggagtacctggtgagccacgccatcccctgctacagcctggacggcgacaacgtgagacacggcctgaacagaaacctgggcttcagccccggcgacagagaggagaacatcagaagaatcgccgaggtggccaagctgttcgccgacgccggcctggtgtgcatcaccagcttcatcagccccttcgccaaggacagagagaacgccagaaagatccacgagagcgccggcctgcccttcttcgagatcttcgtggacgcccccctgaacatctgcgagagcagagacgtgaagggcctgtacaagagagccagagccggcgagatcaagggcttcaccggcatcgacagcgactacgagaagcccgagacccccgagagagtgctgaagaccaacctgagcaccgtgagcgactgcgtgcaccaggtggtggagctgctgcaggagcagaacatcgtgccctacaccatcatcaaggacatccacgagctgttcgtgcccgagaacaagctggaccacgtgagagccgaggccgagaccctgcccagcctgagcatcaccaagctggacctgcagtgggtgcaggtgctgagcgagggctgggccacccccctgaagggcttcatgagagagaaggagtacctgcaggtgatgcacttcgacaccctgctggacggcatggccctgcccgacggcgtgatcaacatgagcatccccatcgtgctgcccgtgagcgccgaggacaagaccagactggagggctgcagcaagttcgtgctggcccacggcggcagaagagtggccatcctgagagacgccgagttctacgagcacagaaaggaggagagatgcagcagagtgtggggcaccacctgcaccaagcacccccacatcaagatggtgatggagagcggcgactggctggtgggcggcgacctgcaggtgctggagaagatcagatggaacgacggcctggaccagtacagactgacccccctggagctgaagcagaagtgcaaggagatgaacgccgacgccgtgttcgccttccagctgagaaaccccgtgcacaacggccacgccctgctgatgcaggacaccagaagaagactgctggagagaggctacaagcaccccgtgctgctgctgcaccccctgggcggctggaccaaggacgacgacgtgcccctggactggagaatgaagcagcacgccgccgtgctggaggagggcgtgctggaccccaagagcaccatcgtggccatcttccccagccccatgctgtacgccggccccaccgaggtgcagtggcactgcagaagcagaatgatcgccggcgccaacttctacatcgtgggcagagaccccgccggcatgccccaccccgagaccaagaaggacctgtacgagcccacccacggcggcaaggtgctgagcatggcccccggcctgaccagcgtggagatcatccccttcagagtggccgcctacaacaaggccaagaaggccatggacttctacgaccccgccagacacaacgagttcgacttcatcagcggcaccagaatgagaaagctggccagagagggcgagaacccccccgacggcttcatggcccccaaggcctggaaggtgctgaccgactactacagaagcctggagaagaactag

SEQ ID NO: 71126 - DNA, 1503 bp, Artificial Sequence
  Description of Artificial Sequence: Synthetic coding sequence
atggccagcatgctgctggcccagagactggcctgcagcttccagcacagctacagactgctggtgcccggcagcagacacatcagccaggccgccgccaaggtggacgtggagttcgactacgacggccccctgatgaagaccgaggtgcccggccccagaagccaggagctgatgaagcagctgaacatcatccagaacgccgaggccgtgcacttcttctgcaactacgaggagagcagaggcaactacctggtggacgtggacggcaacagaatgctggacctgtacagccagatcagcagcgtgcccatcggctacagccaccccgccctgctgaagctgatccagcagccccagaacgccagcatgttcgtgaacagacccgccctgggcatcctgccccccgagaacttcgtggagaagctgagacagagcctgctgagcgtggcccccaagggcatgagccagctgatcaccatggcctgcggcagctgcagcaacgagaacgccctgaagaccatcttcatgtggtacagaagcaaggagagaggccagagaggcttcagccaggaggagctggagacctgcatgatcaaccaggcccccggctgccccgactacagcatcctgagcttcatgggcgccttccacggcagaaccatgggctgcctggccaccacccacagcaaggccatccacaagatcgacatccccagcttcgactggcccatcgcccccttccccagactgaagtaccccctggaggagttcgtgaaggagaaccagcaggaggaggccagatgcctggaggaggtggaggacctgatcgtgaagtacagaaagaagaagaagaccgtggccggcatcatcgtggagcccatccagagcgagggcggcgacaaccacgccagcgacgacttcttcagaaagctgagagacatcgccagaaagcacggctgcgccttcctggtggacgaggtgcagaccggcggcggctgcaccggcaagttctgggcccacgagcactggggcctggacgaccccgccgacgtgatgaccttcagcaagaagatgatgaccggcggcttcttccacaaggaggagttcagacccaacgccccctacagaatcttcaacacctggctgggcgaccccagcaagaacctgctgctggccgaggtgatcaacatcatcaagagagaggacctgctgaacaacgccgcccacgccggcaaggccctgctgaccggcctgctggacctgcaggccagatacccccagttcatcagcagagtgagaggcagaggcaccttctgcagcttcgacacccccgacgacagcatcagaaacaagctgatcctgatcgccagaaacaagggcgtggtgctgggcggctgcggcgacaagagcatcagattcagacccaccctggtgttcagagaccaccacgcccacctgttcctgaacatcttcagcgacatcctggccgacttcaagtag

SEQ ID NO: 71127 - DNA, 1503 bp, Artificial Sequence; identical to SEQ ID NO: 71126
  Description of Artificial Sequence: Synthetic coding sequence

SEQ ID NO: 71128 - DNA, 1503 bp, Artificial Sequence; identical to SEQ ID NO: 71126
  Description of Artificial Sequence: Synthetic coding sequence

SEQ ID NO: 71129 - DNA, 462 bp, Artificial Sequence
  Description of Artificial Sequence: Synthetic coding sequence
gtggacatggacggcgtgctggccgacttcgaggccggcctgctgagaggcttcagaagaagattccccgaggagccccacgtgcccctggagcagagaagaggcttcctggccagagagcagtacagagccctgagacccgacctggccgacaaggtggccagcgtgtacgaggcccccggcttcttcctggacctggagcccatccccggcgccctggacgccgtgagagagatgaacgacctgcccgacacccaggtgttcatctgcaccagccccctgctgaagtaccaccactgcgtgggcgagaaggaggagacccccagctgggagcacatcctgttcacctgctgccacaacagacacctggtgctgccccccaccagaagaagactgctgagctggagcgacaactggagagagatcctggacagcaagagaggcgccgcccagagagagtag

SEQ ID NO: 71130 - DNA, 606 bp, Artificial Sequence
  Description of Artificial Sequence: Synthetic coding sequence
atggccagaagcgtgagagtgctggtggacatggacggcgtgctggccgacttcgaggccggcctgctgagaggcttcagaagaagattccccgaggagccccacgtgcccctggagcagagaagaggcttcctggccagagagcagtacagagccctgagacccgacctggccgacaaggtggccagcgtgtacgaggcccccggcttcttcctggacctggagcccatccccggcgccctggacgccgtgagagagatgaacgacctgcccgacacccaggtgttcatctgcaccagccccctgctgaagtaccaccactgcgtgggcgagaagtacagatgggtggagcagcacctgggcccccagttcgtggagagaatcatcctgaccagagacaagaccgtggtgctgggcgacctgctgatcgacgacaaggacaccgtgagaggccaggaggagacccccagctgggagcacatcctgttcacctgctgccacaacagacacctggtgctgccccccaccagaagaagactgctgagctggagcgacaactggagagagatcctggacagcaagagaggcgccgcccagagagagtag

SEQ ID NO: 71131 - DNA, 687 bp, Artificial Sequence
  Description of Artificial Sequence: Synthetic coding sequence
atgatcagactgggcggctggtgcgccagaagactgtgcagcgccgccgtgcccgccggcagaagaggcgccgccggcggcctgggcctggccggcggcagagccctgagagtgctggtggacatggacggcgtgctggccgacttcgagggcggcttcctgagaaagttcagagccagattccccgaccagcccttcatcgccctggaggacagaagaggcttctgggtgagcgagcagtacggcagactgagacccggcctgagcgagaaggccatcagcatctgggagagcaagaacttcttcttcgagctggagcccctgcccggcgccgtggaggccgtgaaggagatggccagcctgcagaacaccgacgtgttcatctgcaccagccccatcaagatgttcaagtactgcccctacgagaagtacgcctgggtggagaagtacttcggccccgacttcctggagcagatcgtgctgaccagagacaagaccgtggtgagcgccgacctgctgatcgacgacagacccgacatcaccggcgccgagcccacccccagctgggagcacgtgctgttcaccgcctgccacaaccagcacctgcagctgcagccccccagaagaagactgcacagctgggccgacgactggaaggccatcctggacagcaagagaccctgctag

SEQ ID NO: 71132 - DNA, 720 bp, Artificial Sequence
  Description of Artificial Sequence: Synthetic coding sequence
atgatcagactgggcggctggtgcgccagaagactgtgcagcgccgccgtgcccgccggcagaagaggcgccgccggcggcctgggcctggccggcggcagagccctgagagtgctggtggacatggacggcgtgctggccgacttcgagggcggcttcctgagaaagttcagagccagattccccgaccagcccttcatcgccctggaggacagaagaggcttctgggtgagcgagcagtacggcagactgagacccggcctgagcgagaaggccatcagcatctgggagagcaagaacttcttcttcgagctggagcccctgcccggcgccgtggaggccgtgaaggagatggccagcctgcagaacaccgacgtgttcatctgcaccagccccatcaagatgttcaagtactgcccctacgagaagtacgcctgggtggagaagtacttcggccccgacttcctggagcagatcgtgctgaccagagacaagaccgtggtgagcgccgacctgctgatcgacgacagacccgacatcaccggcaaccagccccccgccggcagcatgagcagcagcccccccgccaccaccagcacctgcagctgcagcccccccgccgccggctgcaccagaggcagaaccaccggcagacccttctggaccgccagcggccccgccgagctggactgcgccagcggcagcagcgtgggcctgtag

SEQ ID NO: 71133 - DNA, 2853 bp, Artificial Sequence
  Description of Artificial Sequence: Synthetic coding sequence
atgggcgtgcccgccttcttcagatggctgagcagaaagtaccccagcatcatcgtgaactgcgtggaggagaagcccaaggagtgcaacggcgtgaagatccccgtggacgccagcaagcccaaccccaacgacgtggagttcgacaacctgtacctggacatgaacggcatcatccacccctgcacccaccccgaggacaagcccgcccccaagaacgaggacgagatgatggtggccatcttcgagtacatcgacagactgttcagcatcgtgagacccagaagactgctgtacatggccatcgacggcgtggcccccagagccaagatgaaccagcagagaagcagaagattcagagccagcaaggagggcatggaggccgccgtggagaagcagagagtgagagaggagatcctggccaagggcggcttcctgccccccgaggagatcaaggagagattcgacagcaactgcatcacccccggcaccgagttcatggacaacctggccaagtgcctgagatactacatcgccgacagactgaacaacgaccccggctggaagaacctgaccgtgatcctgagcgacgccagcgcccccggcgagggcgagcacaagatcatggactacatcagaagacagagagcccagcccaaccacgaccccaacacccaccactgcctgtgcggcgccgacgccgacctgatcatgctgggcctggccacccacgagcccaacttcaccatcatcagagaggagttcaagcccaacaagcccaagccctgcggcctgtgcaaccagttcggccacgaggtgaaggactgcgagggcctgcccagagagaagaagggcaagcacgacgagctggccgacagcctgccctgcgccgagggcgagttcatcttcctgagactgaacgtgctgagagagtacctggagagagagctgaccatggccagcctgcccttcaccttcgacgtggagagaagcatcgacgactgggtgttcatgtgcttcttcgtgggcaacgacttcctgccccacctgcccagcctggagatcagagagaacgccatcgacagactggtgaacatctacaagaacgtggtgcacaagaccggcggctacctgaccgagagcggctacgtgaacctgcagagagtgcagatgatcatgctggccgtgggcgaggtggaggacagcatcttcaagaagagaaaggacgacgaggacagcttcagaagaagacagaaggagaagagaaagagaatgaagagagaccagcccgccttcacccccagcggcatcctgaccccccacgccctgggcagcagaaacagccccggcagccaggtggccagcaaccccagacaggccgcctacgagatgagaatgcagaacaacagcagccccagcatcagccccaacaccagcttcaccagcgacggcagccccagccccctgggcggcatcaagagaaaggccgaggacagcgacagcgagcccgagcccgaggacaacgtgagactgtgggaggccggctggaagcagagatactacaagaacaagttcgacgtggacgccgccgacgagaagttcagaagaaaggtggtgcagagctacgtggagggcctgtgctgggtgctgagatactactaccagggctgcgccagctggaagtggtactaccccttccactacgcccccttcgccagcgacttcgagggcatcgccgacatgcccagcgacttcgagaagggcaccaagcccttcaagcccctggagcagctgatgggcgtgttccccgccgccagcggcaacttcctgccccccagctggagaaagctgatgagcgaccccgacagcagcatcatcgacttctaccccgaggacttcgccatcgacctgaacggcaagaagtacgcctggcagggcgtggccctgctgcccttcgtggacgagagaagactgagagccgccctggaggaggtgtaccccgacctgacccccgaggagaccagaagaaacagcctgggcggcgacgtgctgttcgtgggcaagcaccaccccctgcacgacttcatcctggagctgtaccagaccggcagcaccgagcccgtggaggtgccccccgagctgtgccacggcatccagggcaagttcagcctggacgaggaggccatcctgcccgaccagatcgtgtgcagccccgtgcccatgctgagagacctgacccagaacaccgtggtgagcatcaacttcaaggacccccagttcgccgaggactacatcttcaaggccgtgatgctgcccggcgccagaaagcccgccgccgtgctgaagcccagcgactgggagaagagcagcaacggcagacagtggaagccccagctgggcttcaacagagacagaagacccgtgcacctggaccaggccgccttcagaaccctgggccacgtgatgcccagaggcagcggcaccggcatctacagcaacgccgcccccccccccgtgacctaccagggcaacctgtacagacccctgctgagaggccaggcccagatccccaagctgatgagcaacatgagaccccaggacagctggagaggccccccccccctgttccagcagcagagattcgacagaggcgtgggcgccgagcccctgctgccctggaacagaatgctgcagacccagaacgccgccttccagcccaaccagtaccagatgctggccggccccggcggctacccccccagaagagacgacagaggcggcagacagggctaccccagagagggcagaaagtaccccctgcccccccccagcggcagatacaactggaactag

SEQ ID NO: 71134 - DNA, 2625 bp, Artificial Sequence
  Description of Artificial Sequence: Synthetic coding sequence
atgatggtggccatcttcgagtacatcgacagactgttcagcatcgtgagacccagaagactgctgtacatggccatcgacggcgtggcccccagagccaagatgaaccagcagagaagcagaagattcagagccagcaaggagggcatggaggccgccgtggagaagcagagagtgagagaggagatcctggccaagggcggcttcctgccccccgaggagatcaaggagagattcgacagcaactgcatcacccccggcaccgagttcatggacaacctggccaagtgcctgagatactacatcgccgacagactgaacaacgaccccggctggaagaacctgaccgtgatcctgagcgacgccagcgcccccggcgagggcgagcacaagatcatggactacatcagaagacagagagcccagcccaaccacgaccccaacacccaccactgcctgtgcggcgccgacgccgacctgatcatgctgggcctggccacccacgagcccaacttcaccatcatcagagaggagttcaagcccaacaagcccaagccctgcggcctgtgcaaccagttcggccacgaggtgaaggactgcgagggcctgcccagagagaagaagggcaagcacgacgagctggccgacagcctgccctgcgccgagggcgagttcatcttcctgagactgaacgtgctgagagagtacctggagagagagctgaccatggccagcctgcccttcaccttcgacgtggagagaagcatcgacgactgggtgttcatgtgcttcttcgtgggcaacgacttcctgccccacctgcccagcctggagatcagagagaacgccatcgacagactggtgaacatctacaagaacgtggtgcacaagaccggcggctacctgaccgagagcggctacgtgaacctgcagagagtgcagatgatcatgctggccgtgggcgaggtggaggacagcatcttcaagaagagaaaggacgacgaggacagcttcagaagaagacagaaggagaagagaaagagaatgaagagagaccagcccgccttcacccccagcggcatcctgaccccccacgccctgggcagcagaaacagccccggcagccaggtggccagcaaccccagacaggccgcctacgagatgagaatgcagaacaacagcagccccagcatcagccccaacaccagcttcaccagcgacggcagccccagccccctgggcggcatcaagagaaaggccgaggacagcgacagcgagcccgagcccgaggacaacgtgagactgtgggaggccggctggaagcagagatactacaagaacaagttcgacgtggacgccgccgacgagaagttcagaagaaaggtggtgcagagctacgtggagggcctgtgctgggtgctgagatactactaccagggctgcgccagctggaagtggtactaccccttccactacgcccccttcgccagcgacttcgagggcatcgccgacatgcccagcgacttcgagaagggcaccaagcccttcaagcccctggagcagctgatgggcgtgttccccgccgccagcggcaacttcctgccccccagctggagaaagctgatgagcgaccccgacagcagcatcatcgacttctaccccgaggacttcgccatcgacctgaacggcaagaagtacgcctggcagggcgtggccctgctgcccttcgtggacgagagaagactgagagccgccctggaggaggtgtaccccgacctgacccccgaggagaccagaagaaacagcctgggcggcgacgtgctgttcgtgggcaagcaccaccccctgcacgacttcatcctggagctgtaccagaccggcagcaccgagcccgtggaggtgccccccgagctgtgccacggcatccagggcaagttcagcctggacgaggaggccatcctgcccgaccagatcgtgtgcagccccgtgcccatgctgagagacctgacccagaacaccgtggtgagcatcaacttcaaggacccccagttcgccgaggactacatcttcaaggccgtgatgctgcccggcgccagaaagcccgccgccgtgctgaagcccagcgactgggagaagagcagcaacggcagacagtggaagccccagctgggcttcaacagagacagaagacccgtgcacctggaccaggccgccttcagaaccctgggccacgtgatgcccagaggcagcggcaccggcatctacagcaacgccgcccccccccccgtgacctaccagggcaacctgtacagacccctgctgagaggccaggcccagatccccaagctgatgagcaacatgagaccccaggacagctggagaggccccccccccctgttccagcagcagagattcgacagaggcgtgggcgccgagcccctgctgccctggaacagaatgctgcagacccagaacgccgccttccagcccaaccagtaccagatgctggccggccccggcggctacccccccagaagagacgacagaggcggcagacagggctaccccagagagggcagaaagtaccccctgcccccccccagcggcagatacaactggaactag

SEQ ID NO: 71135 - DNA, 2691 bp, Artificial Sequence
  Description of Artificial Sequence: Synthetic coding sequence
atgaacggcatcatccacccctgcacccaccccgaggacaagcccgcccccaagaacgaggacgagatgatggtggccatcttcgagtacatcgacagactgttcagcatcgtgagacccagaagactgctgtacatggccatcgacggcgtggcccccagagccaagatgaaccagcagagaagcagaagattcagagccagcaaggagggcatggaggccgccgtggagaagcagagagtgagagaggagatcctggccaagggcggcttcctgccccccgaggagatcaaggagagattcgacagcaactgcatcacccccggcaccgagttcatggacaacctggccaagtgcctgagatactacatcgccgacagactgaacaacgaccccggctggaagaacctgaccgtgatcctgagcgacgccagcgcccccggcgagggcgagcacaagatcatggactacatcagaagacagagagcccagcccaaccacgaccccaacacccaccactgcctgtgcggcgccgacgccgacctgatcatgctgggcctggccacccacgagcccaacttcaccatcatcagagaggagttcaagcccaacaagcccaagccctgcggcctgtgcaaccagttcggccacgaggtgaaggactgcgagggcctgcccagagagaagaagggcaagcacgacgagctggccgacagcctgccctgcgccgagggcgagttcatcttcctgagactgaacgtgctgagagagtacctggagagagagctgaccatggccagcctgcccttcaccttcgacgtggagagaagcatcgacgactgggtgttcatgtgcttcttcgtgggcaacgacttcctgccccacctgcccagcctggagatcagagagaacgccatcgacagactggtgaacatctacaagaacgtggtgcacaagaccggcggctacctgaccgagagcggctacgtgaacctgcagagagtgcagatgatcatgctggccgtgggcgaggtggaggacagcatcttcaagaagagaaaggacgacgaggacagcttcagaagaagacagaaggagaagagaaagagaatgaagagagaccagcccgccttcacccccagcggcatcctgaccccccacgccctgggcagcagaaacagccccggcagccaggtggccagcaaccccagacaggccgcctacgagatgagaatgcagaacaacagcagccccagcatcagccccaacaccagcttcaccagcgacggcagccccagccccctgggcggcatcaagagaaaggccgaggacagcgacagcgagcccgagcccgaggacaacgtgagactgtgggaggccggctggaagcagagatactacaagaacaagttcgacgtggacgccgccgacgagaagttcagaagaaaggtggtgcagagctacgtggagggcctgtgctgggtgctgagatactactaccagggctgcgccagctggaagtggtactaccccttccactacgcccccttcgccagcgacttcgagggcatcgccgacatgcccagcgacttcgagaagggcaccaagcccttcaagcccctggagcagctgatgggcgtgttccccgccgccagcggcaacttcctgccccccagctggagaaagctgatgagcgaccccgacagcagcatcatcgacttctaccccgaggacttcgccatcgacctgaacggcaagaagtacgcctggcagggcgtggccctgctgcccttcgtggacgagagaagactgagagccgccctggaggaggtgtaccccgacctgacccccgaggagaccagaagaaacagcctgggcggcgacgtgctgttcgtgggcaagcaccaccccctgcacgacttcatcctggagctgtaccagaccggcagcaccgagcccgtggaggtgccccccgagctgtgccacggcatccagggcaagttcagcctggacgaggaggccatcctgcccgaccagatcgtgtgcagccccgtgcccatgctgagagacctgacccagaacaccgtggtgagcatcaacttcaaggacccccagttcgccgaggactacatcttcaaggccgtgatgctgcccggcgccagaaagcccgccgccgtgctgaagcccagcgactgggagaagagcagcaacggcagacagtggaagccccagctgggcttcaacagagacagaagacccgtgcacctggaccaggccgccttcagaaccctgggccacgtgatgcccagaggcagcggcaccggcatctacagcaacgccgcccccccccccgtgacctaccagggcaacctgtacagacccctgctgagaggccaggcccagatccccaagctgatgagcaacatgagaccccaggacagctggagaggccccccccccctgttccagcagcagagattcgacagaggcgtgggcgccgagcccctgctgccctggaacagaatgctgcagacccagaacgccgccttccagcccaaccagtaccagatgctggccggccccggcggctacccccccagaagagacgacagaggcggcagacagggctaccccagagagggcagaaagtaccccctgcccccccccagcggcagatacaactggaactag

SEQ ID NO: 71136 - DNA, 1779 bp, Artificial Sequence
  Description of Artificial Sequence: Synthetic coding sequence
atggcccccggccagctggccctgttcagcgtgagcgacaagaccggcctggtggagttcgccagaaacctgaccgccctgggcctgaacctggtggccagcggcggcaccgccaaggccctgagagacgccggcctggccgtgagagacgtgagcgagctgaccggcttccccgagatgctgggcggcagagtgaagaccctgcaccccgccgtgcacgccggcatcctggccagaaacatccccgaggacaacgccgacatggccagactggacttcaacctgatcagagtggtggcctgcaacctgtaccccttcgtgaagaccgtggccagccccggcgtgaccgtggaggaggccgtggagcagatcgacatcggcggcgtgaccctgctgagagccgccgccaagaaccacgccagagtgaccgtggtgtgcgagcccgaggactacgtggtggtgagcaccgagatgcagagcagcgagagcaaggacaccagcctggagaccagaagacagctggccctgaaggccttcacccacaccgcccagtacgacgaggccatcagcgactacttcagaaagcagtacagcaagggcgtgagccagatgcccctgagatacggcatgaacccccaccagacccccgcccagctgtacaccctgcagcccaagctgcccatcaccgtgctgaacggcgcccccggcttcatcaacctgtgcgacgccctgaacgcctggcagctggtgaaggagctgaaggaggccctgggcatccccgccgccgccagcttcaagcacgtgagccccgccggcgccgccgtgggcatccccctgagcgaggacgaggccaaggtgtgcatggtgtacgacctgtacaagaccctgacccccatcagcgccgcctacgccagagccagaggcgccgacagaatgagcagcttcggcgacttcgtggccctgagcgacgtgtgcgacgtgcccaccgccaagatcatcagcagagaggtgagcgacggcatcatcgcccccggctacgaggaggaggccctgaccatcctgagcaagaagaagaacggcaactactgcgtgctgcagatggaccagagctacaagcccgacgagaacgaggtgagaaccctgttcggcctgcacctgagccagaagagaaacaacggcgtggtggacaagagcctgttcagcaacgtggtgaccaagaacaaggacctgcccgagagcgccctgagagacctgatcgtggccaccatcgccgtgaagtacacccagagcaacagcgtgtgctacgccaagaacggccaggtgatcggcatcggcgccggccagcagagcagaatccactgcaccagactggccggcgacaaggccaactactggtggctgagacaccacccccaggtgctgagcatgaagttcaagaccggcgtgaagagagccgagatcagcaacgccatcgaccagtacgtgaccggcaccatcggcgaggacgaggacctgatcaagtggaaggccctgttcgaggaggtgcccgagctgctgaccgaggccgagaagaaggagtgggtggagaagctgaccgaggtgagcatcagcagcgacgccttcttccccttcagagacaacgtggacagagccaagagaagcggcgtggcctacatcgccgcccccagcggcagcgccgccgacaaggtggtgatcgaggcctgcgacgagctgggcatcatcctggcccacaccaacctgagactgttccaccactag

SEQ ID NO: 71137 - DNA, 1602 bp, Artificial Sequence
  Description of Artificial Sequence: Synthetic coding sequence
atgctgggcggcagagtgaagaccctgcaccccgccgtgcacgccggcatcctggccagaaacatccccgaggacaacgccgacatggccagactggacttcaacctgatcagagtggtggcctgcaacctgtaccccttcgtgaagaccgtggccagccccggcgtgaccgtggaggaggccgtggagcagatcgacatcggcggcgtgaccctgctgagagccgccgccaagaaccacgccagagtgaccgtggtgtgcgagcccgaggactacgtggtggtgagcaccgagatgcagagcagcgagagcaaggacaccagcctggagaccagaagacagctggccctgaaggccttcacccacaccgcccagtacgacgaggccatcagcgactacttcagaaagcagtacagcaagggcgtgagccagatgcccctgagatacggcatgaacccccaccagacccccgcccagctgtacaccctgcagcccaagctgcccatcaccgtgctgaacggcgcccccggcttcatcaacctgtgcgacgccctgaacgcctggcagctggtgaaggagctgaaggaggccctgggcatccccgccgccgccagcttcaagcacgtgagccccgccggcgccgccgtgggcatccccctgagcgaggacgaggccaaggtgtgcatggtgtacgacctgtacaagaccctgacccccatcagcgccgcctacgccagagccagaggcgccgacagaatgagcagcttcggcgacttcgtggccctgagcgacgtgtgcgacgtgcccaccgccaagatcatcagcagagaggtgagcgacggcatcatcgcccccggctacgaggaggaggccctgaccatcctgagcaagaagaagaacggcaactactgcgtgctgcagatggaccagagctacaagcccgacgagaacgaggtgagaaccctgttcggcctgcacctgagccagaagagaaacaacggcgtggtggacaagagcctgttcagcaacgtggtgaccaagaacaaggacctgcccgagagcgccctgagagacctgatcgtggccaccatcgccgtgaagtacacccagagcaacagcgtgtgctacgccaagaacggccaggtgatcggcatcggcgccggccagcagagcagaatccactgcaccagactggccggcgacaaggccaactactggtggctgagacaccacccccaggtgctgagcatgaagttcaagaccggcgtgaagagagccgagatcagcaacgccatcgaccagtacgtgaccggcaccatcggcgaggacgaggacctgatcaagtggaaggccctgttcgaggaggtgcccgagctgctgaccgaggccgagaagaaggagtgggtggagaagctgaccgaggtgagcatcagcagcgacgccttcttccccttcagagacaacgtggacagagccaagagaagcggcgtggcctacatcgccgcccccagcggcagcgccgccgacaaggtggtgatcgaggcctgcgacgagctgggcatcatcctggcccacaccaacctgagactgttccaccactag

SEQ ID NO: 71138 - DNA, 3252 bp, Artificial Sequence
  Description of Artificial Sequence: Synthetic coding sequence
atgaagggcaccagagccatcggcagcgtgcccgagagaagccccgccggcgtggacctgagcctgaccggcctgcccccccccgtgagcagaagacccggcagcgccgccaccaccaagcccatcgtgagaagcgtgagcgtggtgaccggcagcgagcagaagagaaaggtgctggaggccaccggccccggcggcagccaggccatcaacaacctgagaagaagcaacagcaccacccaggtgagccagcccagaagcggcagccccagacccaccgagcccaccgacttcctgatgctgttcgagggcagccccagcggcaagaagagacccgccagcctgagcaccgcccccagcgagaagggcgccacctggaacgtgctggacgaccagcccagaggcttcaccctgcccagcaacgccagaagcagcagcgccctggacagccccgccggccccagaagaaaggagtgcaccgtggccctggcccccaacttcaccgccaacaacagaagcaacaagggcgccgtgggcaactgcgtgaccaccatggtgcacaacagatacacccccagcgagagagccccccccctgaagagcagcaaccagaccgcccccagcctgaacaacatcatcaaggccgccacctgcgagggcagcgagagcagcggcttcggcaagctgcccaagaacgtgagcagcgccacccacagcgccagaaacaacaccggcggcagcaccggcctgcccagaagaaaggaggtgaccgaggaggaggccgagagattcatccaccaggtgaaccaggccaccgtgaccatccagagatggtacagacaccaggtgcagagaagaggcgccggcgccgccagactggagcacctgctgcaggccaagagagaggagcagagacagagaagcggcgagggcaccctgctggacctgcaccagcagaaggaggccgccagaagaaaggccagagaggagaaggccagacaggccagaagagccgccatccaggagctgcagcagaagagagccctgagagcccagaaggccagcaccgccgagagaggcccccccgagaaccccagagagaccagagtgcccggcatgagacagcccgcccaggagctgagccccacccccggcggcaccgcccaccaggccctgaaggccaacaacaccggcggcggcctgcccgccgccggccccggcgacagatgcctgcccaccagcgacagcagccccgagccccagcagccccccgaggacagaacccaggacgtgctggcccaggacgccgccggcgacaacctggagatgatggcccccagcagaggcagcgccaagagcagaggccccctggaggagctgctgcacaccctgcagctgctggagaaggagcccgacgtgctgcccagacccagaacccaccacagaggcagatacgcctgggccagcgaggtgaccaccgaggacgacgccagcagcctgaccgccgacaacctggagaagttcggcaagctgagcgccttccccgagccccccgaggacggcaccctgctgagcgaggccaagctgcagagcatcatgagcttcctggacgagatggagaagagcggccaggaccagctggacagccagcaggagggctgggtgcccgaggccggccccggccccctggagctgggcagcgaggtgagcaccagcgtgatgagactgaagctggaggtggaggagaagaagcaggccatgctgctgctgcagagagccctggcccagcagagagacctgaccgccagaagagtgaaggagaccgagaaggccctgagcagacagctgcagagacagagagagcactacgaggccaccatccagagacacctggccttcatcgaccagctgatcgaggacaagaaggtgctgagcgagaagtgcgaggccgtggtggccgagctgaagcaggaggaccagagatgcaccgagagagtggcccaggcccaggcccagcacgagctggagatcaagaagctgaaggagctgatgagcgccaccgagaaggccagaagagagaagtggatcagcgagaagaccaagaagatcaaggaggtgaccgtgagaggcctggagcccgagatccagaagctgatcgccagacacaagcaggaggtgagaagactgaagagcctgcacgaggccgagctgctgcagagcgacgagagagccagccagagatgcctgagacaggccgaggagctgagagagcagctggagagagagaaggaggccctgggccagcaggagagagagagagccagacagagattccagcagcacctggagcaggagcagtgggccctgcagcagcagagacagagactgtacagcgaggtggccgaggagagagagagactgggccagcaggccgccagacagagagccgagctggaggagctgagacagcagctggaggagagcagcagcgccctgaccagagccctgagagccgagttcgagaagggcagagaggagcaggagagaagacaccagatggagctgaacaccctgaagcagcagctggagctggagagacaggcctgggaggccggcagaaccagaaaggaggaggcctggctgctgaacagagagcaggagctgagagaggagatcagaaagggcagagacaaggagatcgagctggtgatccacagactggaggccgacatggccctggccaaggaggagagcgagaaggccgccgagagcagaatcaagagactgagagacaagtacgaggccgagctgagcgagctggagcagagcgagagaaagctgcaggagagatgcagcgagctgaagggccagctgggcgaggccgagggcgagaacctgagactgcagggcctggtgagacagaaggagagagccctggaggacgcccaggccgtgaacgagcagctgagcagcgagagaagcaacctggcccaggtgatcagacaggagttcgaggacagactggccgccagcgaggaggagaccagacaggccaaggccgagctggccaccctgcaggccagacagcagctggagctggaggaggtgcacagaagagtgaagaccgccctggccagaaaggaggaggccgtgagcagcctgagaacccagcacgaggccgccgtgaagagagccgaccacctggaggagctgctggagcagcacagaagacccacccccagcaccaagtag

SEQ ID NO: 71139 - DNA, 3135 bp, Artificial Sequence
  Description of Artificial Sequence: Synthetic coding sequence
atgaagggcaccagagccatcggcagcgtgcccgagagaagccccgccggcgtggacctgagcctgaccggcctgcccccccccgtgagcagaagacccggcagcgccgccaccaccaagcccatcgtgagaagcgtgagcgtggtgaccggcagcgagcagaagagaaaggtgctggaggccaccggccccggcggcagccaggccatcaacaacctgagaagaagcaacagcaccacccaggtgagccagcccagaagcggcagccccagacccaccgagcccaccgacttcctgatgctgttcgagggcagccccagcggcaagaagagacccgccagcctgagcaccgcccccagcgagaagggcgccacctggaacgtgctggacgaccagcccagaggcttcaccctgcccagcaacgccagaagcagcagcgccctggacagccccgccggccccagaagaaaggagtgcaccgtggccctggcccccaacttcaccgccaacaacagaagcaacaagggcgccgtgggcaactgcgtgaccaccatggtgcacaacagatacacccccagcgagagagccccccccctgaagagcagcaaccagaccgcccccagcctgaacaacatcatcaaggccgccacctgcgagggcagcgagagcagcggcttcggcaagctgcccaagaacgtgagcagcgccacccacagcgccagaaacaacaccggcggcagcaccggcctgcccagaagaaaggaggtgaccgaggaggaggccgagagattcatccaccaggtgaaccaggccaccgtgaccatccagagatggtacagacaccaggtgcagagaagaggcgccggcgccgccagactggagcacctgctgcaggccaagagagaggagcagagacagagaagcggcgagggcaccctgctggacctgcaccagcagaaggaggccgccagaagaaaggccagagaggagaaggccagacaggccagaagagccgccatccaggagctgcagcagaagagagccctgagagcccagaaggccagcaccgccgagagaggcccccccgagaaccccagagagaccagagtgcccggcatgagacagcccgcccaggagctgagccccacccccggcggcaccgcccaccaggccctgaaggccaacaacaccggcggcggcctgcccgccgccggccccggcgacagatgcctgcccaccagcgacagcagccccgagccccagcagccccccgaggacagaacccaggacgtgctggcccaggacgccgccggcgacaacctggagatgatggcccccagcagaggcagcgccaagagcagaggccccctggaggagctgctgcacaccctgcagctgctggagaaggagcccgacgtgctgcccagacccagaacccaccacagaggcagatacgcctgggccagcgaggaggacgacgccagcagcctgaccgccgacaacctggagaagttcggcaagctgagcgccttccccgagccccccgaggacggcaccctgctgagcgaggccaagctgcagagcatcatgagcttcctggacgagatggagaagagcggccaggaccagctggacagccagcaggagggctgggtgcccgaggccggccccggccccctggagctgggcagcgaggtgagcaccagcgtgatgagactgaagctggaggtggaggagaagaagcaggccatgctgctgctgcagagagccctggcccagcagagagacctgaccgccagaagagtgaaggagaccgagaaggccctgagcagacagctgcagagacagagagagcactacgaggccaccatccagagacacctggccttcatcgaccagctgatcgaggacaagaaggtgctgagcgagaagtgcgaggccgtggtggccgagctgaagcaggaggaccagagatgcaccgagagagtggcccaggcccaggcccagcacgagctggagatcaagaagctgaaggagctgatgagcgccaccgagaaggccagaagagagaagtggatcagcgagaagaccaagaagatcaaggaggtgaccgtgagaggcctggagcccgagatccagaagctgatcgccagacacaagcaggaggtgagaagactgaagagcctgcacgaggccgagctgctgcagagcgacgagagagccagccagagatgcctgagacaggccgaggagctgagagagcagctggagagagagaaggaggccctgggccagcaggagagagagagagccagacagagacagagagccgagctggaggagctgagacagcagctggaggagagcagcagcgccctgaccagagccctgagagccgagttcgagaagggcagagaggagcaggagagaagacaccagatggagctgaacaccctgaagcagcagctggagctggagagacaggcctgggaggccggcagaaccagaaaggaggaggcctggctgctgaacagagagcaggagctgagagaggagatcagaaagggcagagacaaggagatcgagctggtgatccacagactggaggccgacatggccctggccaaggaggagagcgagaaggccgccgagagcagaatcaagagactgagagacaagtacgaggccgagctgagcgagctggagcagagcgagagaaagctgcaggagagatgcagcgagctgaagggccagctgggcgaggccgagggcgagaacctgagactgcagggcctggtgagacagaaggagagagccctggaggacgcccaggccgtgaacgagcagctgagcagcgagagaagcaacctggcccaggtgatcagacaggagttcgaggacagactggccgccagcgaggaggagaccagacaggccaaggccgagctggccaccctgcaggccagacagcagctggagctggaggaggtgcacagaagagtgaagaccgccctggccagaaaggaggaggccgtgagcagcctgagaacccagcacgaggccgccgtgaagagagccgaccacctggaggagctgctggagcagcacagaagacccacccccagcaccaagtag

SEQ ID NO: 71140 - DNA, 3243 bp, Artificial Sequence
  Description of Artificial Sequence: Synthetic coding sequence
atgaagggcaccagagccatcggcagcgtgcccgagagaagccccgccggcgtggacctgagcctgaccggcctgcccccccccgtgagcagaagacccggcagcgccgccaccaccaagcccatcgtgagaagcgtgagcgtggtgaccggcagcgagcagaagagaaaggtgctggaggccaccggccccggcggcagccaggccatcaacaacctgagaagaagcaacagcaccacccaggtgagccagcccagaagcggcagccccagacccaccgagcccaccgacttcctgatgctgttcgagggcagccccagcggcaagaagagacccgccagcctgagcaccgcccccagcgagaagggcgccacctggaacgtgctggacgaccagcccagaggcttcaccctgcccagcaacgccagaagcagcagcgccctggacagccccgccggccccagaagaaaggagtgcaccgtggccctggcccccaacttcaccgccaacaacagaagcaacaagggcgccgtgggcaactgcgtgaccaccatggtgcacaacagatacacccccagcgagagagccccccccctgaagagcagcaaccagaccgcccccagcctgaacaacatcatcaaggccgccacctgcgagggcagcgagagcagcggcttcggcaagctgcccaagaacgtgagcagcgccacccacagcgccagaaacaacaccggcggcagcaccggcctgcccagaagaaaggaggtgaccgaggaggaggccgagagattcatccaccaggtgaaccaggccaccgtgaccatccagagatggtacagacaccaggtgcagagaagaggcgccggcgccgccagactggagcacctgctgcaggccaagagagaggagcagagacagagaagcggcgagggcaccctgctggacctgcaccagcagaaggaggccgccagaagaaaggccagagaggagaaggccagacaggccagaagagccgccatccaggagctgcagcagaagagagccctgagagcccagaaggccagcaccgccgagagaggcccccccgagaaccccagagagaccagagtgcccggcatgagacagcccgcccaggagctgagccccacccccggcggcaccgcccaccaggccctgaaggccaacaacaccggcggcggcctgcccgccgccggccccggcgacagatgcctgcccaccagcgacagcagccccgagccccagcagccccccgaggacagaacccaggacgtgctggcccaggacgccgccggcgacaacctggagatgatggcccccagcagaggcagcgccaagagcagaggccccctggaggagctgctgcacaccctgcagctgctggagaaggagcccgacgtgctgcccagacccagaacccaccacagaggcagatacgcctgggccagcgaggaggacgacgccagcagcctgaccgccgacaacctggagaagttcggcaagctgagcgccttccccgagccccccgaggacggcaccctgctgagcgaggccaagctgcagagcatcatgagcttcctggacgagatggagaagagcggccaggaccagctggacagccagcaggagggctgggtgcccgaggccggccccggccccctggagctgggcagcgaggtgagcaccagcgtgatgagactgaagctggaggtggaggagaagaagcaggccatgctgctgctgcagagagccctggcccagcagagagacctgaccgccagaagagtgaaggagaccgagaaggccctgagcagacagctgcagagacagagagagcactacgaggccaccatccagagacacctggccttcatcgaccagctgatcgaggacaagaaggtgctgagcgagaagtgcgaggccgtggtggccgagctgaagcaggaggaccagagatgcaccgagagagtggcccaggcccaggcccagcacgagctggagatcaagaagctgaaggagctgatgagcgccaccgagaaggccagaagagagaagtggatcagcgagaagaccaagaagatcaaggaggtgaccgtgagaggcctggagcccgagatccagaagctgatcgccagacacaagcaggaggtgagaagactgaagagcctgcacgaggccgagctgctgcagagcgacgagagagccagccagagatgcctgagacaggccgaggagctgagagagcagctggagagagagaaggaggccctgggccagcaggagagagagagagccagacagagattccagcagcacctggagcaggagcagtgggccctgcagcagcagagacagagactgtacagcgaggtggccgaggagagagagagactgggccagcaggccgccagacagagagccgagctggaggagctgagacagcagctggaggagagcagcagcgccctgaccagagccctgagagccgagttcgagaagggcagagaggagcaggagagaagacaccagatggagctgaacaccctgaagcagcagctggagctggagagacaggcctgggaggccggcagaaccagaaaggaggaggcctggctgctgaacagagagcaggagctgagagaggagatcagaaagggcagagacaaggagatcgagctggtgatccacagactggaggccgacatggccctggccaaggaggagagcgagaaggccgccgagagcagaatcaagagactgagagacaagtacgaggccgagctgagcgagctggagcagagcgagagaaagctgcaggagagatgcagcgagctgaagggccagctgggcgaggccgagggcgagaacctgagactgcagggcctggtgagacagaaggagagagccctggaggacgcccaggccgtgaacgagcagctgagcagcgagagaagcaacctggcccaggtgatcagacaggagttcgaggacagactggccgccagcgaggaggagaccagacaggccaaggccgagctggccaccctgcaggccagacagcagctggagctggaggaggtgcacagaagagtgaagaccgccctggccagaaaggaggaggccgtgagcagcctgagaacccagcacgaggccgccgtgaagagagccgaccacctggaggagctgctggagcagcacagaagacccacccccagcaccaagtag

SEQ ID NO: 71141 - DNA, 699 bp, Artificial Sequence
  Description of Artificial Sequence: Synthetic coding sequence
atggacgccctggtggaggacgacatctgcatcctgaaccacgagaaggcccacaagagagacaccgtgacccccgtgagcatctacagcggcgacgagagcgtggccagccacttcgccctggtgaccgcctacgaggacatcaagaagagactgaaggacagcgagaaggagaacagcctgctgaagaagagaatcagattcctggaggagaagctgatcgccagattcgaggaggagaccagcagcgtgggcagagagcaggtgaacaaggcctaccacgcctacagagaggtgtgcatcgacagagacaacctgaagagcaagctggacaagatgaacaaggacaacagcgagagcctgaaggtgctgaacgagcagctgcagagcaaggaggtggagctgctgcagctgagaaccgaggtggagacccagcaggtgatgagaaacctgaacccccccagcagcaactgggaggtggagaagctgagctgcgacctgaagatccacggcctggagcaggagctggagctgatgagaaaggagtgcagcgacctgaagatcgagctgcagaaggccaagcagaccgacccctaccaggaggacaacctgaagagcagagacctgcagaagctgagcatcagcagagtgagcgtggcccagcccggcgtgcagtggagaaaccacggcatcgcctag

SEQ ID NO: 71142 - DNA, 648 bp, Artificial Sequence
  Description of Artificial Sequence: Synthetic coding sequence
atggacgccctggtggaggacgacatctgcatcctgaaccacgagaaggcccacaagagagacaccgtgacccccgtgagcatctacagcggcgacgagagcgtggccagccacttcgccctggtgaccgcctacgaggacatcaagaagagactgaaggacagcgagaaggagaacagcctgctgaagaagagaatcagattcctggaggagaagctgatcgccagattcgaggaggagaccagcagcgtgggcagagagcaggtgaacaaggcctaccacgcctacagagaggtgtgcatcgacagagacaacctgaagagcaagctggacaagatgaacaaggacaacagcgagagcctgaaggtgctgaacgagcagctgcagagcaaggaggtggagctgctgcagctgagaaccgaggtggagacccagcaggtgatgagaaacctgaacccccccagcagcaactgggaggtggagaagctgagctgcgacctgaagatccacggcctggagcaggagctggagctgatgagaaaggagtgcagcgacctgaagatcgagctgcagaaggccaagcagaccgacccctaccaggaggacaacctgaagagcagagacctgcagaagctgagcatcagctag

SEQ ID NO: 71143 - DNA, 288 bp, Artificial Sequence
  Description of Artificial Sequence: Synthetic coding sequence
atggacgccctggtggaggacgacatctgcatcctgaaccacgagaaggcccacaagagagacaccgtgacccccgtgagcatctacagcggcgacgagagcgtggccagccacttcgccctggtgaccgcctacgaggacatcaagaagagactgaaggacagcgagaaggagaacagcctgctgaagaagagaatcagattcctggaggagaagctgatcgccagattcgaggaggagaccagcagcgtgggcagagagcaggtgaacaaggcctaccacgcctag

SEQ ID NO: 71144 - DNA, 732 bp, Artificial Sequence
  Description of Artificial Sequence: Synthetic coding sequence
atggacgccctggtggaggacgacatctgcatcctgaaccacgagaaggcccacaagagagacaccgtgacccccgtgagcatctacagcggcgacgagagcgtggccagccacttcgccctggtgaccgcctacgaggacatcaagaagagactgaaggacagcgagaaggagaacagcctgctgaagaagagaatcagattcctggaggagaagctgatcgccagattcgaggaggagaccagcagcgtgggcagagagcaggtgaacaaggcctaccacgcctacagagaggtgtgcatcgacagagacaacctgaagagcaagctggacaagatgaacaaggacaacagcgagagcctgaaggtgctgaacgagcagctgcagagcaaggaggtggagctgctgcagctgagaaccgaggtggagacccagcaggtgatgagaaacctgaacccccccagcagcaactgggaggtggagaagctgagctgcgacctgaagatccacggcctggagcaggagctggagctgatgagaaaggagtgcagcgacctgaagatcgagctgcagaaggccaagcagaccgacccctaccaggaggacaacctgaagagcagagacctgcagaagctgagcatcagcagacagagcatctgcagcaccgcctggagcgccgtggcccagagctgggacagcatgaacttcgaggactgcagcctgttcgcctag

SEQ ID NO: 71145 - DNA, 732 bp, Artificial Sequence; identical to SEQ ID NO: 71144
  Description of Artificial Sequence: Synthetic coding sequence

SEQ ID NO: 71146 - DNA, 1179 bp, Artificial Sequence
  Description of Artificial Sequence: Synthetic coding sequence
atggacgccctggtggaggacgacatctgcatcctgaaccacgagaaggcccacaagagagacaccgtgacccccgtgagcatctacagcggcgacgagagcgtggccagccacttcgccctggtgaccgcctacgaggacatcaagaagagactgaaggacagcgagaaggagaacagcctgctgaagaagagaatcagattcctggaggagaagctgatcgccagattcgaggaggagaccagcagcgtgggcagagagcaggtgaacaaggcctaccacgcctacagagaggtgtgcatcgacagagacaacctgaagagcaagctggacaagatgaacaaggacaacagcgagagcctgaaggtgctgaacgagcagctgcagagcaaggaggtggagctgctgcagctgagaaccgaggtggagacccagcaggtgatgagaaacctgaacccccccagcagcaactgggaggtggagaagctgagctgcgacctgaagatccacggcctggagcaggagctggagctgatgagaaaggagtgcagcgacctgaagatcgagctgcagaaggccaagcagaccgacccctaccaggaggacaacctgaagagcagagacctgcagaagctgagcatcagcagcgacaacatgcagcacgcctactgggagctgaagagagagatgagcaacctgcacctggtgacccaggtgcaggccgagctgctgagaaagctgaagaccagcaccgccatcaagaaggcctgcgcccccgtgggctgcagcgaggacctgggcagagacagcaccaagctgcacctgatgaacttcaccgccacctacaccagacacccccccctgctgcccaacggcaaggccctgtgccacaccaccagcagccccctgcccggcgacgtgaaggtgctgagcgagaaggccatcctgcagagctggaccgacaacgagagaagcatccccaacgacggcacctgcttccaggagcacagcagctacggcagaaacagcctggaggacaacagctgggtgttccccagcccccccaagagcagcgagaccgccttcggcgagaccaagaccaagaccctgcccctgcccaacctgccccccctgcactacctggaccagcacaaccagaactgcctgtacaagaactag

SEQ ID NO: 71147 - DNA, 1269 bp, Artificial Sequence
  Description of Artificial Sequence: Synthetic coding sequence
atggacgtgctgagccccggccagggcaacaacaccaccagcccccccgcccccttcgagaccggcggcaacaccaccggcatcagcgacgtgaccgtgagctaccaggtgatcaccagcctgctgctgggcaccctgatcttctgcgccgtgctgggcaacgcctgcgtggtggccgccatcgccctggagagaagcctgcagaacgtggccaactacctgatcggcagcctggccgtgaccgacctgatggtgagcgtgctggtgctgcccatggccgccctgtaccaggtgctgaacaagtggaccctgggccaggtgacctgcgacctgttcatcgccctggacgtgctgtgctgcaccagcagcatcctgcacctgtgcgccatcgccctggacagatactgggccatcaccgaccccatcgactacgtgaacaagagaacccccagaagagccgccgccctgatcagcctgacctggctgatcggcttcctgatcagcatcccccccatgctgggctggagaacccccgaggacagaagcgaccccgacgcctgcaccatcagcaaggaccacggctacaccatctacagcaccttcggcgccttctacatccccctgctgctgatgctggtgctgtacggcagaatcttcagagccgccagattcagaatcagaaagaccgtgaagaaggtggagaagaccggcgccgacaccagacacggcgccagccccgccccccagcccaagaagagcgtgaacggcgagagcggcagcagaaactggagactgggcgtggagagcaaggccggcggcgccctgtgcgccaacggcgccgtgagacagggcgacgacggcgccgccctggaggtgatcgaggtgcacagagtgggcaacagcaaggagcacctgcccctgcccagcgaggccggccccaccccctgcgcccccgccagcttcgagagaaagaacgagagaaacgccgaggccaagagaaagatggccctggccagagagagaaagaccgtgaagaccctgggcatcatcatgggcaccttcatcctgtgctggctgcccttcttcatcgtggccctggtgctgcccttctgcgagagcagctgccacatgcccaccctgctgggcgccatcatcaactggctgggctacagcaacagcctgctgaaccccgtgatctacgcctacttcaacaaggacttccagaacgccttcaagaagatcatcaagtgcaagttctgcagacagtag

SEQ ID NO: 71148 - DNA, 129 bp, Artificial Sequence
  Description of Artificial Sequence: Synthetic coding sequence
atggacgtgctgagccccggccagggcaacaacaccaccagcccccccgcccccttcgagaccggcggcaacaccaccggcatcagcgacgtgaccgtgagctaccaggtgatcaccagcctgctgtag

SEQ ID NO: 71149 - DNA, 1173 bp, Artificial Sequence
  Description of Artificial Sequence: Synthetic coding sequence
atggaggagcccggcgcccagtgcgccccccccccccccgccggcagcgagacctgggtgccccaggccaacctgagcagcgcccccagccagaactgcagcgccaaggactacatctaccaggacagcatcagcctgccctggaaggtgctgctggtgatgctgctggccctgatcaccctggccaccaccctgagcaacgccttcgtgatcgccaccgtgtacagaaccagaaagctgcacacccccgccaactacctgatcgccagcctggccgtgaccgacctgctggtgagcatcctggtgatgcccatcagcaccatgtacaccgtgaccggcagatggaccctgggccaggtggtgtgcgacttctggctgagcagcgacatcacctgctgcaccgccagcatcctgcacctgtgcgtgatcgccctggacagatactgggccatcaccgacgccgtggagtacagcgccaagagaacccccaagagagccgccgtgatgatcgccctggtgtgggtgttcagcatcagcatcagcctgccccccttcttctggagacaggccaaggccgaggaggaggtgagcgagtgcgtggtgaacaccgaccacatcctgtacaccgtgtacagcaccgtgggcgccttctacttccccaccctgctgctgatcgccctgtacggcagaatctacgtggaggccagaagcagaatcctgaagcagacccccaacagaaccggcaagagactgaccagagcccagctgatcaccgacagccccggcagcaccagcagcgtgaccagcatcaacagcagagtgcccgacgtgcccagcgagagcggcagccccgtgtacgtgaaccaggtgaaggtgagagtgagcgacgccctgctggagaagaagaagctgatggccgccagagagagaaaggccaccaagaccctgggcatcatcctgggcgccttcatcgtgtgctggctgcccttcttcatcatcagcctggtgatgcccatctgcaaggacgcctgctggttccacctggccatcttcgacttcttcacctggctgggctacctgaacagcctgatcaaccccatcatctacaccatgagcaacgaggacttcaagcaggccttccacaagctgatcagattcaagtgcaccagctag

SEQ ID NO: 71150 - DNA, 1134 bp, Artificial Sequence
  Description of Artificial Sequence: Synthetic coding sequence
atgagccccctgaaccagagcgccgagggcctgccccaggaggccagcaacagaagcctgaacgccaccgagaccagcgaggcctgggaccccagaaccctgcaggccctgaagatcagcctggccgtggtgctgagcgtgatcaccctggccaccgtgctgagcaacgccttcgtgctgaccaccatcctgctgaccagaaagctgcacacccccgccaactacctgatcggcagcctggccaccaccgacctgctggtgagcatcctggtgatgcccatcagcatcgcctacaccatcacccacacctggaacttcggccagatcctgtgcgacatctggctgagcagcgacatcacctgctgcaccgccagcatcctgcacctgtgcgtgatcgccctggacagatactgggccatcaccgacgccctggagtacagcaagagaagaaccgccggccacgccgccaccatgatcgccatcgtgtgggccatcagcatctgcatcagcatcccccccctgttctggagacaggccaaggcccaggaggagatgagcgactgcctggtgaacaccagccagatcagctacaccatctacagcacctgcggcgccttctacatccccagcgtgctgctgatcatcctgtacggcagaatctacagagccgccagaaacagaatcctgaacccccccagcctgtacggcaagagattcaccaccgcccacctgatcaccggcagcgccggcagcagcctgtgcagcctgaacagcagcctgcacgagggccacagccacagcgccggcagccccctgttcttcaaccacgtgaagatcaagctggccgacagcgccctggagagaaagagaatcagcgccgccagagagagaaaggccaccaagatcctgggcatcatcctgggcgccttcatcatctgctggctgcccttcttcgtggtgagcctggtgctgcccatctgcagagacagctgctggatccaccccgccctgttcgacttcttcacctggctgggctacctgaacagcctgatcaaccccatcatctacaccgtgttcaacgaggagttcagacaggccttccagaagatcgtgcccttcagaaaggccagctag

SEQ ID NO: 71151 - DNA, 1134 bp, Artificial Sequence; identical to SEQ ID NO: 71150
  Description of Artificial Sequence: Synthetic coding sequence

SEQ ID NO: 71152 - DNA, 1098 bp, Artificial Sequence
  Description of Artificial Sequence: Synthetic coding sequence
atgaacatcaccaactgcaccaccgaggccagcatggccatcagacccaagaccatcaccgagaagatgctgatctgcatgaccctggtggtgatcaccaccctgaccaccctgctgaacctggccgtgatcatggccatcggcaccaccaagaagctgcaccagcccgccaactacctgatctgcagcctggccgtgaccgacctgctggtggccgtgctggtgatgcccctgagcatcatctacatcgtgatggacagatggaagctgggctacttcctgtgcgaggtgtggctgagcgtggacatgacctgctgcacctgcagcatcctgcacctgtgcgtgatcgccctggacagatactgggccatcaccaacgccatcgagtacgccagaaagagaaccgccaagagagccgccctgatgatcctgaccgtgtggaccatcagcatcttcatcagcatgccccccctgttctggagaagccacagaagactgagccccccccccagccagtgcaccatccagcacgaccacgtgatctacaccatctacagcaccctgggcgccttctacatccccctgaccctgatcctgatcctgtactacagaatctaccacgccgccaagagcctgtaccagaagagaggcagcagcagacacctgagcaacagaagcaccgacagccagaacagcttcgccagctgcaagctgacccagaccttctgcgtgagcgacttcagcaccagcgaccccaccaccgagttcgagaagttccacgccagcatcagaatcccccccttcgacaacgacctggaccaccccggcgagagacagcagatcagcagcaccagagagagaaaggccgccagaatcctgggcctgatcctgggcgccttcatcctgagctggctgcccttcttcatcaaggagctgatcgtgggcctgagcatctacaccgtgagcagcgaggtggccgacttcctgacctggctgggctacgtgaacagcctgatcaaccccctgctgtacaccagcttcaacgaggacttcaagctggccttcaagaagctgatcagatgcagagagcacacctag

SEQ ID NO: 71153 - DNA, 1098 bp, Artificial Sequence; identical to SEQ ID NO: 71152
  Description of Artificial Sequence: Synthetic coding sequence

SEQ ID NO: 71154 - DNA, 1101 bp, Artificial Sequence
  Description of Artificial Sequence: Synthetic coding sequence
atggacttcctgaacagcagcgaccagaacctgaccagcgaggagctgctgaacagaatgcccagcaagatcctggtgagcctgaccctgagcggcctggccctgatgaccaccaccatcaacagcctggtgatcgccgccatcatcgtgaccagaaagctgcaccaccccgccaactacctgatctgcagcctggccgtgaccgacttcctggtggccgtgctggtgatgcccttcagcatcgtgtacatcgtgagagagagctggatcatgggccaggtggtgtgcgacatctggctgagcgtggacatcacctgctgcacctgcagcatcctgcacctgagcgccatcgccctggacagatacagagccatcaccgacgccgtggagtacgccagaaagagaacccccaagcacgccggcatcatgatcaccatcgtgtggatcatcagcgtgttcatcagcatgccccccctgttctggagacaccagggcaccagcagagacgacgagtgcatcatcaagcacgaccacatcgtgagcaccatctacagcaccttcggcgccttctacatccccctggccctgatcctgatcctgtactacaagatctacagagccgccaagaccctgtaccacaagagacaggccagcagaatcgccaaggaggaggtgaacggccaggtgctgctggagagcggcgagaagagcaccaagagcgtgagcaccagctacgtgctggagaagagcctgagcgaccccagcaccgacttcgacaagatccacagcaccgtgagaagcctgagaagcgagttcaagcacgagaagagctggagaagacagaagatcagcggcaccagagagagaaaggccgccaccaccctgggcctgatcctgggcgccttcgtgatctgctggctgcccttcttcgtgaaggagctggtggtgaacgtgtgcgacaagtgcaagatcagcgaggagatgagcaacttcctggcctggctgggctacctgaacagcctgatcaaccccctgatctacaccatcttcaacgaggacttcaagaaggccttccagaagctggtgagatgcagatgctag

SEQ ID NO: 71155 - DNA, 1416 bp, Artificial Sequence
  Description of Artificial Sequence: Synthetic coding sequence
atggacatcctgtgcgaggagaacaccagcctgagcagcaccaccaacagcctgatgcagctgaacgacgacaccagactgtacagcaacgacttcaacagcggcgaggccaacaccagcgacgccttcaactggaccgtggacagcgagaacagaaccaacctgagctgcgagggctgcctgagccccagctgcctgagcctgctgcacctgcaggagaagaactggagcgccctgctgaccgccgtggtgatcatcctgaccatcgccggcaacatcctggtgatcatggccgtgagcctggagaagaagctgcagaacgccaccaactacttcctgatgagcctggccatcgccgacatgctgctgggcttcctggtgatgcccgtgagcatgctgaccatcctgtacggctacagatggcccctgcccagcaagctgtgcgccgtgtggatctacctggacgtgctgttcagcaccgccagcatcatgcacctgtgcgccatcagcctggacagatacgtggccatccagaaccccatccaccacagcagattcaacagcagaaccaaggccttcctgaagatcatcgccgtgtggaccatcagcgtgggcatcagcatgcccatccccgtgttcggcctgcaggacgacagcaaggtgttcaaggagggcagctgcctgctggccgacgacaacttcgtgctgatcggcagcttcgtgagcttcttcatccccctgaccatcatggtgatcacctacttcctgaccatcaagagcctgcagaaggaggccaccctgtgcgtgagcgacctgggcaccagagccaagctggccagcttcagcttcctgccccagagcagcctgagcagcgagaagctgttccagagaagcatccacagagagcccggcagctacaccggcagaagaaccatgcagagcatcagcaacgagcagaaggcctgcaaggtgctgggcatcgtgttcttcctgttcgtggtgatgtggtgccccttcttcatcaccaacatcatggccgtgatctgcaaggagagctgcaacgaggacgtgatcggcgccctgctgaacgtgttcgtgtggatcggctacctgagcagcgccgtgaaccccctggtgtacaccctgttcaacaagacctacagaagcgccttcagcagatacatccagtgccagtacaaggagaacaagaagcccctgcagctgatcctggtgaacaccatccccgccctggcctacaagagcagccagctgcagatgggccagaagaagaacagcaagcaggacgccaagaccaccgacaacgactgcagcatggtggccctgggcaagcagcacagcgaggaggccagcaaggacaacagcgacggcgtgaacgagaaggtgagctgcgtgtag

SEQ ID NO: 71156 - DNA, 1416 bp, Artificial Sequence; identical to SEQ ID NO: 71155
  Description of Artificial Sequence: Synthetic coding sequence

SEQ ID NO: 71157 - DNA, 1164 bp, Artificial Sequence
  Description of Artificial Sequence: Synthetic coding sequence
atgcagttcctgaagagcgccaagcagaagcccaactactaccacatcatgctggtggaggaccaggaggagggcaccctgcaccagttcaactactgcgagagatgcagcgagagccagaacaacaagtgcatcagctgcgtggaccccgaggacaagtggtacagatggcccctgcccagcaagctgtgcgccgtgtggatctacctggacgtgctgttcagcaccgccagcatcatgcacctgtgcgccatcagcctggacagatacgtggccatccagaaccccatccaccacagcagattcaacagcagaaccaaggccttcctgaagatcatcgccgtgtggaccatcagcgtgggcatcagcatgcccatccccgtgttcggcctgcaggacgacagcaaggtgttcaaggagggcagctgcctgctggccgacgacaacttcgtgctgatcggcagcttcgtgagcttcttcatccccctgaccatcatggtgatcacctacttcctgaccatcaagagcctgcagaaggaggccaccctgtgcgtgagcgacctgggcaccagagccaagctggccagcttcagcttcctgccccagagcagcctgagcagcgagaagctgttccagagaagcatccacagagagcccggcagctacaccggcagaagaaccatgcagagcatcagcaacgagcagaaggcctgcaaggtgctgggcatcgtgttcttcctgttcgtggtgatgtggtgccccttcttcatcaccaacatcatggccgtgatctgcaaggagagctgcaacgaggacgtgatcggcgccctgctgaacgtgttcgtgtggatcggctacctgagcagcgccgtgaaccccctggtgtacaccctgttcaacaagacctacagaagcgccttcagcagatacatccagtgccagtacaaggagaacaagaagcccctgcagctgatcctggtgaacaccatccccgccctggcctacaagagcagccagctgcagatgggccagaagaagaacagcaagcaggacgccaagaccaccgacaacgactgcagcatggtggccctgggcaagcagcacagcgaggaggccagcaaggacaacagcgacggcgtgaacgagaaggtgagctgcgtgtag

SEQ ID NO: 71158 - DNA, 1446 bp, Artificial Sequence
  Description of Artificial Sequence: Synthetic coding sequence
atggccctgagctacagagtgagcgagctgcagagcaccatccccgagcacatcctgcagagcaccttcgtgcacgtgatcagcagcaactggagcggcctgcagaccgagagcatccccgaggagatgaagcagatcgtggaggagcagggcaacaagctgcactgggccgccctgctgatcctgatggtgatcatccccaccatcggcggcaacaccctggtgatcctggccgtgagcctggagaagaagctgcagtacgccaccaactacttcctgatgagcctggccgtggccgacctgctggtgggcctgttcgtgatgcccatcgccctgctgaccatcatgttcgaggccatgtggcccctgcccctggtgctgtgccccgcctggctgttcctggacgtgctgttcagcaccgccagcatcatgcacctgtgcgccatcagcgtggacagatacatcgccatcaagaagcccatccaggccaaccagtacaacagcagagccaccgccttcatcaagatcaccgtggtgtggctgatcagcatcggcatcgccatccccgtgcccatcaagggcatcgagaccgacgtggacaaccccaacaacatcacctgcgtgctgaccaaggagagattcggcgacttcatgctgttcggcagcctggccgccttcttcacccccctggccatcatgatcgtgacctacttcctgaccatccacgccctgcagaagaaggcctacctggtgaagaacaagcccccccagagactgacctggctgaccgtgagcaccgtgttccagagagacgagaccccctgcagcagccccgagaaggtggccatgctggacggcagcagaaaggacaaggccctgcccaacagcggcgacgagaccctgatgagaagaaccagcaccatcggcaagaagagcgtgcagaccatcagcaacgagcagagagccagcaaggtgctgggcatcgtgttcttcctgttcctgctgatgtggtgccccttcttcatcaccaacatcaccctggtgctgtgcgacagctgcaaccagaccaccctgcagatgctgctggagatcttcgtgtggatcggctacgtgagcagcggcgtgaaccccctggtgtacaccctgttcaacaagaccttcagagacgccttcggcagatacatcacctgcaactacagagccaccaagagcgtgaagaccctgagaaagagaagcagcaagatctacttcagaaaccccatggccgagaacagcaagttcttcaagaagcacggcatcagaaacggcatcaaccccgccatgtaccagagccccatgagactgagaagcagcaccatccagagcagcagcatcatcctgctggacaccctgctgctgaccgagaacgagggcgacaagaccgaggagcaggtgagctacgtgtag

SEQ ID NO: 71159 - DNA, 195 bp, Artificial Sequence
  Description of Artificial Sequence: Synthetic coding sequence
atggtgatcatccccaccatcggcggcaacaccctggtgatcctggccgtgagcctggagaagaagctgcagtacgccaccaactacttcctgatgagcctggccgtggccgacctgctggtgggcctgttcgtgatgcccatcgccctgctgaccatcatgttcggcatcgccatccccgtgcccatcaagtag

SEQ ID NO: 71160 - DNA, 1377 bp, Artificial Sequence
  Description of Artificial Sequence: Synthetic coding sequence
atggtgaacctgagaaacgccgtgcacagcttcctggtgcacctgatcggcctgctggtgtggcagtgcgacatcagcgtgagccccgtggccgccatcgtgaccgacatcttcaacaccagcgacggcggcagattcaagttccccgacggcgtgcagaactggcccgccctgagcatcgtgatcatcatcatcatgaccatcggcggcaacatcctggtgatcatggccgtgagcatggagaagaagctgcacaacgccaccaactacttcctgatgagcctggccatcgccgacatgctggtgggcctgctggtgatgcccctgagcctgctggccatcctgtacgactacgtgtggcccctgcccagatacctgtgccccgtgtggatcagcctggacgtgctgttcagcaccgccagcatcatgcacctgtgcgccatcagcctggacagatacgtggccatcagaaaccccatcgagcacagcagattcaacagcagaaccaaggccatcatgaagatcgccatcgtgtgggccatcagcatcggcgtgagcgtgcccatccccgtgatcggcctgagagacgaggagaaggtgttcgtgaacaacaccacctgcgtgctgaacgaccccaacttcgtgctgatcggcagcttcgtggccttcttcatccccctgaccatcatggtgatcacctactgcctgaccatctacgtgctgagaagacaggccctgatgctgctgcacggccacaccgaggagccccccggcctgagcctggacttcctgaagtgctgcaagagaaacaccgccgaggaggagaacagcgccaaccccaaccaggaccagaacgccagaagaagaaagaagaaggagagaagacccagaggcaccatgcaggccatcaacaacgagagaaaggccagcaaggtgctgggcatcgtgttcttcgtgttcctgatcatgtggtgccccttcttcatcaccaacatcctgagcgtgctgtgcgagaagagctgcaaccagaagctgatggagaagctgctgaacgtgttcgtgtggatcggctacgtgtgcagcggcatcaaccccctggtgtacaccctgttcaacaagatctacagaagagccttcagcaactacctgagatgcaactacaaggtggagaagaagccccccgtgagacagatccccagagtggccgccaccgccctgagcggcagagagctgaacgtgaacatctacagacacaccaacgagcccgtgatcgagaaggccagcgacaacgagcccggcatcgagatgcaggtggagaacctggagctgcccgtgaaccccagcagcgtggtgagcgagagaatcagcagcgtgtag

SEQ ID NO: 71161 - DNA, 747 bp, Artificial Sequence
  Description of Artificial Sequence: Synthetic coding sequence
atggtgaacctgagaaacgccgtgcacagcttcctggtgcacctgatcggcctgctggtgtggcagtgcgacatcagcgtgagccccgtggccgccatcgtgaccgacatcttcaacaccagcgacggcggcagattcaagttccccgacggcgtgcagaactggcccgccctgagcatcgtgatcatcatcatcatgaccatcggcggcaacatcctggtgatcatggccgtgagcatggagaagaagctgcacaacgccaccaactacttcctgatgagcctggccatcgccgacatgctggtgggcctgctggtgatgcccctgagcctgctggccatcctgtacgactacgtgtggcccctgcccagatacctgtgccccgtgtggatcagcctggacgtgctgttcagcaccgccagcatcatgcacctgtgcgccatcagcctggacagatgcatcagcagctacccctgcgactggaccgagggcagaagaaagggcgtgagagagcagcacgacgtgagagcccagagacccaagttcagaagctactgggtgctgagaagcttcctgcacaccgccgacgactacggcgactacgtgctgcccgaccacctgagaagcgcccccaccagcttcgacgtgaccgccagaccccacagaggcaccgcctggaccaagagcggcttccccgaggtgctgcaggaggagtacggcagaggcagagagctgtgcaagccctag

SEQ ID NO: 71162 - DNA, 1377 bp, Artificial Sequence; identical to SEQ ID NO: 71160
  Description of Artificial Sequence: Synthetic coding sequence

SEQ ID NO: 71163 - DNA, 840 bp, Artificial Sequence
  Description of Artificial Sequence: Synthetic coding sequence
atggccagcatgagcatcgtgaaggccaccagcaacaccatcagccagtgcggctggagcgccagcgccaactggacccccagcatcagccccagcatggacagaggcgagagaagccccagcgccctgagccccacccaggtggccatcagaagaagatgcagacccagcccctacgtggtgaacttcctggtgcccagcggcatcctgatcgccatcgacgccctgagcttctacctgcccctggagagcggcaactgcgcccccttcaagatgaccgtgctgctgggctacagcgtgttcctgctgatgatgaacgacctgctgcccgccaccagcaccagcagccacgccagcctggtgagaccccaccccagcagagaccagaagagaggcgtgtacttcgccctgtgcctgagcctgatggtgggcagcctgctggagaccatcttcatcacccacctgctgcacgtggccaccacccagcccctgcccctgcccagatggctgcacagcctgctgctgcactgcaccggccagggcagatgctgccccaccgccccccagaagggcaacaagggccccggcctgacccccacccacctgcccggcgtgaaggagcccgaggtgagcgccggccagatgcccggccccggcgaggccgagctgaccggcggcagcgagtggaccagagcccagagagagcacgaggcccagaagcagcacagcgtggagctgtgggtgcagttcagccacgccatggacgccctgctgttcagactgtacctgctgttcatggccagcagcatcatcaccgtgatctgcctgtggaacacctag

SEQ ID NO: 71164 - DNA, 1365 bp, Artificial Sequence
  Description of Artificial Sequence: Synthetic coding sequence
atgcagaagcacagccccggcccccccgccctggccctgctgagccagagcctgctgaccaccggcaacggcgacaccctgatcatcaactgccccggcttcggccagcacagagtggaccccgccgccttccaggccgtgttcgacagaaaggccatcggccccgtgaccaactacagcgtggccacccacgtgaacatcagcttcaccctgagcgccatctggaactgctacagcagaatccacaccttcaactgccaccacgccagaccctggcacaaccagttcgtgcagtggaaccccgacgagtgcggcggcatcaagaagagcggcatggccaccgagaacctgtggctgagcgacgtgttcatcgaggagagcgtggaccagacccccgccggcctgatggccagcatgagcatcgtgaaggccaccagcaacaccatcagccagtgcggctggagcgccagcgccaactggacccccagcatcagccccagcatggacagagccagagcctggagaagaatgagcagaagcttccagatccaccacagaaccagcttcagaaccagaagagagtgggtgctgctgggcatccagaagagaaccatcaaggtgaccgtggccaccaaccagtacgagcaggccatcttccacgtggccatcagaagaagatgcagacccagcccctacgtggtgaacttcctggtgcccagcggcatcctgatcgccatcgacgccctgagcttctacctgcccctggagagcggcaactgcgcccccttcaagatgaccgtgctgctgggctacagcgtgttcctgctgatgatgaacgacctgctgcccgccaccagcaccagcagccacgccagcctggtggcccccctggccctgatgcagacccccctgcccgccggcgtgtacttcgccctgtgcctgagcctgatggtgggcagcctgctggagaccatcttcatcacccacctgctgcacgtggccaccacccagcccctgcccctgcccagatggctgcacagcctgctgctgcactgcaccggccagggcagatgctgccccaccgccccccagaagggcaacaagggccccggcctgacccccacccacctgcccggcgtgaaggagcccgaggtgagcgccggccagatgcccggccccggcgaggccgagctgaccggcggcagcgagtggaccagagcccagagagagcacgaggcccagaagcagcacagcgtggagctgtgggtgcagttcagccacgccatggacgccctgctgttcagactgtacctgctgttcatggccagcagcatcatcaccgtgatctgcctgtggaacacctag

SEQ ID NO: 71165 - DNA, 1215 bp, Artificial Sequence
  Description of Artificial Sequence: Synthetic coding sequence
atggagagaggctggttccacggcaagggcttcctgctgggcttcatcctgcacctgctgctgcaggacagccacctgcagctggtgaccagcttcctgtggctgaacatgtggaaccccgacgagtgcggcggcatcaagaagagcggcatggccaccgagaacctgtggctgagcgacgtgttcatcgaggagagcgtggaccagacccccgccggcctgatggccagcatgagcatcgtgaaggccaccagcaacaccatcagccagtgcggctggagcgccagcgccaactggacccccagcatcagccccagcatggacagaggcgagagaagccccagcgccctgagccccacccaggtgaccagagcctggagaagaatgagcagaagcttccagatccaccacagaaccagcttcagaaccagaagagagtgggtgctgctgggcatccagaagagaaccatcaaggtgaccgtggccaccaaccagtacgagcaggccatcttccacgtggccatcagaagaagatgcagacccagcccctacgtggtgaacttcctggtgcccagcggcatcctgatcgccatcgacgccctgagcttctacctgcccctggagagcggcaactgcgcccccttcaagatgaccgtgctgctgggctacagcgtgttcctgctgatgatgaacgacctgctgcccgccaccagcaccagcagccacgccagcctggtgagaccccaccccagcagagaccagaagagaggcgtgtacttcgccctgtgcctgagcctgatggtgggcagcctgctggagaccatcttcatcacccacctgctgcacgtggccaccacccagcccctgcccctgcccagatggctgcacagcctgctgctgcactgcaccggccagggcagatgctgccccaccgccccccagaagggcaacaagggccccggcctgacccccacccacctgcccggcgtgaaggagcccgaggtgagcgccggccagatgcccggccccggcgaggccgagctgaccggcggcagcgagtggaccagagcccagagagagcacgaggcccagaagcagcacagcgtggagctgtgggtgcagttcagccacgccatggacgccctgctgttcagactgtacctgctgttcatggccagcagcatcatcaccgtgatctgcctgtggaacacctag

SEQ ID NO: 71166 - DNA, 702 bp, Artificial Sequence
  Description of Artificial Sequence: Synthetic coding sequence
atggtggccatcagaagaagatgcagacccagcccctacgtggtgaacttcctggtgcccagcggcatcctgatcgccatcgacgccctgagcttctacctgcccctggagagcggcaactgcgcccccttcaagatgaccgtgctgctgggctacagcgtgttcctgctgatgatgaacgacctgctgcccgccaccagcaccagcagccacgccagcctggtgagaccccaccccagcagagaccagaagagaggcgtgtacttcgccctgtgcctgagcctgatggtgggcagcctgctggagaccatcttcatcacccacctgctgcacgtggccaccacccagcccctgcccctgcccagatggctgcacagcctgctgctgcactgcaccggccagggcagatgctgccccaccgccccccagaagggcaacaagggccccggcctgacccccacccacctgcccggcgtgaaggagcccgaggtgagcgccggccagatgcccggccccggcgaggccgagctgaccggcggcagcgagtggaccagagcccagagagagcacgaggcccagaagcagcacagcgtggagctgtgggtgcagttcagccacgccatggacgccctgctgttcagactgtacctgctgttcatggccagcagcatcatcaccgtgatctgcctgtggaacacctag

SEQ ID NO: 71167 - DNA, 1344 bp, Artificial Sequence
  Description of Artificial Sequence: Synthetic coding sequence
atggagggcggctggcccgccagacagagcgccctgctgtgcctgaccgtgagcctgctgctgcagggcagaggcgacgccttcaccatcaactgcagcggcttcgaccagcacggcgtggaccccgccgtgttccaggccgtgttcgacagaaaggccttcagacccttcaccaactacagcatccccaccagagtgaacatcagcttcaccctgagcgccatcctgggcgtggacgcccagctgcagctgctgaccagcttcctgtggatggacctggtgtgggacaaccccttcatcaactggaaccccaaggagtgcgtgggcatcaacaagctgaccgtgctggccgagaacctgtggctgcccgacatcttcatcgtggagagcatggacgtggaccagacccccagcggcctgaccgcctacatcagcagcgagggcagaatcaagtacgacaagcccatgagagtgaccagcatctgcaacctggacatcttctacttccccttcgaccagcagaactgcaccttcaccttcagcagcttcctgtacaccgtggacagcatgctgctgggcatggacaaggaggtgtgggagatcaccgacaccagcagaaaggtgatccagacccagggcgagtgggagctgctgggcatcaacaaggccacccccaagatgagcatgggcaacaacctgtacgaccagatcatgttctacgtggccatcagaagaagacccagcctgtacatcatcaacctgctggtgcccagcagcttcctggtggccatcgacgccctgagcttctacctgcccgccgagagcgagaacagagcccccttcaagatcaccctgctgctgggctacaacgtgttcctgctgatgatgaacgacctgctgcccgccagcggcacccccctgatcagcgtgtacttcgccctgtgcctgagcctgatggtggtgagcctgctggagaccgtgttcatcacctacctgctgcacgtggccaccacccagcccccccccatgcccagatggctgcacagcctgctgctgcactgcaccagccccggcagatgctgccccaccgccccccagaagggcaacaagggcctgggcctgaccctgacccacctgcccggccccaaggagcccggcgagctggccggcaagaagctgggccccagagagaccgagcccgacggcggcagcggctggaccaagacccagctgatggagctgtgggtgcagttcagccacgccatggacaccctgctgttcagactgtacctgctgttcatggccagcagcatcctgaccgtgatcgtgctgtggaacacctag

SEQ ID NO: 71168 - DNA, 1416 bp, Artificial Sequence
  Description of Artificial Sequence: Synthetic coding sequence
atgctggccttcatcctgagcagagccacccccagacccgccctgggccccctgagctacagagagcacagagtggccctgctgcacctgacccacagcatgagcaccaccggcagaggcgtgaccttcaccatcaactgcagcggcttcggccagcacggcgccgaccccaccgccctgaacagcgtgttcaacagaaagcccttcagacccgtgaccaacatcagcgtgcccacccaggtgaacatcagcttcgccatgagcgccatcctggacgtgaacgagcagctgcacctgctgagcagcttcctgtggctggagatggtgtgggacaaccccttcatcagctggaaccccgaggagtgcgagggcatcaccaagatgagcatggccgccaagaacctgtggctgcccgacatcttcatcatcgagctgatggacgtggacaagacccccaagggcctgaccgcctacgtgagcaacgagggcagaatcagatacaagaagcccatgaaggtggacagcatctgcaacctggacatcttctacttccccttcgaccagcagaactgcaccctgaccttcagcagcttcctgtacaccgtggacagcatgctgctggacatggagaaggaggtgtgggagatcaccgacgccagcagaaacatcctgcagacccacggcgagtgggagctgctgggcctgagcaaggccaccgccaagctgagcagaggcggcaacctgtacgaccagatcgtgttctacgtggccatcagaagaagacccagcctgtacgtgatcaacctgctggtgcccagcggcttcctggtggccatcgacgccctgagcttctacctgcccgtgaagagcggcaacagagtgcccttcaagatcaccctgctgctgggctacaacgtgttcctgctgatgatgagcgacctgctgcccaccagcggcacccccctgatcggcgtgtacttcgccctgtgcctgagcctgatggtgggcagcctgctggagaccatcttcatcacccacctgctgcacgtggccaccacccagcccccccccctgcccagatggctgcacagcctgctgctgcactgcaacagccccggcagatgctgccccaccgccccccagaaggagaacaagggccccggcctgacccccacccacctgcccggcgtgaaggagcccgaggtgagcgccggccagatgcccggccccgccgaggccgagctgaccggcggcagcgagtggaccagagcccagagagagcacgaggcccagaagcagcacagcgtggagctgtggctgcagttcagccacgccatggacgccatgctgttcagactgtacctgctgttcatggccagcagcatcatcaccgtgatctgcctgtggaacacctag

SEQ ID NO: 71169 - DNA, 1371 bp, Artificial Sequence
  Description of Artificial Sequence: Synthetic coding sequence
atggagggcagctggttccacagaaagagattcagcttctacctgctgctgggcttcctgctgcagggcagaggcgtgaccttcaccatcaactgcagcggcttcggccagcacggcgccgaccccaccgccctgaacagcgtgttcaacagaaagcccttcagacccgtgaccaacatcagcgtgcccacccaggtgaacatcagcttcgccatgagcgccatcctggacgtgaacgagcagctgcacctgctgagcagcttcctgtggctggagatggtgtgggacaaccccttcatcagctggaaccccgaggagtgcgagggcatcaccaagatgagcatggccgccaagaacctgtggctgcccgacatcttcatcatcgagctgatggacgtggacaagacccccaagggcctgaccgcctacgtgagcaacgagggcagaatcagatacaagaagcccatgaaggtggacagcatctgcaacctggacatcttctacttccccttcgaccagcagaactgcaccctgaccttcagcagcttcctgtacaccgtggacagcatgctgctggacatggagaaggaggtgtgggagatcaccgacgccagcagaaacatcctgcagacccacggcgagtgggagctgctgggcctgagcaaggccaccgccaagctgagcagaggcggcaacctgtacgaccagatcgtgttctacgtggccatcagaagaagacccagcctgtacgtgatcaacctgctggtgcccagcggcttcctggtggccatcgacgccctgagcttctacctgcccgtgaagagcggcaacagagtgcccttcaagatcaccctgctgctgggctacaacgtgttcctgctgatgatgagcgacctgctgcccaccagcggcacccccctgatcggcgtgtacttcgccctgtgcctgagcctgatggtgggcagcctgctggagaccatcttcatcacccacctgctgcacgtggccaccacccagcccccccccctgcccagatggctgcacagcctgctgctgcactgcaacagccccggcagatgctgccccaccgccccccagaaggagaacaagggccccggcctgacccccacccacctgcccggcgtgaaggagcccgaggtgagcgccggccagatgcccggccccgccgaggccgagctgaccggcggcagcgagtggaccagagcccagagagagcacgaggcccagaagcagcacagcgtggagctgtggctgcagttcagccacgccatggacgccatgctgttcagactgtacctgctgttcatggccagcagcatcatcaccgtgatctgcctgtggaacacctag

SEQ ID NO: 71170 - DNA, 1326 bp, Artificial Sequence
  Description of Artificial Sequence: Synthetic coding sequence
atggagggcagctggttccacagaaagagattcagcttctacctgctgctgggcttcctgctgcagggcagaggcgtgaccttcaccatcaactgcagcggcttcggccagcacggcgccgaccccaccgccctgaacagcgtgttcaacagaaagcccttcagacccgtgaccaacatcagcgtgcccacccaggtgaacatcagcttcgccatgagcgccatcctggacgtggtgtgggacaaccccttcatcagctggaaccccgaggagtgcgagggcatcaccaagatgagcatggccgccaagaacctgtggctgcccgacatcttcatcatcgagctgatggacgtggacaagacccccaagggcctgaccgcctacgtgagcaacgagggcagaatcagatacaagaagcccatgaaggtggacagcatctgcaacctggacatcttctacttccccttcgaccagcagaactgcaccctgaccttcagcagcttcctgtacaccgtggacagcatgctgctggacatggagaaggaggtgtgggagatcaccgacgccagcagaaacatcctgcagacccacggcgagtgggagctgctgggcctgagcaaggccaccgccaagctgagcagaggcggcaacctgtacgaccagatcgtgttctacgtggccatcagaagaagacccagcctgtacgtgatcaacctgctggtgcccagcggcttcctggtggccatcgacgccctgagcttctacctgcccgtgaagagcggcaacagagtgcccttcaagatcaccctgctgctgggctacaacgtgttcctgctgatgatgagcgacctgctgcccaccagcggcacccccctgatcggcgtgtacttcgccctgtgcctgagcctgatggtgggcagcctgctggagaccatcttcatcacccacctgctgcacgtggccaccacccagcccccccccctgcccagatggctgcacagcctgctgctgcactgcaacagccccggcagatgctgccccaccgccccccagaaggagaacaagggccccggcctgacccccacccacctgcccggcgtgaaggagcccgaggtgagcgccggccagatgcccggccccgccgaggccgagctgaccggcggcagcgagtggaccagagcccagagagagcacgaggcccagaagcagcacagcgtggagctgtggctgcagttcagccacgccatggacgccatgctgttcagactgtacctgctgttcatggccagcagcatcatcaccgtgatctgcctgtggaacacctag

SEQ ID NO: 71171 - DNA, 1371 bp, Artificial Sequence
  Description of Artificial Sequence: Synthetic coding sequence
atgctggccttcatcctgagcagagccacccccagacccgccctgggccccctgagctacagagagcacagagtggccctgctgcacctgacccacagcatgagcaccaccggcagaggcgtgaccttcaccatcaactgcagcggcttcggccagcacggcgccgaccccaccgccctgaacagcgtgttcaacagaaagcccttcagacccgtgaccaacatcagcgtgcccacccaggtgaacatcagcttcgccatgagcgccatcctggacgtggtgtgggacaaccccttcatcagctggaaccccgaggagtgcgagggcatcaccaagatgagcatggccgccaagaacctgtggctgcccgacatcttcatcatcgagctgatggacgtggacaagacccccaagggcctgaccgcctacgtgagcaacgagggcagaatcagatacaagaagcccatgaaggtggacagcatctgcaacctggacatcttctacttccccttcgaccagcagaactgcaccctgaccttcagcagcttcctgtacaccgtggacagcatgctgctggacatggagaaggaggtgtgggagatcaccgacgccagcagaaacatcctgcagacccacggcgagtgggagctgctgggcctgagcaaggccaccgccaagctgagcagaggcggcaacctgtacgaccagatcgtgttctacgtggccatcagaagaagacccagcctgtacgtgatcaacctgctggtgcccagcggcttcctggtggccatcgacgccctgagcttctacctgcccgtgaagagcggcaacagagtgcccttcaagatcaccctgctgctgggctacaacgtgttcctgctgatgatgagcgacctgctgcccaccagcggcacccccctgatcggcgtgtacttcgccctgtgcctgagcctgatggtgggcagcctgctggagaccatcttcatcacccacctgctgcacgtggccaccacccagcccccccccctgcccagatggctgcacagcctgctgctgcactgcaacagccccggcagatgctgccccaccgccccccagaaggagaacaagggccccggcctgacccccacccacctgcccggcgtgaaggagcccgaggtgagcgccggccagatgcccggccccgccgaggccgagctgaccggcggcagcgagtggaccagagcccagagagagcacgaggcccagaagcagcacagcgtggagctgtggctgcagttcagccacgccatggacgccatgctgttcagactgtacctgctgttcatggccagcagcatcatcaccgtgatctgcctgtggaacacctag

SEQ ID NO: 71172 - DNA, 1326 bp, Artificial Sequence
  Description of Artificial Sequence: Synthetic coding sequence
atgctgagcagcgtgatggcccccctgtgggcctgcatcctggtggccgccggcatcctggccaccgacacccaccacccccaggacagcgccctgtaccacctgagcaagcagctgctgcagaagtaccacaaggaggtgagacccgtgtacaactggaccaaggccaccaccgtgtacctggacctgttcgtgcacgccatcctggacgtggacgccgagaaccagatcctgaagaccagcgtgtggtaccaggaggtgtggaacgacgagttcctgagctggaacagcagcatgttcgacgagatcagagagatcagcctgcccctgagcgccatctgggcccccgacatcatcatcaacgagttcgtggacatcgagagataccccgacctgccctacgtgtacgtgaacagcagcggcaccatcgagaactacaagcccatccaggtggtgagcgcctgcagcctggagacctacgccttccccttcgacgtgcagaactgcagcctgaccttcaagagcatcctgcacaccgtggaggacgtggacctggccttcctgagaagccccgaggacatccagcacgacaagaaggccttcctgaacgacagcgagtgggagctgctgagcgtgagcagcacctacagcatcctgcagagcagcgccggcggcttcgcccagatccagttcaacgtggtgatgagaagacaccccctggtgtacgtggtgagcctgctgatccccagcatcttcctgatgctggtggacctgggcagcttctacctgccccccaactgcagagccagaatcgtgttcaagaccagcgtgctggtgggctacaccgtgttcagagtgaacatgagcaaccaggtgcccagaagcgtgggcagcacccccctgatcggccacttcttcaccatctgcatggccttcctggtgctgagcctggccaagagcatcgtgctggtgaagttcctgcacgacgagcagagaggcggccaggagcagcccttcctgtgcctgagaggcgacaccgacgccgacagacccagagtggagcccagagcccagagagccgtggtgaccgagagcagcctgtacggcgagcacctggcccagcccggcaccctgaaggaggtgtggagccagctgcagagcatcagcaactacctgcagacccaggaccagaccgaccagcaggaggccgagtggctggtgctgctgagcagattcgacagactgctgttccagagctacctgttcatgctgggcatctacaccatcaccctgtgcagcctgtgggccctgtggggcggcgtgtag

SEQ ID NO: 71173 - DNA, 1293 bp, Artificial Sequence
  Description of Artificial Sequence: Synthetic coding sequence
atgatcgtgtacttccccggcatcctggccaccgacacccaccacccccaggacagcgccctgtaccacctgagcaagcagctgctgcagaagtaccacaaggaggtgagacccgtgtacaactggaccaaggccaccaccgtgtacctggacctgttcgtgcacgccatcctggacgtggacgccgagaaccagatcctgaagaccagcgtgtggtaccaggaggtgtggaacgacgagttcctgagctggaacagcagcatgttcgacgagatcagagagatcagcctgcccctgagcgccatctgggcccccgacatcatcatcaacgagttcgtggacatcgagagataccccgacctgccctacgtgtacgtgaacagcagcggcaccatcgagaactacaagcccatccaggtggtgagcgcctgcagcctggagacctacgccttccccttcgacgtgcagaactgcagcctgaccttcaagagcatcctgcacaccgtggaggacgtggacctggccttcctgagaagccccgaggacatccagcacgacaagaaggccttcctgaacgacagcgagtgggagctgctgagcgtgagcagcacctacagcatcctgcagagcagcgccggcggcttcgcccagatccagttcaacgtggtgatgagaagacaccccctggtgtacgtggtgagcctgctgatccccagcatcttcctgatgctggtggacctgggcagcttctacctgccccccaactgcagagccagaatcgtgttcaagaccagcgtgctggtgggctacaccgtgttcagagtgaacatgagcaaccaggtgcccagaagcgtgggcagcacccccctgatcggccacttcttcaccatctgcatggccttcctggtgctgagcctggccaagagcatcgtgctggtgaagttcctgcacgacgagcagagaggcggccaggagcagcccttcctgtgcctgagaggcgacaccgacgccgacagacccagagtggagcccagagcccagagagccgtggtgaccgagagcagcctgtacggcgagcacctggcccagcccggcaccctgaaggaggtgtggagccagctgcagagcatcagcaactacctgcagacccaggaccagaccgaccagcaggaggccgagtggctggtgctgctgagcagattcgacagactgctgttccagagctacctgttcatgctgggcatctacaccatcaccctgtgcagcctgtgggccctgtggggcggcgtgtag

SEQ ID NO: 71174 - DNA, 528 bp, Artificial Sequence
  Description of Artificial Sequence: Synthetic coding sequence
tgagccgagaaccagatcctgaagaccagcgtgtggtaccaggaggtgtggaacgacgagttcctgagctggaacagcagcatgttcgacgagatcagagagatcagcctgcccctgagcgccatctgggcccccgacatcatcatcaacgagttcgtggacatcgagagataccccgacctgccctacgtgtacgtgaacagcagcggcaccatcgagaactacaagcccatccaggtggtgagcgcctgcagcctggagacctacgccttccccttcgacgtgcagaactgcagcctgaccttcaagagcatcctgcacaccgtggaggacgtggacctggccttcctgagaagccccgaggacatccagcacgacaagaaggccttcctgaacgacagcgagtgggagctgctgagcgtgagcagcacctacagcatcctgcagagcagcgccggcggcttcgcccagatccagttcaacggcaccagcagccccagcgcctggcccagctggttcagcgcctag

SEQ ID NO: 71175 - DNA, 1449 bp, Artificial Sequence
  Description of Artificial Sequence: Synthetic coding sequence
atgctggccttcatcctgagcagagccacccccagacccgccctgggccccctgagctacagagagcacagagtggccctgctgcacctgacccacagcatgagcaccaccggcagaggcgtgaccttcaccatcaactgcagcggcttcggccagcacggcgccgaccccaccgccctgaacagcgtgttcaacagaaagcccttcagacccgtgaccaacatcagcgtgcccacccaggtgaacatcagcttcgccatgagcgccatcctggacgtggtgtgggacaaccccttcatcagctggaaccccgaggagtgcgagggcatcaccaagatgagcatggccgccaagaacctgtggctgcccgacatcttcatcatcgagctgtgcgtgagcagagccggccagagagaggtgcccagccccggcagccacagagaccacagcctgcccctgggccccctgatggacgtggacaagacccccaagggcctgaccgcctacgtgagcaacgagggcagaatcagatacaagaagcccatgaaggtggacagcatctgcaacctggacatcttctacttccccttcgaccagcagaactgcaccctgaccttcagcagcttcctgtacaccgtggacagcatgctgctggacatggagaaggaggtgtgggagatcaccgacgccagcagaaacatcctgcagacccacggcgagtgggagctgctgggcctgagcaaggccaccgccaagctgagcagaggcggcaacctgtacgaccagatcgtgttctacgtggccatcagaagaagacccagcctgtacgtgatcaacctgctggtgcccagcggcttcctggtggccatcgacgccctgagcttctacctgcccgtgaagagcggcaacagagtgcccttcaagatcaccctgctgctgggctacaacgtgttcctgctgatgatgagcgacctgctgcccaccagcggcacccccctgatcggcgtgtacttcgccctgtgcctgagcctgatggtgggcagcctgctggagaccatcttcatcacccacctgctgcacgtggccaccacccagcccccccccctgcccagatggctgcacagcctgctgctgcactgcaacagccccggcagatgctgccccaccgccccccagaaggagaacaagggccccggcctgacccccacccacctgcccggcgtgaaggagcccgaggtgagcgccggccagatgcccggccccgccgaggccgagctgaccggcggcagcgagtggaccagagcccagagagagcacgaggcccagaagcagcacagcgtggagctgtggctgcagttcagccacgccatggacgccatgctgttcagactgtacctgctgttcatggccagcagcatcatcaccgtgatctgcctgtggaacacctag

SEQ ID NO: 71176 - DNA, 1137 bp, Artificial Sequence
  Description of Artificial Sequence: Synthetic coding sequence
atggacaagctggacgccaacgtgagcagcgaggagggcttcggcagcgtggagaaggtggtgctgctgaccttcctgagcaccgtgatcctgatggccatcctgggcaacctgctggtgatggtggccgtgtgctgggacagacagctgagaaagatcaagaccaactacttcatcgtgagcctggccttcgccgacctgctggtgagcgtgctggtgatgcccttcggcgccatcgagctggtgcaggacatctggatctacggcgaggtgttctgcctggtgagaaccagcctggacgtgctgctgaccaccgccagcatcttccacctgtgctgcatcagcctggacagatactacgccatctgctgccagcccctggtgtacagaaacaagatgacccccctgagaatcgccctgatgctgggcggctgctgggtgatccccaccttcatcagcttcctgcccatcatgcagggctggaacaacatcggcatcatcgacctgatcgagaagagaaagttcaaccagaacagcaacagcacctactgcgtgttcatggtgaacaagccctacgccatcacctgcagcgtggtggccttctacatccccttcctgctgatggtgctggcctactacagaatctacgtgaccgccaaggagcacgcccaccagatccagatgctgcagagagccggcgccagcagcgagagcagaccccagagcgccgaccagcacagcacccacagaatgagaaccgagaccaaggccgccaagaccctgtgcatcatcatgggctgcttctgcctgtgctgggcccccttcttcgtgaccaacatcgtggaccccttcatcgactacaccgtgcccggccaggtgtggaccgccttcctgtggctgggctacatcaacagcggcctgaaccccttcctgtacgccttcctgaacaagagcttcagaagagccttcctgatcatcctgtgctgcgacgacgagagatacagaagacccagcatcctgggccagaccgtgccctgcagcaccaccaccatcaacggcagcacccacgtgctgagcggctgcagccccgtgagcagcttcctgctgctgttctgcaacagacccgtgcccgtgtag

SEQ ID NO: 71177 - DNA, 1164 bp, Artificial Sequence
  Description of Artificial Sequence: Synthetic coding sequence
atggacaagctggacgccaacgtgagcagcgaggagggcttcggcagcgtggagaaggtggtgctgctgaccttcctgagcaccgtgatcctgatggccatcctgggcaacctgctggtgatggtggccgtgtgctgggacagacagctgagaaagatcaagaccaactacttcatcgtgagcctggccttcgccgacctgctggtgagcgtgctggtgatgcccttcggcgccatcgagctggtgcaggacatctggatctacggcgaggtgttctgcctggtgagaaccagcctggacgtgctgctgaccaccgccagcatcttccacctgtgctgcatcagcctggacagatactacgccatctgctgccagcccctggtgtacagaaacaagatgacccccctgagaatcgccctgatgctgggcggctgctgggtgatccccaccttcatcagcttcctgcccatcatgcagggctggaacaacatcggcatcatcgacctgatcgagaagagaaagttcaaccagaacagcaacagcacctactgcgtgttcatggtgaacaagccctacgccatcacctgcagcgtggtggccttctacatccccttcctgctgatggtgctggcctactacagaatctacgtgaccgccaaggagcacgcccaccagatccagatgctgcagagagccggcgccagcagcgagagcagaccccagagcgccgaccagcacagcacccacagaatgagaaccgagaccaaggccgccaagaccctgtgcatcatcatgggctgcttctgcctgtgctgggcccccttcttcgtgaccaacatcgtggaccccttcatcgactacaccgtgcccggccaggtgtggaccgccttcctgtggctgggctacatcaacagcggcctgaaccccttcctgtacgccttcctgaacaagagcttcagaagagccttcctgatcatcctgtgctgcgacgacgagagatacagaagacccagcatcctgggccagaccgtgccctgcagcaccaccaccatcaacggcagcacccacgtgctgagatacaccgtgctgcacagaggccaccaccaggagctggagaagctgcccatccacaacgaccccgagagcctggagagctgcttctag

SEQ ID NO: 71178 - DNA, 1287 bp, Artificial Sequence
  Description of Artificial Sequence: Synthetic coding sequence
atggacaagctggacgccaacgtgagcagcgaggagggcttcggcagcgtggagaaggtggtgctgctgaccttcctgagcaccgtgatcctgatggccatcctgggcaacctgctggtgatggtggccgtgtgctgggacagacagctgagaaagatcaagaccaactacttcatcgtgagcctggccttcgccgacctgctggtgagcgtgctggtgatgcccttcggcgccatcgagctggtgcaggacatctggatctacggcgaggtgttctgcctggtgagaaccagcctggacgtgctgctgaccaccgccagcatcttccacctgtgctgcatcagcctggacagatactacgccatctgctgccagcccctggtgtacagaaacaagatgacccccctgagaatcgccctgatgctgggcggctgctgggtgatccccaccttcatcagcttcctgcccatcatgcagggctggaacaacatcggcatcatcgacctgatcgagaagagaaagttcaaccagaacagcaacagcacctactgcgtgttcatggtgaacaagccctacgccatcacctgcagcgtggtggccttctacatccccttcctgctgatggtgctggcctactacagaatctacgtgaccgccaaggagcacgcccaccagatccagatgctgcagagagccggcgccagcagcgagagcagaccccagagcgccgaccagcacagcacccacagaatgagaaccgagaccaaggccgccaagaccctgtgcatcatcatgggctgcttctgcctgtgctgggcccccttcttcgtgaccaacatcgtggaccccttcatcgactacaccgtgcccggccaggtgtggaccgccttcctgtggctgggctacatcaacagcggcctgaaccccttcctgtacgccttcctgaacaagagcttcagaagagccttcctgatcatcctgtgctgcgacgacgagagatacagaagacccagcatcctgggccagaccgtgccctgcagcaccaccaccatcaacggcagcacccacgtgctgagaaccgacttcctgttcgacagagacatcctggccagatactggaccaagcccgccagagccggccccttcagcggcaccctgagcatcagatgcctgaccgccagaaagcccgtgctgggcgacgccgtggagtgcggcggccagtgggagagccagtgccacccccccgccaccagccccctggtggccgcccagcccagcgacacctag

SEQ ID NO: 71179 - DNA, 1209 bp, Artificial Sequence
  Description of Artificial Sequence: Synthetic coding sequence
atggacaagctggacgccaacgtgagcagcgaggagggcttcggcagcgtggagaaggtggtgctgctgaccttcctgagcaccgtgatcctgatggccatcctgggcaacctgctggtgatggtggccgtgtgctgggacagacagctgagaaagatcaagaccaactacttcatcgtgagcctggccttcgccgacctgctggtgagcgtgctggtgatgcccttcggcgccatcgagctggtgcaggacatctggatctacggcgaggtgttctgcctggtgagaaccagcctggacgtgctgctgaccaccgccagcatcttccacctgtgctgcatcagcctggacagatactacgccatctgctgccagcccctggtgtacagaaacaagatgacccccctgagaatcgccctgatgctgggcggctgctgggtgatccccaccttcatcagcttcctgcccatcatgcagggctggaacaacatcggcatcatcgacctggagagaagcctgaaccagggcctgggccaggacttccacgccatcgagaagagaaagttcaaccagaacagcaacagcacctactgcgtgttcatggtgaacaagccctacgccatcacctgcagcgtggtggccttctacatccccttcctgctgatggtgctggcctactacagaatctacgtgaccgccaaggagcacgcccaccagatccagatgctgcagagagccggcgccagcagcgagagcagaccccagagcgccgaccagcacagcacccacagaatgagaaccgagaccaaggccgccaagaccctgtgcatcatcatgggctgcttctgcctgtgctgggcccccttcttcgtgaccaacatcgtggaccccttcatcgactacaccgtgcccggccaggtgtggaccgccttcctgtggctgggctacatcaacagcggcctgaaccccttcctgtacgccttcctgaacaagagcttcagaagagccttcctgatcatcctgtgctgcgacgacgagagatacagaagacccagcatcctgggccagaccgtgccctgcagcaccaccaccatcaacggcagcacccacgtgctgagagacgccgtggagtgcggcggccagtgggagagccagtgccacccccccgccaccagccccctggtggccgcccagcccagcgacacctag

SEQ ID NO: 71180 - DNA, 1167 bp, Artificial Sequence
  Description of Artificial Sequence: Synthetic coding sequence
atggacaagctggacgccaacgtgagcagcgaggagggcttcggcagcgtggagaaggtggtgctgctgaccttcctgagcaccgtgatcctgatggccatcctgggcaacctgctggtgatggtggccgtgtgctgggacagacagctgagaaagatcaagaccaactacttcatcgtgagcctggccttcgccgacctgctggtgagcgtgctggtgatgcccttcggcgccatcgagctggtgcaggacatctggatctacggcgaggtgttctgcctggtgagaaccagcctggacgtgctgctgaccaccgccagcatcttccacctgtgctgcatcagcctggacagatactacgccatctgctgccagcccctggtgtacagaaacaagatgacccccctgagaatcgccctgatgctgggcggctgctgggtgatccccaccttcatcagcttcctgcccatcatgcagggctggaacaacatcggcatcatcgacctgatcgagaagagaaagttcaaccagaacagcaacagcacctactgcgtgttcatggtgaacaagccctacgccatcacctgcagcgtggtggccttctacatccccttcctgctgatggtgctggcctactacagaatctacgtgaccgccaaggagcacgcccaccagatccagatgctgcagagagccggcgccagcagcgagagcagaccccagagcgccgaccagcacagcacccacagaatgagaaccgagaccaaggccgccaagaccctgtgcatcatcatgggctgcttctgcctgtgctgggcccccttcttcgtgaccaacatcgtggaccccttcatcgactacaccgtgcccggccaggtgtggaccgccttcctgtggctgggctacatcaacagcggcctgaaccccttcctgtacgccttcctgaacaagagcttcagaagagccttcctgatcatcctgtgctgcgacgacgagagatacagaagacccagcatcctgggccagaccgtgccctgcagcaccaccaccatcaacggcagcacccacgtgctgagagacgccgtggagtgcggcggccagtgggagagccagtgccacccccccgccaccagccccctggtggccgcccagcccagcgacacctag

SEQ ID NO: 71181 - DNA, 1083 bp, Artificial Sequence
  Description of Artificial Sequence: Synthetic coding sequence
atggacaagctggacgccaacgtgagcagcgaggagggcttcggcagcgtggagaaggtggtgctgctgaccttcctgagcaccgtgatcctgatggccatcctgggcaacctgctggtgatggtggccgtgtgctgggacagacagctgagaaagatcaagaccaactacttcatcgtgagcctggccttcgccgacctgctggtgagcgtgctggtgatgcccttcggcgccatcgagctggtgcaggacatctggatctacggcgaggtgttctgcctggtgagaaccagcctggacgtgctgctgaccaccgccagcatcttccacctgtgctgcatcagcctggacagatactacgccatctgctgccagcccctggtgtacagaaacaagatgacccccctgagaatcgccctgatgctgggcggctgctgggtgatccccaccttcatcagcttcctgcccatcatgcagggctggaacaacatcggcatcatcgacctgatcgagaagagaaagttcaaccagaacagcaacagcacctactgcgtgttcatggtgaacaagccctacgccatcacctgcagcgtggtggccttctacatccccttcctgctgatggtgctggcctactacagaatctacgtgaccgccaaggagcacgcccaccagatccagatgctgcagagagccggcgccagcagcgagagcagaccccagagcgccgaccagcacagcacccacagaatgagaaccgagaccaaggccgccaagaccctgtgcatcatcatgggctgcttctgcctgtgctgggcccccttcttcgtgaccaacatcgtggaccccttcatcgactacaccgtgcccggccaggtgtggaccgccttcctgtggctgggctacatcaacagcggcctgaaccccttcctgtacgccttcctgaacaagagcttcagaagagccttcctgatcatcctgtgctgcgacgacgagagatacagaagacccagcatcctgggccagaccgtgccctgcagcaccaccaccatcaacggcagcacccacgtgctgagattctag

SEQ ID NO: 71182 - DNA, 1236 bp, Artificial Sequence
  Description of Artificial Sequence: Synthetic coding sequence
atggacaagctggacgccaacgtgagcagcgaggagggcttcggcagcgtggagaaggtggtgctgctgaccttcctgagcaccgtgatcctgatggccatcctgggcaacctgctggtgatggtggccgtgtgctgggacagacagctgagaaagatcaagaccaactacttcatcgtgagcctggccttcgccgacctgctggtgagcgtgctggtgatgcccttcggcgccatcgagctggtgcaggacatctggatctacggcgaggtgttctgcctggtgagaaccagcctggacgtgctgctgaccaccgccagcatcttccacctgtgctgcatcagcctggacagatactacgccatctgctgccagcccctggtgtacagaaacaagatgacccccctgagaatcgccctgatgctgggcggctgctgggtgatccccaccttcatcagcttcctgcccatcatgcagggctggaacaacatcggcatcatcgacctgatcgagaagagaaagttcaaccagaacagcaacagcacctactgcgtgttcatggtgaacaagccctacgccatcacctgcagcgtggtggccttctacatccccttcctgctgatggtgctggcctactacagaatctacgtgaccgccaaggagcacgcccaccagatccagatgctgcagagagccggcgccagcagcgagagcagaccccagagcgccgaccagcacagcacccacagaatgagaaccgagaccaaggccgccaagaccctgtgcatcatcatgggctgcttctgcctgtgctgggcccccttcttcgtgaccaacatcgtggaccccttcatcgactacaccgtgcccggccaggtgtggaccgccttcctgtggctgggctacatcaacagcggcctgaaccccttcctgtacgccttcctgaacaagagcttcagaagagccttcctgatcatcctgtgctgcgacgacgagagatacagaagacccagcatcctgggccagaccgtgccctgcagcaccaccaccatcaacggcagcacccacgtgctgagcagcggcaccgagaccgacagaaagaagctgtggaacaaggaggagaagatcgaccagaccatccagatgcccaagagaaagagaaagaagaaggccagcctgagctacgaggacctgatcctgctgggcagaaagagctgcttcagagagggcaagtag

SEQ ID NO: 71183 - DNA, 1164 bp, Artificial Sequence; identical to SEQ ID NO: 71177
  Description of Artificial Sequence: Synthetic coding sequence

SEQ ID NO: 71184 - DNA, 1137 bp, Artificial Sequence; identical to SEQ ID NO: 71176
  Description of Artificial Sequence: Synthetic coding sequence

SEQ ID NO: 71185 - DNA, 1137 bp, Artificial Sequence; identical to SEQ ID NO: 71176
  Description of Artificial Sequence: Synthetic coding sequence

SEQ ID NO: 71186 - DNA, 1074 bp, Artificial Sequence
  Description of Artificial Sequence: Synthetic coding sequence
atggacctgcccgtgaacctgaccagcttcagcctgagcacccccagccccctggagaccaaccacagcctgggcaaggacgacctgagacccagcagccccctgctgagcgtgttcggcgtgctgatcctgaccctgctgggcttcctggtggccgccaccttcgcctggaacctgctggtgctggccaccatcctgagagtgagaaccttccacagagtgccccacaacctggtggccagcatggccgtgagcgacgtgctggtggccgccctggtgatgcccctgagcctggtgcacgagctgagcggcagaagatggcagctgggcagaagactgtgccagctgtggatcgcctgcgacgtgctgtgctgcaccgccagcatctggaacgtgaccgccatcgccctggacagatactggagcatcaccagacacatggagtacaccctgagaaccagaaagtgcgtgagcaacgtgatgatcgccctgacctgggccctgagcgccgtgatcagcctggcccccctgctgttcggctggggcgagacctacagcgagggcagcgaggagtgccaggtgagcagagagcccagctacgccgtgttcagcaccgtgggcgccttctacctgcccctgtgcgtggtgctgttcgtgtactggaagatctacaaggccgccaagttcagagtgggcagcagaaagaccaacagcgtgagccccatcagcgaggccgtggaggtgaaggacagcgccaagcagccccagatggtgttcaccgtgagacacgccaccgtgaccttccagcccgagggcgacacctggagagagcagaaggagcagagagccgccctgatggtgggcatcctgatcggcgtgttcgtgctgtgctggatccccttcttcctgaccgagctgatcagccccctgtgcagctgcgacatccccgccatctggaagagcatcttcctgtggctgggctacagcaacagcttcttcaaccccctgatctacaccgccttcaacaagaactacaacagcgccttcaagaacttcttcagcagacagcactag

SEQ ID NO: 71187 - DNA, 1323 bp, Artificial Sequence
  Description of Artificial Sequence: Synthetic coding sequence
atggtgcccgagcccggccccaccgccaacagcacccccgcctggggcgccggcccccccagcgcccccggcggcagcggctgggtggccgccgccctgtgcgtggtgatcgccctgaccgccgccgccaacagcctgctgatcgccctgatctgcacccagcccgccctgagaaacaccagcaacttcttcctggtgagcctgttcaccagcgacctgatggtgggcctggtggtgatgccccccgccatgctgaacgccctgtacggcagatgggtgctggccagaggcctgtgcctgctgtggaccgccttcgacgtgatgtgctgcagcgccagcatcctgaacctgtgcctgatcagcctggacagatacctgctgatcctgagccccctgagatacaagctgagaatgacccccctgagagccctggccctggtgctgggcgcctggagcctggccgccctggccagcttcctgcccctgctgctgggctggcacgagctgggccacgccagaccccccgtgcccggccagtgcagactgctggccagcctgcccttcgtgctggtggccagcggcctgaccttcttcctgcccagcggcgccatctgcttcacctactgcagaatcctgctggccgccagaaagcaggccgtgcaggtggccagcctgaccaccggcatggccagccaggccagcgagaccctgcaggtgcccagaacccccagacccggcgtggagagcgccgacagcagaagactggccaccaagcacagcagaaaggccctgaaggccagcctgaccctgggcatcctgctgggcatgttcttcgtgacctggctgcccttcttcgtggccaacatcgtgcaggccgtgtgcgactgcatcagccccggcctgttcgacgtgctgacctggctgggctactgcaacagcaccatgaaccccatcatctaccccctgttcatgagagacttcaagagagccctgggcagattcctgccctgccccagatgccccagagagagacaggccagcctggccagccccagcctgagaaccagccacagcggccccagacccggcctgagcctgcagcaggtgctgcccctgcccctgccccccgacagcgacagcgacagcgacgccggcagcggcggcagcagcggcctgagactgaccgcccagctgctgctgcccggcgaggccacccaggacccccccctgcccaccagagccgccgccgccgtgaacttcttcaacatcgaccccgccgagcccgagctgagaccccaccccctgggcatccccaccaactag

SEQ ID NO: 71188 - DNA, 1338 bp, Artificial Sequence
  Description of Artificial Sequence: Synthetic coding sequence
atgatggacgtgaacagcagcggcagacccgacctgtacggccacctgagaagcttcctgctgcccgaggtgggcagaggcctgcccgacctgagccccgacggcggcgccgaccccgtggccggcagctgggccccccacctgctgagcgaggtgaccgccagccccgcccccacctgggacgccccccccgacaacgccagcggctgcggcgagcagatcaactacggcagagtggagaaggtggtgatcggcagcatcctgaccctgatcaccctgctgaccatcgccggcaactgcctggtggtgatcagcgtgtgcttcgtgaagaagctgagacagcccagcaactacctgatcgtgagcctggccctggccgacctgagcgtggccgtggccgtgatgcccttcgtgagcgtgaccgacctgatcggcggcaagtggatcttcggccacttcttctgcaacgtgttcatcgccatggacgtgatgtgctgcaccgccagcatcatgaccctgtgcgtgatcagcatcgacagatacctgggcatcaccagacccctgacctaccccgtgagacagaacggcaagtgcatggccaagatgatcctgagcgtgtggctgctgagcgccagcatcaccctgccccccctgttcggctgggcccagaacgtgaacgacgacaaggtgtgcctgatcagccaggacttcggctacaccatctacagcaccgccgtggccttctacatccccatgagcgtgatgctgttcatgtactaccagatctacaaggccgccagaaagagcgccgccaagcacaagttccccggcttccccagagtggagcccgacagcgtgatcgccctgaacggcatcgtgaagctgcagaaggaggtggaggagtgcgccaacctgagcagactgctgaagcacgagagaaagaacatcagcatcttcaagagagagcagaaggccgccaccaccctgggcatcatcgtgggcgccttcaccgtgtgctggctgcccttcttcctgctgagcaccgccagacccttcatctgcggcaccagctgcagctgcatccccctgtgggtggagagaaccttcctgtggctgggctacgccaacagcctgatcaaccccttcatctacgccttcttcaacagagacctgagaaccacctacagaagcctgctgcagtgccagtacagaaacatcaacagaaagctgagcgccgccggcatgcacgaggccctgaagctggccgagagacccgagagacccgagttcgtgctgcagaacgccgactactgcagaaagaagggccacgacagctag

SEQ ID NO: 71189 - DNA, 1440 bp, Artificial Sequence
  Description of Artificial Sequence: Synthetic coding sequence
atgatggacgtgaacagcagcggcagacccgacctgtacggccacctgagaagcttcctgctgcccgaggtgggcagaggcctgcccgacctgagccccgacggcggcgccgaccccgtggccggcagctgggccccccacctgctgagcgaggtgaccgccagccccgcccccacctgggacgccccccccgacaacgccagcggctgcggcgagcagatcaactacggcagagtggagaaggtggtgatcggcagcatcctgaccctgatcaccctgctgaccatcgccggcaactgcctggtggtgatcagcgtgtgcttcgtgaagaagctgagacagcccagcaactacctgatcgtgagcctggccctggccgacctgagcgtggccgtggccgtgatgcccttcgtgagcgtgaccgacctgatcggcggcaagtggatcttcggccacttcttctgcaacgtgttcatcgccatggacgtgatgtgctgcaccgccagcatcatgaccctgtgcgtgatcagcatcgacagatacctgggcatcaccagacccctgacctaccccgtgagacagaacggcaagtgcatggccaagatgatcctgagcgtgtggctgctgagcgccagcatcaccctgccccccctgttcggctgggcccagaacgtgaacgacgacaaggtgtgcctgatcagccaggacttcggctacaccatctacagcaccgccgtggccttctacatccccatgagcgtgatgctgttcatgtactaccagatctacaaggccgccagaaagagcgccgccaagcacaagttccccggcttccccagagtggagcccgacagcgtgatcgccctgaacggcatcgtgaagctgcagaaggaggtggaggagtgcgccaacctgagcagactgctgaagcacgagagaaagaacatcagcatcttcaagagagagcagaaggccgccaccaccctgggcatcatcgtgggcgccttcaccgtgtgctggctgcccttcttcctgctgagcaccgccagacccttcatctgcggcaccagctgcagctgcatccccctgtgggtggagagaaccttcctgtggctgggctacgccaacagcctgatcaaccccttcatctacgccttcttcaacagagacctgagaaccacctacagaagcctgctgcagtgccagtacagaaacatcaacagaaagctgagcgccgccggcatgcacgaggccctgaagctggccgagagacccgagagacccgagttcgtgctgagagcctgcaccagaagagtgctgctgagacccgagaagagaccccccgtgagcgtgtgggtgctgcagagccccgaccaccacaactggctggccgacaagatgctgaccaccgtggagaagaaggtgatgatccacgactag

SEQ ID NO: 71190 - DNA, 1299 bp, Artificial Sequence
  Description of Artificial Sequence: Synthetic coding sequence
atgatggacgtgaacagcagcggcagacccgacctgtacggccacctgagaagcttcctgctgcccgaggtgggcagaggcctgcccgacctgagccccgacggcggcgccgaccccgtggccggcagctgggccccccacctgctgagcgaggtgaccgccagccccgcccccacctgggacgccccccccgacaacgccagcggctgcggcgagcagatcaactacggcagagtggagaaggtggtgatcggcagcatcctgaccctgatcaccctgctgaccatcgccggcaactgcctggtggtgatcagcgtgtgcttcgtgaagaagctgagacagcccagcaactacctgatcgtgagcctggccctggccgacctgagcgtggccgtggccgtgatgcccttcgtgagcgtgaccgacctgatcggcggcaagtggatcttcggccacttcttctgcaacgtgttcatcgccatggacgtgatgtgctgcaccgccagcatcatgaccctgtgcgtgatcagcatcgacagatacctgggcatcaccagacccctgacctaccccgtgagacagaacggcaagtgcatggccaagatgatcctgagcgtgtggctgctgagcgccagcatcaccctgccccccctgttcggctgggcccagaacgtgaacgacgacaaggtgtgcctgatcagccaggacttcggctacaccatctacagcaccgccgtggccttctacatccccatgagcgtgatgctgttcatgtactaccagatctacaaggccgccagaaagagcgccgccaagcacaagttccccggcttccccagagtggagcccgacagcgtgatcgccctgaacggcatcgtgaagctgcagaaggaggtggaggagtgcgccaacctgagcagactgctgaagcacgagagaaagaacatcagcatcttcaagagagagcagaaggccgccaccaccctgggcatcatcgtgggcgccttcaccgtgtgctggctgcccttcttcctgctgagcaccgccagacccttcatctgcggcaccagctgcagctgcatccccctgtgggtggagagaaccttcctgtggctgggctacgccaacagcctgatcaaccccttcatctacgccttcttcaacagagacctgagaaccacctacagaagcctgctgcagtgccagtacagaaacatcaacagaaagctgagcgccgccggcatgcacgaggccctgaagctggccgagagacccgagagacccgagttcgtgctgtag

SEQ ID NO: 71191 - DNA, 1440 bp, Artificial Sequence
  Description of Artificial Sequence: Synthetic coding sequence
atgatggacgtgaacagcagcggcagacccgacctgtacggccacctgagaagcttcctgctgcccgaggtgggcagaggcctgcccgacctgagccccgacggcggcgccgaccccgtggccggcagctgggccccccacctgctgagcgaggtgaccgccagccccgcccccacctgggacgccccccccgacaacgccagcggctgcggcgagcagatcaactacggcagagtggagaaggtggtgatcggcagcatcctgaccctgatcaccctgctgaccatcgccggcaactgcctggtggtgatcagcgtgtgcttcgtgaagaagctgagacagcccagcaactacctgatcgtgagcctggccctggccgacctgagcgtggccgtggccgtgatgcccttcgtgagcgtgaccgacctgatcggcggcaagtggatcttcggccacttcttctgcaacgtgttcatcgccatggacgtgatgtgctgcaccgccagcatcatgaccctgtgcgtgatcagcatcgacagatacctgggcatcaccagacccctgacctaccccgtgagacagaacggcaagtgcatggccaagatgatcctgagcgtgtggctgctgagcgccagcatcaccctgccccccctgttcggctgggcccagaacgtgaacgacgacaaggtgtgcctgatcagccaggacttcggctacaccatctacagcaccgccgtggccttctacatccccatgagcgtgatgctgttcatgtactaccagatctacaaggccgccagaaagagcgccgccaagcacaagttccccggcttccccagagtggagcccgacagcgtgatcgccctgaacggcatcgtgaagctgcagaaggaggtggaggagtgcgccaacctgagcagactgctgaagcacgagagaaagaacatcagcatcttcaagagagagcagaaggccgccaccaccctgggcatcatcgtgggcgccttcaccgtgtgctggctgcccttcttcctgctgagcaccgccagacccttcatctgcggcaccagctgcagctgcatccccctgtgggtggagagaaccttcctgtggctgggctacgccaacagcctgatcaaccccttcatctacgccttcttcaacagagacctgagaaccacctacagaagcctgctgcagtgccagtacagaaacatcaacagaaagctgagcgccgccggcatgcacgaggccctgaagctggccgagagacccgagagacccgagttcgtgctgatcaccagaaccagcggcgtgcaccaggccctggagaacttcccctggggcaacgaggtgaacagatggagaaagagctgcgagtacttctgcaccgacaagatgctgaccaccgtggagaagaaggtgatgatccacgactag

SEQ ID NO: 71192 - DNA, 2460 bp, Artificial Sequence
  Description of Artificial Sequence: Synthetic coding sequence
ggcatgctggacggccccagcgccatgaccagattctgcaacctgatcgccagcgagcccgacatcgccaaggtgcccctgtgcatcgacagcagcaacttcgccgtgatcgaggccggcctgaagtgctgccagggcaagtgcatcgtgaacagcatcagcctgaaggagggcgaggccaccgagaccgacaccaagatcagagtgtgcaccagagcctaccacctgctggtgaagaagctgggcttcaaccccaacgacatcatcttcgaccccaacatcctgaccatcggcaccggcatggaggagcacaacctgtacgccatcaacttcatccacgccaccaaggtgatcaaggagaccctgcccggcgccagaatcagcggcggcctgagcaacctgagcttcagcttcagaggcatggaggccatcagagaggccatgcacggcgtgttcctgtaccacgccatcaagagcggcatggacatgggcatcgtgaacgccggcaacctgcccgtgtacgacgacatccacaaggagctgctgcagctgtgcgaggacctgatctggaacaaggaccccgaggccaccgagaagctgctgagatacgcccagacccagggcaccggcggcaagaaggtgatccagaccgacgagtggagaaacggccccgtggaggagagactggagtacgccctggtgaagggcatcgagaagcacatcatcgaggacaccgaggaggccagactgaaccagaagaagtaccccagacccctgaacatcatcgagggccccctgatgaacggcatgaagatcgtgggcgacctgttcggcgccggcaagatgttcctgccccaggtgatcaagagcgccagagtgatgaagaaggccgtgggccacctgatccccttcatggagaaggagagagaggagaccagagtgctgaacggcaccgtggaggaggaggacccctaccagggcaccatcgtgctggccaccgtgaagggcgacgtgcacgacatcggcaagaacatcgtgggcgtggtgctgggctgcaacaacttcagagtgatcgacctgggcgtgatgaccccctgcgacaagatcctgaaggccgccctggaccacaaggccgacatcatcggcctgagcggcctgatcacccccagcctggacgagatgatcttcgtggccaaggagatggagagactggccatcagaatccccctgctgatcggcggcgccaccaccagcaagacccacaccgccgtgaagatcgcccccagatacagcgcccccgtgatccacgtgctggacgccagcaagagcgtggtggtgtgcagccagctgctggacgagaacctgaaggacgagtacttcgaggagatcatggaggagtacgaggacatcagacaggaccactacgagagcctgaaggagagaagatacctgcccctgagccaggccagaaagagcggcttccagatggactggctgagcgagccccaccccgtgaagcccaccttcatcggcacccaggtgttcgaggactacgacctgcagaagctggtggactacatcgactggaagcccttcttcgacgtgtggcagctgagaggcaagtaccccaacagaggcttccccaagatcttcaacgacaagaccgtgggcggcgaggccagaaaggtgtacgacgacgcccacaacatgctgaacaccctgatcagccagaagaagctgagagccagaggcgtggtgggcttctggcccgcccagagcatccaggacgacatccacctgtacgccgaggccgccgtgccccaggccgccgagcccatcgccaccttctacggcctgagacagcaggccgagaaggacagcgccagcaccgagccctactactgcctgagcgacttcatcgcccccctgcacagcggcatcagagactacctgggcctgttcgccgtggcctgcttcggcgtggaggagctgagcaaggcctacgaggacgacggcgacgactacagcagcatcatggtgaaggccctgggcgacagactggccgaggccttcgccgaggagctgcacgagagagtgagaagagagctgtgggcctactgcggcagcgagcagctggacgtggccgacctgagaagactgagatacaagggcatcagacccgcccccggctaccccagccagcccgaccacaccgagaagctgaccatgtggagactggccgacatcgagcagagcaccggcatcagactgaccgagagcctggccatggcccccgccagcgccgtgagcggcctgtacttcagcaacctgaagagcaagtacttcgccgtgggcaagatcagcaaggaccaggtggaggactacgccctgagaaagaacatcagcgtggccgaggtggagaagtggctgggccccatcctgggctacgacaccgactag

SEQ ID NO: 71193 - DNA, 3798 bp, Artificial Sequence
  Description of Artificial Sequence: Synthetic coding sequence
atgagccccgccctgcaggacctgagccagcccgagggcctgaagaagaccctgagagacgagatcaacgccatcctgcagaagagaatcatggtgctggacggcggcatgggcaccatgatccagagagagaagctgaacgaggagcacttcagaggccaggagttcaaggaccacgccagacccctgaagggcaacaacgacatcctgagcatcacccagcccgacgtgatctaccagatccacaaggagtacctgctggccggcgccgacatcatcgagaccaacaccttcagcagcaccagcatcgcccaggccgactacggcctggagcacctggcctacagaatgaacatgtgcagcgccggcgtggccagaaaggccgccgaggaggtgaccctgcagaccggcatcaagagattcgtggccggcgccctgggccccaccaacaagaccctgagcgtgagccccagcgtggagagacccgactacagaaacatcaccttcgacgagctggtggaggcctaccaggagcaggccaagggcctgctggacggcggcgtggacatcctgctgatcgagaccatcttcgacaccgccaacgccaaggccgccctgttcgccctgcagaacctgttcgaggagaagtacgcccccagacccatcttcatcagcggcaccatcgtggacaagagcggcagaaccctgagcggccagaccggcgagggcttcgtgatcagcgtgagccacggcgagcccctgtgcatcggcctgaactgcgccctgggcgccgccgagatgagacccttcatcgagatcatcggcaagtgcaccaccgcctacgtgctgtgctaccccaacgccggcctgcccaacaccttcggcgactacgacgagacccccagcatgatggccaagcacctgaaggacttcgccatggacggcctggtgaacatcgtgggcggctgctgcggcagcacccccgaccacatcagagagatcgccgaggccgtgaagaactgcaagcccagagtgccccccgccaccgccttcgagggccacatgctgctgagcggcctggagcccttcagaatcggcccctacaccaacttcgtgaacatcggcgagagatgcaacgtggccggcagcagaaagttcgccaagctgatcatggccggcaactacgaggaggccctgtgcgtggccaaggtgcaggtggagatgggcgcccaggtgctggacgtgaacatggacgacggcatgctggacggccccagcgccatgaccagattctgcaacctgatcgccagcgagcccgacatcgccaaggtgcccctgtgcatcgacagcagcaacttcgccgtgatcgaggccggcctgaagtgctgccagggcaagtgcatcgtgaacagcatcagcctgaaggagggcgaggacgacttcctggagaaggccagaaagatcaagaagtacggcgccgccatggtggtgatggccttcgacgaggagggccaggccaccgagaccgacaccaagatcagagtgtgcaccagagcctaccacctgctggtgaagaagctgggcttcaaccccaacgacatcatcttcgaccccaacatcctgaccatcggcaccggcatggaggagcacaacctgtacgccatcaacttcatccacgccaccaaggtgatcaaggagaccctgcccggcgccagaatcagcggcggcctgagcaacctgagcttcagcttcagaggcatggaggccatcagagaggccatgcacggcgtgttcctgtaccacgccatcaagagcggcatggacatgggcatcgtgaacgccggcaacctgcccgtgtacgacgacatccacaaggagctgctgcagctgtgcgaggacctgatctggaacaaggaccccgaggccaccgagaagctgctgagatacgcccagacccagggcaccggcggcaagaaggtgatccagaccgacgagtggagaaacggccccgtggaggagagactggagtacgccctggtgaagggcatcgagaagcacatcatcgaggacaccgaggaggccagactgaaccagaagaagtaccccagacccctgaacatcatcgagggccccctgatgaacggcatgaagatcgtgggcgacctgttcggcgccggcaagatgttcctgccccaggtgatcaagagcgccagagtgatgaagaaggccgtgggccacctgatccccttcatggagaaggagagagaggagaccagagtgctgaacggcaccgtggaggaggaggacccctaccagggcaccatcgtgctggccaccgtgaagggcgacgtgcacgacatcggcaagaacatcgtgggcgtggtgctgggctgcaacaacttcagagtgatcgacctgggcgtgatgaccccctgcgacaagatcctgaaggccgccctggaccacaaggccgacatcatcggcctgagcggcctgatcacccccagcctggacgagatgatcttcgtggccaaggagatggagagactggccatcagaatccccctgctgatcggcggcgccaccaccagcaagacccacaccgccgtgaagatcgcccccagatacagcgcccccgtgatccacgtgctggacgccagcaagagcgtggtggtgtgcagccagctgctggacgagaacctgaaggacgagtacttcgaggagatcatggaggagtacgaggacatcagacaggaccactacgagagcctgaaggagagaagatacctgcccctgagccaggccagaaagagcggcttccagatggactggctgagcgagccccaccccgtgaagcccaccttcatcggcacccaggtgttcgaggactacgacctgcagaagctggtggactacatcgactggaagcccttcttcgacgtgtggcagctgagaggcaagtaccccaacagaggcttccccaagatcttcaacgacaagaccgtgggcggcgaggccagaaaggtgtacgacgacgcccacaacatgctgaacaccctgatcagccagaagaagctgagagccagaggcgtggtgggcttctggcccgcccagagcatccaggacgacatccacctgtacgccgaggccgccgtgccccaggccgccgagcccatcgccaccttctacggcctgagacagcaggccgagaaggacagcgccagcaccgagccctactactgcctgagcgacttcatcgcccccctgcacagcggcatcagagactacctgggcctgttcgccgtggcctgcttcggcgtggaggagctgagcaaggcctacgaggacgacggcgacgactacagcagcatcatggtgaaggccctgggcgacagactggccgaggccttcgccgaggagctgcacgagagagtgagaagagagctgtgggcctactgcggcagcgagcagctggacgtggccgacctgagaagactgagatacaagggcatcagacccgcccccggctaccccagccagcccgaccacaccgagaagctgaccatgtggagactggccgacatcgagcagagcaccggcatcagactgaccgagagcctggccatggcccccgccagcgccgtgagcggcctgtacttcagcaacctgaagagcaagtacttcgccgtgggcaagatcagcaaggaccaggtggaggactacgccctgagaaagaacatcagcgtggccgaggtggagaagtggctgggccccatcctgggctacgacaccgactag

SEQ ID NO: 71194 - DNA, 3357 bp, Artificial Sequence
  Description of Artificial Sequence: Synthetic coding sequence
atgagccccgccctgcaggacctgagccagcccgagggcctgaagaagaccctgagagacgagatcaacgccatcctgcagaagagaatcatggtgctggacggcggcatgggcaccatgatccagagagagaagctgaacgaggagcacttcagaggccaggagttcaaggaccacgccagacccctgaagggcaacaacgacatcctgagcatcacccagcccgacgtgatctaccagatccacaaggagtacctgctggccggcgccgacatcatcgagaccaacaccttcagcagcaccagcatcgcccaggccgactacggcctggagcacctggcctacagaatgaacatgtgcagcgccggcgtggccagaaaggccgccgaggaggtgaccctgcagaccggcatcaagagattcgtggccggcgccctgggccccaccaacaagaccctgagcgtgagccccagcgtggagagacccgactacagaaacatcaccttcgacgagctggtggaggcctaccaggagcaggccaagggcctgctggacggcggcgtggacatcctgctgatcgagaccatcttcgacaccgccaacgccaaggccgccctgttcgccctgcagaacctgttcgaggagaagtacgcccccagacccatcttcatcagcggcaccatcgtggacaagagcggcagaaccctgagcggccagaccggcgagggcttcgtgatcagcgtgagccacggcgagcccctgtgcatcggcctgaactgcgccctgggcgccgccgagatgagacccttcatcgagatcatcggcaagtgcaccaccgcctacgtgctgtgctaccccaacgccggcctgcccaacaccttcggcgactacgacgagacccccagcatgatggccaagcacctgaaggacttcgccatggacggcctggtgaacatcgtgggcggctgctgcggcagcacccccgaccacatcagagagatcgccgaggccgtgaagaactgcaagcccagagtgccccccgccaccgccttcgagggccacatgctgctgagcggcctggagcccttcagaatcggcccctacaccaacttcgtgaacatcggcgagagatgcaacgtggccggcagcagaaagttcgccaagctgatcatggccggcaactacgaggaggccctgtgcgtggccaaggtgcaggtggagatgggcgcccaggtgctggacgtgaacatggacgacggcatgctggacggccccagcgccatgaccagattctgcaacctgatcgccagcgagcccgacatcgccaaggtgcccctgtgcatcgacagcagcaacttcgccgtgatcgaggccggcctgaagtgctgccagggcaagtgcatcgtgaacagcatcagcctgaaggagggcgaggacgacttcctggagaaggccagaaagatcaagaagtacggcgccgccatggtggtgatggccttcgacgaggagggccagacccagggcaccggcggcaagaaggtgatccagaccgacgagtggagaaacggccccgtggaggagagactggagtacgccctggtgaagggcatcgagaagcacatcatcgaggacaccgaggaggccagactgaaccagaagaagtaccccagacccctgaacatcatcgagggccccctgatgaacggcatgaagatcgtgggcgacctgttcggcgccggcaagatgttcctgccccaggtgatcaagagcgccagagtgatgaagaaggccgtgggccacctgatccccttcatggagaaggagagagaggagaccagagtgctgaacggcaccgtggaggaggaggacccctaccagggcaccatcgtgctggccaccgtgaagggcgacgtgcacgacatcggcaagaacatcgtgggcgtggtgctgggctgcaacaacttcagagtgatcgacctgggcgtgatgaccccctgcgacaagatcctgaaggccgccctggaccacaaggccgacatcatcggcctgagcggcctgatcacccccagcctggacgagatgatcttcgtggccaaggagatggagagactggccatcagaatccccctgctgatcggcggcgccaccaccagcaagacccacaccgccgtgaagatcgcccccagatacagcgcccccgtgatccacgtgctggacgccagcaagagcgtggtggtgtgcagccagctgctggacgagaacctgaaggacgagtacttcgaggagatcatggaggagtacgaggacatcagacaggaccactacgagagcctgaaggagagaagatacctgcccctgagccaggccagaaagagcggcttccagatggactggctgagcgagccccaccccgtgaagcccaccttcatcggcacccaggtgttcgaggactacgacctgcagaagctggtggactacatcgactggaagcccttcttcgacgtgtggcagctgagaggcaagtaccccaacagaggcttccccaagatcttcaacgacaagaccgtgggcggcgaggccagaaaggtgtacgacgacgcccacaacatgctgaacaccctgatcagccagaagaagctgagagccagaggcgtggtgggcttctggcccgcccagagcatccaggacgacatccacctgtacgccgaggccgccgtgccccaggccgccgagcccatcgccaccttctacggcctgagacagcaggccgagaaggacagcgccagcaccgagccctactactgcctgagcgacttcatcgcccccctgcacagcggcatcagagactacctgggcctgttcgccgtggcctgcttcggcgtggaggagctgagcaaggcctacgaggacgacggcgacgactacagcagcatcatggtgaaggccctgggcgacagactggccgaggccttcgccgaggagctgcacgagagagtgagaagagagctgtgggcctactgcggcagcgagcagctggacgtggccgacctgagaagactgagatacaagggcatcagacccgcccccggctaccccagccagcccgaccacaccgagaagctgaccatgtggagactggccgacatcgagcagagcaccggcatcagactgaccgagagcctggccatggcccccgccagcgccgtgagcggcctgtacttcagcaacctgaagagcaagtacttcgccgtgggcaagatcagcaaggaccaggtggaggactacgccctgagaaagaacatcagcgtggccgaggtggagaagtgcatgagcgtgtacagaaagatcggcgagtag

SEQ ID NO: 71195 - DNA, 690 bp, Artificial Sequence
  Description of Artificial Sequence: Synthetic coding sequence
atgagcgccggcctgagagccggctgccacgtggtgctgctgtgcagattcagcctgggcagcttcagcgtgcccagcagagacagcgccagcggcagagcctgcctggccgccagacccacccccagaaccggcagagtgcccggcaagaaggccagagcccccgccgtggccgcccccagccccgagagaggccccagagccctgagagccttcggcgtgagaagcccccccgccaccagagccaacggcagaagacagaagaccagagccctgtgcggcagactggcctggagatggctggcctggcccctggccgtggtgacctgcggcgagcacgtgttcagcgccgcccccagcgcccagggcggcgacagcaccacctgccaccccagaagcaagacctgcagaaaccccgagtacctgctggccggcgccgacatcatcgagaccaacaccttcagcagcaccagcatcgcccaggccgactacggcctggagcacctggcctacagaatgaacatgtgcagcgccggcgtggccagaaaggccgccgaggaggtgaccctgcagaccggcatcaagagattcgtggccggcgccctgggccccaccaacaagaccctgagcgtgagccccagcgtggagagacccgactacagaaacatcaacctgcccgtgggcagctag

SEQ ID NO: 71196 - DNA, 3645 bp, Artificial Sequence
  Description of Artificial Sequence: Synthetic coding sequence
atgagccccgccctgcaggacctgagccagcccgagggcctgaagaagaccctgagagacgagatcaacgccatcctgcagaagagaatcatggtgctggacggcggcatgggcaccatgatccagagagagaagctgaacgaggagcacttcagaggccaggagttcaaggaccacgccagacccctgaagggcaacaacgacatcctgagcatcacccagcccgacgtgatctaccagatccacaaggagtacctgctggccggcgccgacatcatcgagaccaacaccttcagcagcaccagcatcgcccaggccgactacggcctggagcacctggcctacagaatgaacatgtgcagcgccggcgtggccagaaaggccgccgaggaggtgaccctgcagaccggcatcaagagattcgtggccggcgccctgggccccaccaacaagaccctgagcgtgagccccagcgtggagagacccgactacagaaacatcaccttcgacgagctggtggaggcctaccaggagcaggccaagggcctgctggacggcggcgtggacatcctgctgatcgagaccatcttcgacaccgccaacgccaaggccgccctgttcgccctgcagaacctgttcgaggagaagtacgcccccagacccatcttcatcagcggcaccatcgtggacaagagcggcagaaccctgagcggccagaccggcgagggcttcgtgatcagcgtgagccacggcgagcccctgtgcatcggcctgaactgcgccctgggcgccgccgagatgagacccttcatcgagatcatcggcaagtgcaccaccgcctacgtgctgtgctaccccaacgccggcctgcccaacaccttcggcgactacgacgagacccccagcatgatggccaagcacctgaaggacttcgccatggacggcctggtgaacatcgtgggcggctgctgcggcagcacccccgaccacatcagagagatcgccgaggccgtgaagaactgcaagcccagagtgccccccgccaccgccttcgagggccacatgctgctgagcggcctggagcccttcagaatcggcccctacaccaacttcgtgaacatcggcgagagatgcaacgtggccggcagcagaaagttcgccaagctgatcatggccggcaactacgaggaggccctgtgcgtggccaaggtgcaggtggagatgggcgcccaggtgctggacgtgaacatggacgacggcatgctggacggccccagcgccatgaccagattctgcaacctgatcgccagcgagcccgacatcgccaaggtgcccctgtgcatcgacagcagcaacttcgccgtgatcgaggccggcctgaagtgctgccagggcaagtgcatcgtgaacagcatcagcctgaaggagggcgaggacgacttcctggagaaggccagaaagatcaagaagtacggcgccgccatggtggtgatggccttcgacgaggagggccaggccaccgagaccgacaccaagatcagagtgtgcaccagagcctaccacctgctggtgaagaagctgggcttcaaccccaacgacatcatcttcgaccccaacatcctgaccatcggcaccggcatggaggagcacaacctgtacgccatcaacttcatccacgccaccaaggtgatcaaggagaccctgcccggcgccagaatcagcggcggcctgagcaacctgagcttcagcttcagaggcatggaggccatcagagaggccatgcacggcgtgttcctgtaccacgccatcaagagcggcatggacatgggcatcgtgaacgccggcaacctgcccgtgtacgacgacatccacaaggagctgctgcagctgtgcgaggacctgatctggaacaaggaccccgaggccaccgagaagctgctgagatacgcccagacccagggcaccggcggcaagaaggtgatccagaccgacgagtggagaaacggccccgtggaggagagactggagtacgccctggtgaaggtgatcaagagcgccagagtgatgaagaaggccgtgggccacctgatccccttcatggagaaggagagagaggagaccagagtgctgaacggcaccgtggaggaggaggacccctaccagggcaccatcgtgctggccaccgtgaagggcgacgtgcacgacatcggcaagaacatcgtgggcgtggtgctgggctgcaacaacttcagagtgatcgacctgggcgtgatgaccccctgcgacaagatcctgaaggccgccctggaccacaaggccgacatcatcggcctgagcggcctgatcacccccagcctggacgagatgatcttcgtggccaaggagatggagagactggccatcagaatccccctgctgatcggcggcgccaccaccagcaagacccacaccgccgtgaagatcgcccccagatacagcgcccccgtgatccacgtgctggacgccagcaagagcgtggtggtgtgcagccagctgctggacgagaacctgaaggacgagtacttcgaggagatcatggaggagtacgaggacatcagacaggaccactacgagagcctgaaggagagaagatacctgcccctgagccaggccagaaagagcggcttccagatggactggctgagcgagccccaccccgtgaagcccaccttcatcggcacccaggtgttcgaggactacgacctgcagaagctggtggactacatcgactggaagcccttcttcgacgtgtggcagctgagaggcaagtaccccaacagaggcttccccaagatcttcaacgacaagaccgtgggcggcgaggccagaaaggtgtacgacgacgcccacaacatgctgaacaccctgatcagccagaagaagctgagagccagaggcgtggtgggcttctggcccgcccagagcatccaggacgacatccacctgtacgccgaggccgccgtgccccaggccgccgagcccatcgccaccttctacggcctgagacagcaggccgagaaggacagcgccagcaccgagccctactactgcctgagcgacttcatcgcccccctgcacagcggcatcagagactacctgggcctgttcgccgtggcctgcttcggcgtggaggagctgagcaaggcctacgaggacgacggcgacgactacagcagcatcatggtgaaggccctgggcgacagactggccgaggccttcgccgaggagctgcacgagagagtgagaagagagctgtgggcctactgcggcagcgagcagctggacgtggccgacctgagaagactgagatacaagggcatcagacccgcccccggctaccccagccagcccgaccacaccgagaagctgaccatgtggagactggccgacatcgagcagagcaccggcatcagactgaccgagagcctggccatggcccccgccagcgccgtgagcggcctgtacttcagcaacctgaagagcaagtacttcgccgtgggcaagatcagcaaggaccaggtggaggactacgccctgagaaagaacatcagcgtggccgaggtggagaagtggctgggccccatcctgggctacgacaccgactag

SEQ ID NO: 71197 - DNA, 2178 bp, Artificial Sequence
  Description of Artificial Sequence: Synthetic coding sequence
atgggcgccgccagcgtgagagccggcgccagactggtggaggtggccctgtgcagcttcaccgtgacctgcctggaggtgatgagaagattcctgctgctgtacgccacccagcagggccaggccaaggccatcgccgaggagatctgcgagcaggccgtggtgcacggcttcagcgccgacctgcactgcatcagcgagagcgacaagtacgacctgaagaccgagaccgcccccctggtggtggtggtgagcaccaccggcaccggcgacccccccgacaccgccagaaagttcgtgaaggagatccagaaccagaccctgcccgtggacttcttcgcccacctgagatacggcctgctgggcctgggcgacagcgagtacacctacttctgcaacggcggcaagatcatcgacaagagactgcaggagctgggcgccagacacttctacgacaccggccacgccgacgactgcgtgggcctggagctggtggtggagccctggatcgccggcctgtggcccgccctgagaaagcacttcagaagcagcagaggccaggaggagatcagcggcgccctgcccgtggccagccccgccagcagcagaaccgacctggtgaagagcgagctgctgcacatcgagagccaggtggagctgctgagattcgacgacagcggcagaaaggacagcgaggtgctgaagcagaacgccgtgaacagcaaccagagcaacgtggtgatcgaggacttcgagagcagcctgaccagaagcgtgccccccctgagccaggccagcctgaacatccccggcctgccccccgagtacctgcaggtgcacctgcaggagagcctgggccaggaggagagccaggtgagcgtgaccagcgccgaccccgtgttccaggtgcccatcagcaaggccgtgcagctgaccaccaacgacgccatcaagaccaccctgctggtggagctggacatcagcaacaccgacttcagctaccagcccggcgacgccttcagcgtgatctgccccaacagcgacagcgaggtgcagagcctgctgcagagactgcagctggaggacaagagagagcactgcgtgctgctgaagatcaaggccgacaccaagaagaagggcgccaccctgccccagcacatccccgccggctgcagcctgcagttcatcttcacctggtgcctggagatcagagccatccccaagaaggccttcctgagagccctggtggactacaccagcgacagcgccgagaagagaagactgcaggagctgtgcagcaagcagggcgccgccgactacagcagattcgtgagagacgcctgcgcctgcctgctggacctgctgctggccttccccagctgccagccccccctgagcctgctgctggagcacctgcccaagctgcagcccagaccctacagctgcgccagcagcagcctgttccaccccggcaagctgcacttcgtgttcaacatcgtggagttcctgagcaccgccaccaccgaggtgctgagaaagggcgtgtgcaccggctggctggccctgctggtggccagcgtgctgcagcccaacatccacgccagccacgaggacagcggcaaggccctggcccccaagatcagcatcagccccagaaccaccaacagcttccacctgcccgacgaccccagcatccccatcatcatggtgggccccggcaccggcatcgcccccttcatcggcttcctgcagcacagagagaagctgcaggagcagcaccccgacggcaacttcggcgccatgtggctgttcttcggctgcagacacaaggacagagactacctgttcagaaaggagctgagacacttcctgaagcacggcatcctgacccacctgaaggtgagcttcagcagagacgcccccgtgggcgaggaggaggcccccgccaagtacgtgcaggacaacatccagctgcacggccagcaggtggccagaatcctgctgcaggagaacggccacatctacgtgtgcggcgacgccaagaacatggccaaggacgtgcacgacgccctggtgcagatcatcagcaaggaggtgggcgtggagaagctggaggccatgaagaccctggccaccctgaaggaggagaagagatacctgcaggacatctggagctag

SEQ ID NO: 71198 - DNA, 177 bp, Artificial Sequence
  Description of Artificial Sequence: Synthetic coding sequence
atgagaagattcctgctgctgtacgccacccagcagggccaggccaaggccatcgccgaggagatctgcgagcaggccgtggtgcacggcttcagcgccgacctgcactgcatcagcgagagcgacaaggtgagcgtgatccagaacacccccaccttcgccatgggcggcagatag

SEQ ID NO: 71199 - DNA, 2097 bp, Artificial Sequence
  Description of Artificial Sequence: Synthetic coding sequence
atgagaagattcctgctgctgtacgccacccagcagggccaggccaaggccatcgccgaggagatctgcgagcaggccgtggtgcacggcttcagcgccgacctgcactgcatcagcgagagcgacaagtacgacctgaagaccgagaccgcccccctggtggtggtggtgagcaccaccggcaccggcgacccccccgacaccgccagaaagttcgtgaaggagatccagaaccagaccctgcccgtggacttcttcgcccacctgagatacggcctgctgggcctgggcgacagcgagtacacctacttctgcaacggcggcaagatcatcgacaagagactgcaggagctgggcgccagacacttctacgacaccggccacgccgacgactgcgtgggcctggagctggtggtggagccctggatcgccggcctgtggcccgccctgagaaagcacttcagaagcagcagaggccaggaggagatcagcggcgccctgcccgtggccagccccgccagcagcagaaccgacctggtgaagagcgagctgctgcacatcgagagccaggtggagctgctgagattcgacgacagcggcagaaaggacagcgaggtgctgaagcagaacgccgtgaacagcaaccagagcaacgtggtgatcgaggacttcgagagcagcctgaccagaagcgtgccccccctgagccaggccagcctgaacatccccggcctgccccccgagtacctgcaggtgcacctgcaggagagcctgggccaggaggagagccaggtgagcgtgaccagcgccgaccccgtgttccaggtgcccatcagcaaggccgtgcagctgaccaccaacgacgccatcaagaccaccctgctggtggagctggacatcagcaacaccgacttcagctaccagcccggcgacgccttcagcgtgatctgccccaacagcgacagcgaggtgcagagcctgctgcagagactgcagctggaggacaagagagagcactgcgtgctgctgaagatcaaggccgacaccaagaagaagggcgccaccctgccccagcacatccccgccggctgcagcctgcagttcatcttcacctggtgcctggagatcagagccatccccaagaaggccttcctgagagccctggtggactacaccagcgacagcgccgagaagagaagactgcaggagctgtgcagcaagcagggcgccgccgactacagcagattcgtgagagacgcctgcgcctgcctgctggacctgctgctggccttccccagctgccagccccccctgagcctgctgctggagcacctgcccaagctgcagcccagaccctacagctgcgccagcagcagcctgttccaccccggcaagctgcacttcgtgttcaacatcgtggagttcctgagcaccgccaccaccgaggtgctgagaaagggcgtgtgcaccggctggctggccctgctggtggccagcgtgctgcagcccaacatccacgccagccacgaggacagcggcaaggccctggcccccaagatcagcatcagccccagaaccaccaacagcttccacctgcccgacgaccccagcatccccatcatcatggtgggccccggcaccggcatcgcccccttcatcggcttcctgcagcacagagagaagctgcaggagcagcaccccgacggcaacttcggcgccatgtggctgttcttcggctgcagacacaaggacagagactacctgttcagaaaggagctgagacacttcctgaagcacggcatcctgacccacctgaaggtgagcttcagcagagacgcccccgtgggcgaggaggaggcccccgccaagtacgtgcaggacaacatccagctgcacggccagcaggtggccagaatcctgctgcaggagaacggccacatctacgtgtgcggcgacgccaagaacatggccaaggacgtgcacgacgccctggtgcagatcatcagcaaggaggtgggcgtggagaagctggaggccatgaagaccctggccaccctgaaggaggagaagagatacctgcaggacatctggagctag

SEQ ID NO: 71200 - DNA, 471 bp, Artificial Sequence
  Description of Artificial Sequence: Synthetic coding sequence
atgagaagattcctgctgctgtacgccacccagcagggccaggccaaggccatcgccgaggagatctgcgagcaggccgtggtgcacggcttcagcgccgacctgcactgcatcagcgagagcgacaagtacgacctgaagaccgagaccgcccccctggtggtggtggtgagcaccaccggcaccggcgacccccccgacaccgccagaaagttcgtgaaggagatccagaaccagaccctgcccgtggacttcttcgcccacctgagatacggcctgctgggcctgggcgacagcgagtacacctacttctgcaacggcggcaagatcatcgacaagagactgcaggagctgggcgccagacacttctacgacaccggccacgccgacgactgcgtgggcctggagctggtggtggagccctggatcgccggcctgtggcccgccctgagaaagcacttcagaagctag

SEQ ID NO: 71201 - DNA, 126 bp, Artificial Sequence
  Description of Artificial Sequence: Synthetic coding sequence
atgagaagattcctgctgctgtacgccacccagcagggccaggccaaggccatcgccgaggagatctgcgagcaggccgtggtgcacggcttcagcgccgacctgcactgcatcagcgagagctag

SEQ ID NO: 71202 - DNA, 339 bp, Artificial Sequence
  Description of Artificial Sequence: Synthetic coding sequence
atgagaagattcctgctgctgtacgccacccagcagggccaggccaaggccatcgccgaggagatctgcgagcaggccgtggtgcacggcttcagcgccgacctgcactgcatcagcgagagcgacaagtacgacctgaagaccgagaccgcccccctggtggtggtggtgagcaccaccggcaccggcgacccccccgacaccgccagaaagttcgtgaaggagatccagaaccagaccctgcccgtggacttcttcgcccacctgagatacggcctgctgggcctgggcgacagcgagtacacctacttctgcaacggcggcaagatcatcgactag

SEQ ID NO: 71203 - DNA, 249 bp, Artificial Sequence
  Description of Artificial Sequence: Synthetic coding sequence
atgctgtgggaccccgccctgcccagactggccgtgtacgccagctgcctgttcttcagctgcctggacgcccacgagggccccgtgcacggccccagaggcagaggcgagggcggcagaggcagcgagagacagagagtgagacccggcggcggcggcggcgccggcagcgtgcacatccacctggaggaggaggacggcgccgaggaccaggaccacagagacgaggactggatcaccaagaagtag

SEQ ID NO: 71204 - DNA, 1647 bp, Artificial Sequence
  Description of Artificial Sequence: Synthetic coding sequence
atgaccatggccgccgccgccgtggtggccagaggcgccggcgccagagccgccaccgccgccgccctgagaggcggctgcggcaccgccgccagaggcagaccctgcgccggccccgccagacccctgtgcaccgcccccggcaccgcccccgacatgaagagatacctgtgggagagatacagagaggccaagagaagcaccgaggagctggtgcccagcatcatgagcaacctgctgaaccccgacgccatcttcagcaacaacgagatgagcctgagcgacatcgagatctacggcttcgactacgactacaccctggtgttctacagcaagcacctgcacaccctgatcttcaacgccgccagagacctgctgatcaacgagcacagataccccgccgagatcagaaagtacgagtacgaccccaacttcgccatcagaggcctgcactacgacgtgcagagagccgtgctgatgaagatcgacgccttccactacatccagctgggcaccgtgtacagaggcctgagcgtggtgcccgacgaggaggtgatcgagatgtacgagggcagccacgtgcccctggagcagatgagcgacttctacggcaagagcagccacggcaacaccatgaagcagttcatggacatcttcagcctgcccgagatgaccctgctgagctgcgtgaacgagtacttcctgaagaacaacatcgactacgagcccgtgcacctgtacaaggacgtgaaggacagcatcagagacgtgcacatcaagggcatcatgtacagagccatcgaggccgacatcgagaagtacatctgctacgccgagcagaccagagccgtgctggccaagctggccgaccacggcaagaagatgttcctgatcaccaacagccccagcagcttcgtggacaagggcatgagctacatcgtgggcaaggactggagagacctgttcgacgtggtgatcgtgcaggccgagaagcccaacttcttcaacgacaagagaagacccttcagaaagatgaacgagaagggcgtgctgctgtgggacaagatccacaagctgcagaagggccagatctacaagcagggcaacctgtacgagttcctgaagctgaccggctggagaggcagcagagtgctgtacttcggcgaccacatctacagcgacctggccgacctgaccctgaagcacggctggagaaccggcgccatcatccccgagctgagaagcgagctgaagatcatgaacaccgagcagtacatccagaccatgacctggctgcagaccctgaccggcctgctggagcagatgcaggtgcacagagacgccgagagccagctggtgctgcaggagtggaagaaggagagaaaggagatgagagagatgaccaagagcttcttcaacgcccagttcggcagcctgttcagaaccgaccagaaccccacctacttcctgagaagactgagcagattcgccgacatctacatggccagcctgagctgcctgctgaactacgacgtgagccacaccttctaccccagaagaacccccctgcagcacgagctgcccgcctggagcgagagaccccccaccttcggcacccccctgctgcaggaggcccaggccaagtag

SEQ ID NO: 71205 - DNA, 1686 bp, Artificial Sequence
  Description of Artificial Sequence: Synthetic coding sequence
atgagcaccagctggagcgacagactgcagaacgccgccgacatgcccgccaacatggacaagcacgccctgaagaagtacagaagagaggcctaccacagagtgttcgtgaacagaagcctggccatggagaagatcaagtgcttcggcttcgacatggactacaccctggccgtgtacaagagccccgagtacgagagcctgggcttcgagctgaccgtggagagactggtgagcatcggctacccccaggagctgctgagcttcgcctacgacagcaccttccccaccagaggcctggtgttcgacaccctgtacggcaacctgctgaaggtggacgcctacggcaacctgctggtgtgcgcccacggcttcaacttcatcagaggccccgagaccagagagcagtaccccaacaagttcatccagagagacgacaccgagagattctacatcctgaacaccctgttcaacctgcccgagacctacctgctggcctgcctggtggacttcttcaccaactgccccagatacaccagctgcgagaccggcttcaaggacggcgacctgttcatgagctacagaagcatgttccaggacgtgagagacgccgtggactgggtgcactacaagggcagcctgaaggagaagaccgtggagaacctggagaagtacgtggtgaaggacggcaagctgcccctgctgctgagcagaatgaaggaggtgggcaaggtgttcctggccaccaacagcgactacaagtacaccgacaagatcatgacctacctgttcgacttcccccacggccccaagcccggcagcagccacagaccctggcagagctacttcgacctgatcctggtggacgccagaaagcccctgttcttcggcgagggcaccgtgctgagacaggtggacaccaagaccggcaagctgaagatcggcacctacaccggccccctgcagcacggcatcgtgtacagcggcggcagcagcgacaccatctgcgacctgctgggcgccaagggcaaggacatcctgtacatcggcgaccacatcttcggcgacatcctgaagagcaagaagagacagggctggagaaccttcctggtgatccccgagctggcccaggagctgcacgtgtggaccgacaagagcagcctgttcgaggagctgcagagcctggacatcttcctggccgagctgtacaagcacctggacagcagcagcaacgagagacccgacatcagcagcatccagagaagaatcaagaaggtgacccacgacatggacatgtgctacggcatgatgggcagcctgttcagaagcggcagcagacagaccctgttcgccagccaggtgatgagatacgccgacctgtacgccgccagcttcatcaacctgctgtactaccccttcagctacctgttcagagccgcccacgtgctgatgccccacgagagcaccgtggagcacacccacgtggacatcaacgagatggagagccccctggccaccagaaacagaaccagcgtggacttcaaggacaccgactacaagagacaccagctgaccagaagcatcagcgagatcaagccccccaacctgttccccctggccccccaggagatcacccactgccacgacgaggacgacgacgaggaggaggaggaggaggaggagtag

SEQ ID NO: 71206 - DNA, 600 bp, Artificial Sequence
  Description of Artificial Sequence: Synthetic coding sequence
atggactacaccctggccgtgtacaagagccccgagtacgagagcctgggcttcgagctgaccgtggagagactggtgagcatcggctacccccaggagctgctgagcttcgcctacgacagcaccttccccaccagaggcctggtgttcgacaccctgtacggcaacctgctgaaggtggacgcctacggcaacctgctggtgtgcgcccacggcttcaacttcatcagaggcagccaggtggccgtgcagaagagacccgagaccagagagcagtaccccaacaagttcatccagagagacgacaccgagagattctacatcctgaacaccctgttcaacctgcccgagacctacctgctggcctgcctggtggacttcttcaccaactgccccagatacaccagctgcgagaccggcttcaaggacggcgacctgttcatgagctacagaagcatgttccaggacgtgagagacgccgtggactgggtgcactacaagggcagcctgaaggagaagaccgtggagaacctggagaagtacgtggtgaaggacagcaagagcagcagaatccagtacttcctgaaggtgctgtggtag

SEQ ID NO: 71207 - DNA, 1686 bp, Artificial Sequence; identical to SEQ ID NO: 71205
  Description of Artificial Sequence: Synthetic coding sequence

SEQ ID NO: 71208 - DNA, 444 bp, Artificial Sequence
  Description of Artificial Sequence: Synthetic coding sequence
gtgctgagacaggtggacaccaagaccggcaagctgaagatcggcacctacaccggccccctgcagcacggcatcgtgtacagcggcggcagcagcgacaccatctgcgacctgctgggcgccaagggcaaggacatcctgtacatcggcgaccacatcttcggcgacatcctgaagagcaagaagagacagggctggagaaccttcctggtgatccccgagctggcccaggagctgcacgtgtggaccgacaagagcagcctgttcgaggagctgcagagcctggacatcttcctggccgagctgtacaagcacctggacagcagcagcaacgagagacccgacatcagcagcatccagagaagaatcaagatgccccacgagagcaccgtggagcacacccacgtggacatcaacgagatggagagccccctggccacctag

SEQ ID NO: 71209 - DNA, 1599 bp, Artificial Sequence
  Description of Artificial Sequence: Synthetic coding sequence
atgagcaaggagggcgtgttcgtgaacagaagcctggccatggagaagatcaagtgcttcggcttcgacatggactacaccctggccgtgtacaagagccccgagtacgagagcctgggcttcgagctgaccgtggagagactggtgagcatcggctacccccaggagctgctgagcttcgcctacgacagcaccttccccaccagaggcctggtgttcgacaccctgtacggcaacctgctgaaggtggacgcctacggcaacctgctggtgtgcgcccacggcttcaacttcatcagaggccccgagaccagagagcagtaccccaacaagttcatccagagagacgacaccgagagattctacatcctgaacaccctgttcaacctgcccgagacctacctgctggcctgcctggtggacttcttcaccaactgccccagatacaccagctgcgagaccggcttcaaggacggcgacctgttcatgagctacagaagcatgttccaggacgtgagagacgccgtggactgggtgcactacaagggcagcctgaaggagaagaccgtggagaacctggagaagtacgtggtgaaggacggcaagctgcccctgctgctgagcagaatgaaggaggtgggcaaggtgttcctggccaccaacagcgactacaagtacaccgacaagatcatgacctacctgttcgacttcccccacggccccaagcccggcagcagccacagaccctggcagagctacttcgacctgatcctggtggacgccagaaagcccctgttcttcggcgagggcaccgtgctgagacaggtggacaccaagaccggcaagctgaagatcggcacctacaccggccccctgcagcacggcatcgtgtacagcggcggcagcagcgacaccatctgcgacctgctgggcgccaagggcaaggacatcctgtacatcggcgaccacatcttcggcgacatcctgaagagcaagaagagacagggctggagaaccttcctggtgatccccgagctggcccaggagctgcacgtgtggaccgacaagagcagcctgttcgaggagctgcagagcctggacatcttcctggccgagctgtacaagcacctggacagcagcagcaacgagagacccgacatcagcagcatccagagaagaatcaagaaggtgacccacgacatggacatgtgctacggcatgatgggcagcctgttcagaagcggcagcagacagaccctgttcgccagccaggtgatgagatacgccgacctgtacgccgccagcttcatcaacctgctgtactaccccttcagctacctgttcagagccgcccacgtgctgatgccccacgagagcaccgtggagcacacccacgtggacatcaacgagatggagagccccctggccaccagaaacagaaccagcgtggacttcaaggacaccgactacaagagacaccagctgaccagaagcatcagcgagatcaagccccccaacctgttccccctggccccccaggagatcacccactgccacgacgaggacgacgacgaggaggaggaggaggaggaggagtag

SEQ ID NO: 71210 - DNA, 798 bp, Artificial Sequence
  Description of Artificial Sequence: Synthetic coding sequence
atgagcaccagctggagcgacagactgcagaacgccgccgacatgcccgccaacatggacaagcacgccctgaagaagtacagaagagaggcctaccacagagtgttcgtgaacagaagcctggccatggagaagatcaagtgcttcggcttcgacatggactacaccctggccgtgtacaagagccccgagtacgagagcctgggcttcgagctgaccgtggagagactggtgagcatcggctacccccaggagctgctgagcttcgcctacgacagcaccttccccaccagaggcctggtgttcgacaccctgtacggcaacctgctgaaggtggacgcctacggcaacctgctggtgtgcgcccacggcttcaacttcatcagaggcagccaggtggccgtgcagaagagacccgagaccagagagcagtaccccaacaagttcatccagagagacgacaccgagagattctacatcctgaacaccctgttcaacctgcccgagacctacctgctggcctgcctggtggacttcttcaccaactgccccagatacaccagctgcgagaccggcttcaaggacggcgacctgttcatgagctacagaagcatgttccaggacgtgagagacgccgtggactgggtgcactacaagggcagcctgaaggagaagaccgtggagaacctggagaagtacgtggtgaaggacggcaagctgcccctgctgctgagcagaatgaaggaggtgggcaaggtgttcctggccaccaacagcgactacaagtacaccgactag

SEQ ID NO: 71211 - DNA, 525 bp, Artificial Sequence
  Description of Artificial Sequence: Synthetic coding sequence
gtgagcatcggctacccccaggagctgctgagcttcgcctacgacagcaccttccccaccagaggcctggtgttcgacaccctgtacggcaacctgctgaaggtggacgcctacggcaacctgctggtgtgcgcccacggcttcaacttcatcagaggcagccaggtggccgtgcagaagagacccgagaccagagagcagtaccccaacaagttcatccagagagacgacaccgagagattctacatcctgaacaccctgttcaacctgcccgagacctacctgctggcctgcctggtggacttcttcaccaactgccccagatacaccagctgcgagaccggcttcaaggacggcgacctgttcatgagctacagaagcatgttccaggacgtgagagacgccgtggactgggtgcactacaagggcagcctgaaggagaagaccgtggagaacctggagaagtacgtggtgaaggacagcaagagcagcagaatccagtacttcctgaaggtgctgtggtag

SEQ ID NO: 71212 - DNA, 1011 bp, Artificial Sequence
  Description of Artificial Sequence: Synthetic coding sequence
atgagagcccccagcatggacagagccgccgtggccagagtgggcgccgtggccagcgccagcgtgtgcgccctggtggccggcgtggtgctggcccagtacatcttcaccctgaagagaaagaccggcagaaagaccaagatcatcgagatgatgcccgagttccagaagagcagcgtgagaatcaagaaccccaccagagtggaggagatcatctgcggcctgatcaagggcggcgccgccaagctgcagatcatcaccgacttcgacatgaccctgagcagattcagctacaagggcaagagatgccccacctgccacaacatcatcgacaactgcaagctggtgaccgacgagtgcagaaagaagctgctgcagctgaaggagaagtactacgccatcgaggtggaccccgtgctgaccgtggaggagaagtacccctacatggtggagtggtacaccaagagccacggcctgctggtgcagcaggccctgcccaaggccaagctgaaggagatcgtggccgagagcgacgtgatgctgaaggagggctacgagaacttcttcgacaagctgcagcagcacagcatccccgtgttcatcttcagcgccggcatcggcgacgtgctggaggaggtgatcagacaggccggcgtgtaccaccccaacgtgaaggtggtgagcaacttcatggacttcgacgagaccggcgtgctgaagggcttcaagggcgagctgatccacgtgttcaacaagcacgacggcgccctgagaaacaccgagtacttcaaccagctgaaggacaacagcaacatcatcctgctgggcgacagccagggcgacctgagaatggccgacggcgtggccaacgtggagcacatcctgaagatcggctacctgaacgacagagtggacgagctgctggagaagtacatggacagctacgacatcgtgctggtgcaggacgagagcctggaggtggccaacagcatcctgcagaagatcctgtag

SEQ ID NO: 71213 - DNA, 858 bp, Artificial Sequence
  Description of Artificial Sequence: Synthetic coding sequence
atgcccgagttccagaagagcagcgtgagaatcaagaaccccaccagagtggaggagatcatctgcggcctgatcaagggcggcgccgccaagctgcagatcatcaccgacttcgacatgaccctgagcagattcagctacaagggcaagagatgccccacctgccacaacatcatcgacaactgcaagctggtgaccgacgagtgcagaaagaagctgctgcagctgaaggagaagtactacgccatcgaggtggaccccgtgctgaccgtggaggagaagtacccctacatggtggagtggtacaccaagagccacggcctgctggtgcagcaggccctgcccaaggccaagctgaaggagatcgtggccgagagcgacgtgatgctgaaggagggctacgagaacttcttcgacaagctgcagcagcacagcatccccgtgttcatcttcagcgccggcatcggcgacgtgctggaggaggtgatcagacaggccggcgtgtaccaccccaacgtgaaggtggtgagcaacttcatggacttcgacgagaccggcgtgctgaagggcttcaagggcgagctgatccacgtgttcaacaagcacgacggcgccctgagaaacaccgagtacttcaaccagctgaaggacaacagcaacatcatcctgctgggcgacagccagggcgacctgagaatggccgacggcgtggccaacgtggagcacatcctgaagatcggctacctgaacgacagagtggacgagctgctggagaagtacatggacagctacgacatcgtgctggtgcaggacgagagcctggaggtggccaacagcatcctgcagaagatcctgtag

SEQ ID NO: 71214 - DNA, 894 bp, Artificial Sequence
  Description of Artificial Sequence: Synthetic coding sequence
atgaccaaccaggagagcgccgtgcacgtgaagatgatgcccgagttccagaagagcagcgtgagaatcaagaaccccaccagagtggaggagatcatctgcggcctgatcaagggcggcgccgccaagctgcagatcatcaccgacttcgacatgaccctgagcagattcagctacaagggcaagagatgccccacctgccacaacatcatcgacaactgcaagctggtgaccgacgagtgcagaaagaagctgctgcagctgaaggagaagtactacgccatcgaggtggaccccgtgctgaccgtggaggagaagtacccctacatggtggagtggtacaccaagagccacggcctgctggtgcagcaggccctgcccaaggccaagctgaaggagatcgtggccgagagcgacgtgatgctgaaggagggctacgagaacttcttcgacaagctgcagcagcacagcatccccgtgttcatcttcagcgccggcatcggcgacgtgctggaggaggtgatcagacaggccggcgtgtaccaccccaacgtgaaggtggtgagcaacttcatggacttcgacgagaccggcgtgctgaagggcttcaagggcgagctgatccacgtgttcaacaagcacgacggcgccctgagaaacaccgagtacttcaaccagctgaaggacaacagcaacatcatcctgctgggcgacagccagggcgacctgagaatggccgacggcgtggccaacgtggagcacatcctgaagatcggctacctgaacgacagagtggacgagctgctggagaagtacatggacagctacgacatcgtgctggtgcaggacgagagcctggaggtggccaacagcatcctgcagaagatcctgtag

SEQ ID NO: 71215 - DNA, 894 bp, Artificial Sequence; identical to SEQ ID NO: 71214
  Description of Artificial Sequence: Synthetic coding sequence

SEQ ID NO: 71216 - DNA, 858 bp, Artificial Sequence; identical to SEQ ID NO: 71213
  Description of Artificial Sequence: Synthetic coding sequence

SEQ ID NO: 71217 - DNA, 129 bp, Artificial Sequence
  Description of Artificial Sequence: Synthetic coding sequence
atgcccgagttccagaagagcagcgtgagaatcaagaaccccaccagagtggaggagatcatctgcggcctgatcaagggcggcgccgccaagctgcagatcatcaccgacttcgacatgaccctgtag

SEQ ID NO: 71218 - DNA, 1725 bp, Artificial Sequence
  Description of Artificial Sequence: Synthetic coding sequence
atgtgccccagagccgccagagcccccgccaccctgctgctggccctgggcgccgtgctgtggcccgccgccggcgcctgggagctgaccatcctgcacaccaacgacgtgcacagcagactggagcagaccagcgaggacagcagcaagtgcgtgaacgccagcagatgcatgggcggcgtggccagactgttcaccaaggtgcagcagatcagaagagccgagcccaacgtgctgctgctggacgccggcgaccagtaccagggcaccatctggttcaccgtgtacaagggcgccgaggtggcccacttcatgaacgccctgagatacgacgccatggccctgggcaaccacgagttcgacaacggcgtggagggcctgatcgagcccctgctgaaggaggccaagttccccatcctgagcgccaacatcaaggccaagggccccctggccagccagatcagcggcctgtacctgccctacaaggtgctgcccgtgggcgacgaggtggtgggcatcgtgggctacaccagcaaggagacccccttcctgagcaaccccggcaccaacctggtgttcgaggacgagatcaccgccctgcagcccgaggtggacaagctgaagaccctgaacgtgaacaagatcatcgccctgggccacagcggcttcgagatggacaagctgatcgcccagaaggtgagaggcgtggacgtggtggtgggcggccacagcaacaccttcctgtacaccggcaacccccccagcaaggaggtgcccgccggcaagtaccccttcatcgtgaccagcgacgacggcagaaaggtgcccgtggtgcaggcctacgccttcggcaagtacctgggctacctgaagatcgagttcgacgagagaggcaacgtgatcagcagccacggcaaccccatcctgctgaacagcagcatccccgaggaccccagcatcaaggccgacatcaacaagtggagaatcaagctggacaactacagcacccaggagctgggcaagaccatcgtgtacctggacggcagcagccagagctgcagattcagagagtgcaacatgggcaacctgatctgcgacgccatgatcaacaacaacctgagacacaccgacgagatgttctggaaccacgtgagcatgtgcatcctgaacggcggcggcatcagaagccccatcgacgagagaaacaacggcaccatcacctgggagaacctggccgccgtgctgcccttcggcggcaccttcgacctggtgcagctgaagggcagcaccctgaagaaggccttcgagcacagcgtgcacagatacggccagagcaccggcgagttcctgcaggtgggcggcatccacgtggtgtacgacctgagcagaaagcccggcgacagagtggtgaagctggacgtgctgtgcaccaagtgcagagtgcccagctacgaccccctgaagatggacgaggtgtacaaggtgatcctgcccaacttcctggccaacggcggcgacggcttccagatgatcaaggacgagctgctgagacacgacagcggcgaccaggacatcaacgtggtgagcacctacatcagcaagatgaaggtgatctaccccgccgtggagggcagaatcaagttcagcaccggcagccactgccacggcagcttcagcctgatcttcctgagcctgtgggccgtgatcttcgtgctgtaccagtag

SEQ ID NO: 71219 - DNA, 795 bp, Artificial Sequence
  Description of Artificial Sequence: Synthetic coding sequence
atgtgccccagagccgccagagcccccgccaccctgctgctggccctgggcgccgtgctgtggcccgccgccggcgcctgggagctgaccatcctgcacaccaacgacgtgcacagcagactggagcagaccagcgaggacagcagcaagtgcgtgaacgccagcagatgcatgggcggcgtggccagactgttcaccaaggtgcagcagatcagaagagccgagcccaacgtgctgctgctggacgccggcgaccagtaccagggcaccatctggttcaccgtgtacaagggcgccgaggtggcccacttcatgaacgccctgagatacgacgccatggccctgggcaaccacgagttcgacaacggcgtggagggcctgatcgagcccctgctgaaggaggccaagttccccatcctgagcgccaacatcaaggccaagggccccctggccagccagatcagcggcctgtacctgccctacaaggtgctgcccgtgggcgacgaggtggtgggcatcgtgggctacaccagcaaggagacccccttcctgagcaaccccggcaccaacctggtgttcgaggacgagatcaccgccctgcagcccgaggtggacaagctgaagaccctgaacgtgaacaagatcatcgccctgggccacagcggcttcgagatggacaagctgatcgcccagaaggtgagaggcgtggacgtggtggtgggcggccacagcaacaccttcctgtacaccggcaactgcttcaagagaatcgcctgggccagaatgagcagatag

SEQ ID NO: 71220 - DNA, 780 bp, Artificial Sequence
  Description of Artificial Sequence: Synthetic coding sequence
atggacaagctgatcgcccagaaggtgagaggcgtggacgtggtggtgggcggccacagcaacaccttcctgtacaccggcaacccccccagcaaggaggtgcccgccggcaagtaccccttcatcgtgaccagcgacgacggcagaaaggtgcccgtggtgcaggcctacgccttcggcaagtacctgggctacctgaagatcgagttcgacgagagaggcaacgtgatcagcagccacggcaaccccatcctgctgaacagcagcatccccgaggaccccagcatcaaggccgacatcaacaagtggagaatcaagctggacaactacagcacccaggagctgggcaagaccatcgtgtacctggacggcagcagccagagctgcagattcagagagtgcaacatgggcaacctgatctgcgacgccatgatcaacaacaacctgagacacaccgacgagatgttctggaaccacgtgagcatgtgcatcctgaacggcggcggcatcagaagccccatcgacgagagaaacaacggcaccatcacctgggagaacctggccgccgtgctgcccttcggcggcaccttcgacctggtgcagctgaagggcagcaccctgaagaaggccttcgagcacagcgtgcacagatacggccagagcaccggcgagttcctgcaggtgggcgacctgaaggagtgctgccccatctgcatcaaccaggacgacagctggaaggagcagcccaccgcccagacctacctgaacacctggttctag

SEQ ID NO: 71221 - DNA, 1575 bp, Artificial Sequence
  Description of Artificial Sequence: Synthetic coding sequence
atgtgccccagagccgccagagcccccgccaccctgctgctggccctgggcgccgtgctgtggcccgccgccggcgcctgggagctgaccatcctgcacaccaacgacgtgcacagcagactggagcagaccagcgaggacagcagcaagtgcgtgaacgccagcagatgcatgggcggcgtggccagactgttcaccaaggtgcagcagatcagaagagccgagcccaacgtgctgctgctggacgccggcgaccagtaccagggcaccatctggttcaccgtgtacaagggcgccgaggtggcccacttcatgaacgccctgagatacgacgccatggccctgggcaaccacgagttcgacaacggcgtggagggcctgatcgagcccctgctgaaggaggccaagttccccatcctgagcgccaacatcaaggccaagggccccctggccagccagatcagcggcctgtacctgccctacaaggtgctgcccgtgggcgacgaggtggtgggcatcgtgggctacaccagcaaggagacccccttcctgagcaaccccggcaccaacctggtgttcgaggacgagatcaccgccctgcagcccgaggtggacaagctgaagaccctgaacgtgaacaagatcatcgccctgggccacagcggcttcgagatggacaagctgatcgcccagaaggtgagaggcgtggacgtggtggtgggcggccacagcaacaccttcctgtacaccggcaacccccccagcaaggaggtgcccgccggcaagtaccccttcatcgtgaccagcgacgacggcagaaaggtgcccgtggtgcaggcctacgccttcggcaagtacctgggctacctgaagatcgagttcgacgagagaggcaacgtgatcagcagccacggcaaccccatcctgctgaacagcagcatccccgaggaccccagcatcaaggccgacatcaacaagtggagaatcaagctggacaactacagcacccaggagctgggcaagaccatcgtgtacctggacggcagcagccagagctgcagattcagagagtgcaacatgggcaacctgatctgcgacgccatgatcaacaacaacctgagacacaccgacgagatgttctggaaccacgtgagcatgtgcatcctgaacggcggcggcatcagaagccccatcgacgagagaaacaacggcatccacgtggtgtacgacctgagcagaaagcccggcgacagagtggtgaagctggacgtgctgtgcaccaagtgcagagtgcccagctacgaccccctgaagatggacgaggtgtacaaggtgatcctgcccaacttcctggccaacggcggcgacggcttccagatgatcaaggacgagctgctgagacacgacagcggcgaccaggacatcaacgtggtgagcacctacatcagcaagatgaaggtgatctaccccgccgtggagggcagaatcaagttcagcaccggcagccactgccacggcagcttcagcctgatcttcctgagcctgtgggccgtgatcttcgtgctgtaccagtag

SEQ ID NO: 71222 - DNA, 693 bp, Artificial Sequence
  Description of Artificial Sequence: Synthetic coding sequence
tgagacgtggtggtgggcggccacagcaacaccttcctgtacaccggcaacccccccagcaaggaggtgcccgccggcaagtaccccttcatcgtgaccagcgacgacggcagaaaggtgcccgtggtgcaggcctacgccttcggcaagtacctgggctacctgaagatcgagttcgacgagagaggcaacgtgatcagcagccacggcaaccccatcctgctgaacagcagcatccccgaggaccccagcatcaaggccgacatcaacaagtggagaatcaagctggacaactacagcacccaggagctgggcaagaccatcgtgtacctggacggcagcagccagagctgcagattcagagagtgcaacatgggcaacctgatctgcgacgccatgatcaacaacaacctgagacacaccgacgagatgttctggaaccacgtgagcatgtgcatcctgaacggcggcggcatcagaagccccatcgacgagagaaacaacggcatccacgtggtgtacgacctgagcagaaagcccggcgacagagtggtgaagctggacgtgctgtgcaccaagtgcagagtgcccagctacgaccccctgaagatggacgaggtgtacaaggtgatcctgcccaacttcctggccaacggcggcgacggcttccagatgatcaaggacgagctgtag

SEQ ID NO: 71223 - DNA, 540 bp, Artificial Sequence
  Description of Artificial Sequence: Synthetic coding sequence
tgaaaccccatcctgctgaacagcagcatccccgaggaccccagcatcaaggccgacatcaacaagtggagaatcaagctggacaactacagcacccaggagctgggcaagaccatcgtgtacctggacggcagcagccagagctgcagattcagagagtgcaacatgggcaacctgatctgcgacgccatgatcaacaacaacctgagacacaccgacgagatgttctggaaccacgtgagcatgtgcatcctgaacggcggcggcatcagaagccccatcgacgagagaaacaacggcaccatcacctgggagaacctggccgccgtgctgcccttcggcggcaccttcgacctggtgcagctgaagggcagcaccctgaagaaggccttcgagcacagcgtgcacagatacggccagagcaccggcgagttcctgcaggtgggcgacctgaaggagtgctgccccatctgcatcaaccaggacgacagctggaaggagcagcccaccgcccagacctacctgaacacctggttctag

SEQ ID NO: 71224 - DNA, 687 bp, Artificial Sequence
  Description of Artificial Sequence: Synthetic coding sequence
atggtgagatacagcctggaccccgagaaccccaccaagagctgcaagagcagaggcagcaacctgagagtgcacttcaagaacaccagagagaccgcccaggccatcaagggcatgcacatcagaaaggccaccaagtacctgaaggacgtgaccctgcagaagcagtgcgtgcccttcagaagatacaacggcggcgtgggcagatgcgcccaggccaagcagtggggctggacccagggcagatggcccaagaagagcgccgagttcctgctgcacatgctgaagaacgccgagagcaacgccgagctgaagggcctggacgtggacagcctggtgatcgagcacatccaggtgaacaaggcccccaagatgagaagaagaacctacagagcccacggcagaatcaacccctacatgagcagcccctgccacatcgagatgatcctgaccgagaaggagcagatcgtgcccaagcccgaggaggaggtggcccagaagaagaagctgagaagcagcagcctgggcaagtggtgcgccttcctggtgagcagcttccagttctgcagcggcagcaccaagaacagctggagccacatctacaccctgtggttcccccccagcctggtggtgtacggcctgagaaagcagtacaagaaccccatgatccagaccaaggccaagtag

SEQ ID NO: 71225 - DNA, 816 bp, Artificial Sequence
  Description of Artificial Sequence: Synthetic coding sequence
atgagccccgagatgggcgagctgacccagaccagactgcagaagatctggatcccccacagcagcggcagcagcagactgcagagaagaagaggcagcagcatcccccagttcaccaacagccccaccatggtgatcatggtgggcctgcccgccagaggcaagacctacatcagcaccaagctgaccagatacctgaactggatcggcacccccaccaaggacaacatggaggccctgcagatcagaaagcagtgcgccctggccgccctgaaggacgtgcacaactacctgagccacgaggagggccacgtggccgtgttcgacgccaccaacaccaccagagagagaagaagcctgatcctgcagttcgccaaggagcacggctacaagggcgtgtgcgaggagatgacctacgaggagatccaggagcactaccccgaggagttcgccctgagagaccaggacaagtacagatacagataccccaagggcgagagctacgaggacctggtgcagagactggagcccgtgatcatggagctggagagacaggagaacgtgctggtgatctgccaccaggccgtgatgagatgcctgctggcctacttcctggacaagagcagcgacgagctgccctacctgaagtgccccctgcacaccgtgctgaagctgacccccgtggcctacggctgcaaggtggagagcatctacctgaacgtggaggccgtgaacacccacagagagaagcccgagaacgtggacatcaccagagagcccgaggaggccctggacaccgtgcccgcccactactag

SEQ ID NO: 71226 - DNA, 1416 bp, Artificial Sequence
  Description of Artificial Sequence: Synthetic coding sequence
atgagccccgagatgggcgagctgacccagaccagactgcagaagatctggatcccccacagcagcggcagcagcagactgcagagaagaagaggcagcagcatcccccagttcaccaacagccccaccatggtgatcatggtgggcctgcccgccagaggcaagacctacatcagcaccaagctgaccagatacctgaactggatcggcacccccaccaaggtgttcaacctgggccagtacagaagagaggccgtgagctacaagaactacgagttcttcctgcccgacaacatggaggccctgcagatcagaaagcagtgcgccctggccgccctgaaggacgtgcacaactacctgagccacgaggagggccacgtggccgtgttcgacgccaccaacaccaccagagagagaagaagcctgatcctgcagttcgccaaggagcacggctacaaggtgttcttcatcgagagcatctgcaacgaccccggcatcatcgccgagaacatcagacaggtgaagctgggcagccccgactacatcgactgcgacagagagaaggtgctggaggacttcctgaagagaatcgagtgctacgaggtgaactaccagcccctggacgaggagctggacagccacctgagctacatcaagatcttcgacgtgggcaccagatacatggtgaacagagtgcaggaccacatccagagcagaaccgtgtactacctgatgaacatccacgtgacccccagaagcatctacctgtgcagacacggcgagagcgagctgaacatcagaggcagaatcggcggcgacagcggcctgagcgtgagaggcaagcagtacgcctacgccctggccaacttcatccagagccagggcatcagcagcctgaaggtgtggaccagccacatgaagagaaccatccagaccgccgaggccctgggcgtgccctacgagcagtggaaggccctgaacgagatcgacgccggcgtgtgcgaggagatgacctacgaggagatccaggagcactaccccgaggagttcgccctgagagaccaggacaagtacagatacagataccccaagggcgagagctacgaggacctggtgcagagactggagcccgtgatcatggagctggagagacaggagaacgtgctggtgatctgccaccaggccgtgatgagatgcctgctggcctacttcctggacaagagcagcgacgagctgccctacctgaagtgccccctgcacaccgtgctgaagctgacccccgtggcctacggctgcaaggtggagagcatctacctgaacgtggaggccgtgaacacccacagagagaagcccgagaacgtggacatcaccagagagcccgaggaggccctggacaccgtgcccgcccactactag

SEQ ID NO: 71227 - DNA, 1221 bp, Artificial Sequence
  Description of Artificial Sequence: Synthetic coding sequence
atggaggagaagaccagcagaatcaaggtgttcaacctgggccagtacagaagagaggccgtgagctacaagaactacgagttcttcctgcccgacaacatggaggccctgcagatcagaaagcagtgcgccctggccgccctgaaggacgtgcacaactacctgagccacgaggagggccacgtggccgtgttcgacgccaccaacaccaccagagagagaagaagcctgatcctgcagttcgccaaggagcacggctacaaggtgttcttcatcgagagcatctgcaacgaccccggcatcatcgccgagaacatcagacaggtgaagctgggcagccccgactacatcgactgcgacagagagaaggtgctggaggacttcctgaagagaatcgagtgctacgaggtgaactaccagcccctggacgaggagctggacagccacctgagctacatcaagatcttcgacgtgggcaccagatacatggtgaacagagtgcaggaccacatccagagcagaaccgtgtactacctgatgaacatccacgtgacccccagaagcatctacctgtgcagacacggcgagagcgagctgaacatcagaggcagaatcggcggcgacagcggcctgagcgtgagaggcaagcagtacgcctacgccctggccaacttcatccagagccagggcatcagcagcctgaaggtgtggaccagccacatgaagagaaccatccagaccgccgaggccctgggcgtgccctacgagcagtggaaggccctgaacgagatcgacgccggcgtgtgcgaggagatgacctacgaggagatccaggagcactaccccgaggagttcgccctgagagaccaggacaagtacagatacagataccccaagggcgagagctacgaggacctggtgcagagactggagcccgtgatcatggagctggagagacaggagaacgtgctggtgatctgccaccaggccgtgatgagatgcctgctggcctacttcctggacaagagcagcgacgagctgccctacctgaagtgccccctgcacaccgtgctgaagctgacccccgtggcctacggctgcaaggtggagagcatctacctgaacgtggaggccgtgaacacccacagagagaagcccgagaacgtggacatcaccagagagcccgaggaggccctggacaccgtgcccgcccactactag

SEQ ID NO: 71228 - DNA, 1416 bp, Artificial Sequence
  Description of Artificial Sequence: Synthetic coding sequence
atgagcggcgccagcagcagcgagcagaacaacaacagctacgagaccaagacccccaacctgagaatgagcgagaagaagtgcagctgggccagctacatgaccaacagccccaccctgatcgtgatgatcggcctgcccgccagaggcaagacctacgtgagcaagaagctgaccagatacctgaactggatcggcgtgcccaccaaggtgttcaacctgggcgtgtacagaagagaggccgtgaagagctacaagagctacgacttcttcagacacgacaacgaggaggccatgaagatcagaaagcagtgcgccctggtggccctggaggacgtgaaggcctacctgaccgaggagaacggccagatcgccgtgttcgacgccaccaacaccaccagagagagaagagacatgatcctgaacttcgccgagcagaacagcttcaaggtgttcttcgtggagagcgtgtgcgacgaccccgacgtgatcgccgccaacatcctggaggtgaaggtgagcagccccgactaccccgagagaaacagagagaacgtgatggaggacttcctgaagagaatcgagtgctacaaggtgacctacagacccctggaccccgacaactacgacaaggacctgagcttcatcaaggtgatcaacgtgggccagagattcctggtgaacagagtgcaggactacatccagagcaagatcgtgtactacctgatgaacatccacgtgcagcccagaaccatctacctgtgcagacacggcgagagcgagttcaacctgctgggcaagatcggcggcgacagcggcctgagcgtgagaggcaagcagttcgcccaggccctgagaaagttcctggaggagcaggagatcaccgacctgaaggtgtggaccagccagctgaagagaaccatccagaccgccgagagcctgggcgtgccctacgagcagtggaagatcctgaacgagatcgacgccggcgtgtgcgaggagatgacctacgccgagatcgagaagagataccccgaggagttcgccctgagagaccaggagaagtacctgtacagataccccggcggcgagagctaccaggacctggtgcagagactggagcccgtgatcatggagctggagagacagggcaacgtgctggtgatcagccaccaggccgtgatgagatgcctgctggcctacttcctggacaagggcgccgacgagctgccctacctgagatgccccctgcacaccatcttcaagctgacccccgtggcctacggctgcaaggtggagaccatcaagctgaacgtggaggccgtgaacacccacagagacaagcccaccgccgccgagaccaccctggccgtgagaagaagacccagcgccgccagcctgatgctgccctgctag

SEQ ID NO: 71229 - DNA, 1518 bp, Artificial Sequence
  Description of Artificial Sequence: Synthetic coding sequence
atgagcggcgccagcagcagcgagcagaacaacaacagctacgagaccaagacccccaacctgagaatgagcgagaagaagtgcagctgggccagctacatgaccaacagccccaccctgatcgtgatgatcggcctgcccgccagaggcaagacctacgtgagcaagaagctgaccagatacctgaactggatcggcgtgcccaccaaggtgttcaacctgggcgtgtacagaagagaggccgtgaagagctacaagagctacgacttcttcagacacgacaacgaggaggccatgaagatcagaaagcagtgcgccctggtggccctggaggacgtgaaggcctacctgaccgaggagaacggccagatcgccgtgttcgacgccaccaacaccaccagagagagaagagacatgatcctgaacttcgccgagcagaacagcttcaaggtgttcttcgtggagagcgtgtgcgacgaccccgacgtgatcgccgccaacatcctggaggtgaaggtgagcagccccgactaccccgagagaaacagagagaacgtgatggaggacttcctgaagagaatcgagtgctacaaggtgacctacagacccctggaccccgacaactacgacaaggacctgagcttcatcaaggtgatcaacgtgggccagagattcctggtgaacagagtgcaggactacatccagagcaagatcgtgtactacctgatgaacatccacgtgcagcccagaaccatctacctgtgcagacacggcgagagcgagttcaacctgctgggcaagatcggcggcgacagcggcctgagcgtgagaggcaagcagttcgcccaggccctgagaaagttcctggaggagcaggagatcaccgacctgaaggtgtggaccagccagctgaagagaaccatccagaccgccgagagcctgggcgtgccctacgagcagtggaagatcctgaacgagatcgacgccggcgtgtgcgaggagatgacctacgccgagatcgagaagagataccccgaggagttcgccctgagagaccaggagaagtacctgtacagataccccggcggcgagagctaccaggacctggtgcagagactggagcccgtgatcatggagctggagagacagggcaacgtgctggtgatcagccaccaggccgtgatgagatgcctgctggcctacttcctggacaagggcgccgacgagctgccctacctgagatgccccctgcacaccatcttcaagctgacccccgtggcctacggctgcaaggtggagaccatcaagctgaacgtggaggccgtgaacacccacagagacaagcccaccaacaacttccccaagaaccagacccccgtgagaatgagaagaaacagcttcacccccctgagcagcagcaacaccatcagaagacccagaaactacagcgtgggcagcagacccctgaagcccctgagccccctgagagcccaggacatgcaggagggcgccgactag

SEQ ID NO: 71230 - DNA, 1122 bp, Artificial Sequence
  Description of Artificial Sequence: Synthetic coding sequence
atgaagatcagaaagcagtgcgccctggtggccctggaggacgtgaaggcctacctgaccgaggagaacggccagatcgccgtgttcgacgccaccaacaccaccagagagagaagagacatgatcctgaacttcgccgagcagaacagcttcaaggtgttcttcgtggagagcgtgtgcgacgaccccgacgtgatcgccgccaacatcctggaggtgaaggtgagcagccccgactaccccgagagaaacagagagaacgtgatggaggacttcctgaagagaatcgagtgctacaaggtgacctacagacccctggaccccgacaactacgacaaggacctgagcttcatcaaggtgatcaacgtgggccagagattcctggtgaacagagtgcaggactacatccagagcaagatcgtgtactacctgatgaacatccacgtgcagcccagaaccatctacctgtgcagacacggcgagagcgagttcaacctgctgggcaagatcggcggcgacagcggcctgagcgtgagaggcaagcagttcgcccaggccctgagaaagttcctggaggagcaggagatcaccgacctgaaggtgtggaccagccagctgaagagaaccatccagaccgccgagagcctgggcgtgccctacgagcagtggaagatcctgaacgagatcgacgccggcgtgtgcgaggagatgacctacgccgagatcgagaagagataccccgaggagttcgccctgagagaccaggagaagtacctgtacagataccccggcggcgagagctaccaggacctggtgcagagactggagcccgtgatcatggagctggagagacagggcaacgtgctggtgatcagccaccaggccgtgatgagatgcctgctggcctacttcctggacaagggcgccgacgagctgccctacctgagatgccccctgcacaccatcttcaagctgacccccgtggcctacggctgcaaggtggagaccatcaagctgaacgtggaggccgtgaacacccacagagacaagcccaccgccgccgagaccaccctggccgtgagaagaagacccagcgccgccagcctgatgctgccctgctag

SEQ ID NO: 71231 - DNA, 795 bp, Artificial Sequence
  Description of Artificial Sequence: Synthetic coding sequence
atggaggacttcctgaagagaatcgagtgctacaaggtgacctacagacccctggaccccgacaactacgacaaggacctgagcttcatcaaggtgatcaacgtgggccagagattcctggtgaacagagtgcaggactacatccagagcaagatcgtgtactacctgatgaacatccacgtgcagcccagaaccatctacctgtgcagacacggcgagagcgagttcaacctgctgggcaagatcggcggcgacagcggcctgagcgtgagaggcaagcagttcgcccaggccctgagaaagttcctggaggagcaggagatcaccgacctgaaggtgtggaccagccagctgaagagaaccatccagaccgccgagagcctgggcgtgccctacgagcagtggaagatcctgaacgagatcgacgccggcgtgtgcgaggagatgacctacgccgagatcgagaagagataccccgaggagttcgccctgagagaccaggagaagtacctgtacagataccccggcggcgagagctaccaggacctggtgcagagactggagcccgtgatcatggagctggagagacagggcaacgtgctggtgatcagccaccaggccgtgatgagatgcctgctggcctacttcctggacaagggcgccggctgcaaggtggagaccatcaagctgaacgtggaggccgtgaacacccacagagacaagcccaccgccgccgagaccaccctggccgtgagaagaagacccagcgccgccagcctgatgctgccctgctag

SEQ ID NO: 71232 - DNA, 1419 bp, Artificial Sequence
  Description of Artificial Sequence: Synthetic coding sequence
atgaccaacagccccaccctgatcgtgatgatcggcctgcccgccagaggcaagacctacgtgagcaagaagctgaccagatacctgaactggatcggcgtgcccaccaaggtgttcaacctgggcgtgtacagaagagaggccgtgaagagctacaagagctacgacttcttcagacacgacaacgaggaggccatgaagatcagaaagcagtgcgccctggtggccctggaggacgtgaaggcctacctgaccgaggagaacggccagatcgccgtgttcgacgccaccaacaccaccagagagagaagagacatgatcctgaacttcgccgagcagaacagcttcaaggtgttcttcgtggagagcgtgtgcgacgaccccgacgtgatcgccgccaacatcctggaggtgaaggtgagcagccccgactaccccgagagaaacagagagaacgtgatggaggacttcctgaagagaatcgagtgctacaaggtgacctacagacccctggaccccgacaactacgacaaggacctgagcttcatcaaggtgatcaacgtgggccagagattcctggtgaacagagtgcaggactacatccagagcaagatcgtgtactacctgatgaacatccacgtgcagcccagaaccatctacctgtgcagacacggcgagagcgagttcaacctgctgggcaagatcggcggcgacagcggcctgagcgtgagaggcaagcagttcgcccaggccctgagaaagttcctggaggagcaggagatcaccgacctgaaggtgtggaccagccagctgaagagaaccatccagaccgccgagagcctgggcgtgccctacgagcagtggaagatcctgaacgagatcgacgccggcgtgtgcgaggagatgacctacgccgagatcgagaagagataccccgaggagttcgccctgagagaccaggagaagtacctgtacagataccccggcggcgagagctaccaggacctggtgcagagactggagcccgtgatcatggagctggagagacagggcaacgtgctggtgatcagccaccaggccgtgatgagatgcctgctggcctacttcctggacaagggcgccgacgagctgccctacctgagatgccccctgcacaccatcttcaagctgacccccgtggcctacggctgcaaggtggagaccatcaagctgaacgtggaggccgtgaacacccacagagacaagcccaccaacaacttccccaagaaccagacccccgtgagaatgagaagaaacagcttcacccccctgagcagcagcaacaccatcagaagacccagaaactacagcgtgggcagcagacccctgaagcccctgagccccctgagagcccaggacatgcaggagggcgccgactag

SEQ ID NO: 71233 - DNA, 1542 bp, Artificial Sequence
  Description of Artificial Sequence: Synthetic coding sequence
atgcccctggagctgacccagagcagagtgcagaagatctgggtgcccgtggaccacagacccagcctgcccagaagctgcggccccaagctgaccaacagccccaccgtgatcgtgatggtgggcctgcccgccagaggcaagacctacatcagcaagaagctgaccagatacctgaactggatcggcgtgcccaccaaggtgttcaacgtgggcgagtacagaagagaggccgtgaagcagtacagcagctacaacttcttcagacccgacaacgaggaggccatgaaggtgagaaagcagtgcgccctggccgccctgagagacgtgaagagctacctggccaaggagggcggccagatcgccgtgttcgacgccaccaacaccaccagagagagaagacacatgatcctgcacttcgccaaggagaacgacttcaaggccttcttcatcgagagcgtgtgcgacgaccccaccgtggtggccagcaacatcatggaggtgaagatcagcagccccgactacaaggactgcaacagcgccgaggccatggacgacttcatgaagagaatcagctgctacgaggccagctaccagcccctggaccccgacaagtgcgacagagacctgagcctgatcaaggtgatcgacgtgggcagaagattcctggtgaacagagtgcaggaccacatccagagcagaatcgtgtactacctgatgaacatccacgtgcagcccagaaccatctacctgtgcagacacggcgagaacgagcacaacctgcagggcagaatcggcggcgacagcggcctgagcagcagaggcaagaagttcgccagcgccctgagcaagttcgtggaggagcagaacctgaaggacctgagagtgtggaccagccagctgaagagcaccatccagaccgccgaggccctgagactgccctacgagcagtggaaggccctgaacgagatcgacgccggcgtgtgcgaggagctgacctacgaggagatcagagacacctaccccgaggagtacgccctgagagagcaggacaagtactactacagataccccaccggcgagagctaccaggacctggtgcagagactggagcccgtgatcatggagctggagagacaggagaacgtgctggtgatctgccaccaggccgtgctgagatgcctgctggcctacttcctggacaagagcgccgaggagatgccctacctgaagtgccccctgcacaccgtgctgaagctgacccccgtggcctacggctgcagagtggagagcatctacctgaacgtggagagcgtgtgcacccacagagagagaagcgaggacgccaagaagggccccaaccccctgatgagaagaaacagcgtgacccccctggccagccccgagcccaccaagaagcccagaatcaacagcttcgaggagcacgtggccagcaccagcgccgccctgcccagctgcctgccccccgaggtgcccacccagctgcccggccagcccctgctgggccaggcctgcctgtag

SEQ ID NO: 71234 - DNA, 1545 bp, Artificial Sequence
  Description of Artificial Sequence: Synthetic coding sequence
atgcccctggagctgacccagagcagagtgcagaagatctgggtgcccgtggaccacagacccagcctgcccagaagctgcggccccaagctgaccaacagccccaccgtgatcgtgatggtgggcctgcccgccagaggcaagacctacatcagcaagaagctgaccagatacctgaactggatcggcgtgcccaccaaggtgttcaacgtgggcgagtacagaagagaggccgtgaagcagtacagcagctacaacttcttcagacccgacaacgaggaggccatgaaggtgagaaagcagtgcgccctggccgccctgagagacgtgaagagctacctggccaaggagggcggccagatcgccgtgttcgacgccaccaacaccaccagagagagaagacacatgatcctgcacttcgccaaggagaacgacttcaaggccttcttcatcgagagcgtgtgcgacgaccccaccgtggtggccagcaacatcatggaggtgaagatcagcagccccgactacaaggactgcaacagcgccgaggccatggacgacttcatgaagagaatcagctgctacgaggccagctaccagcccctggaccccgacaagtgcgacagagacctgagcctgatcaaggtgatcgacgtgggcagaagattcctggtgaacagagtgcaggaccacatccagagcagaatcgtgtactacctgatgaacatccacgtgcagcccagaaccatctacctgtgcagacacggcgagaacgagcacaacctgcagggcagaatcggcggcgacagcggcctgagcagcagaggcaagaagttcgccagcgccctgagcaagttcgtggaggagcagaacctgaaggacctgagagtgtggaccagccagctgaagagcaccatccagaccgccgaggccctgagactgccctacgagcagtggaaggccctgaacgagatcgacgccggcgtgtgcgaggagctgacctacgaggagatcagagacacctaccccgaggagtacgccctgagagagcaggacaagtactactacagataccccaccggcgagagctaccaggacctggtgcagagactggagcccgtgatcatggagctggagagacaggagaacgtgctggtgatctgccaccaggccgtgctgagatgcctgctggcctacttcctggacaagagcgccgaggagatgccctacctgaagtgccccctgcacaccgtgctgaagctgacccccgtggcctacggctgcagagtggagagcatctacctgaacgtggagagcgtgtgcacccacagagagagaagcgaggacgccaagaagggccccaaccccctgatgagaagaaacagcgtgacccccctggccagccccgagcccaccaagaagcccagaatcaacagcttcgaggagcacgtggccagcaccagcgccgccctgcccagctgcctgccccccgaggtgcccacccagctgcccggccagcccctgctgggccaggcctgcctgacctag

SEQ ID NO: 71235 - DNA, 1545 bp, Artificial Sequence; identical to SEQ ID NO: 71234
  Description of Artificial Sequence: Synthetic coding sequence

SEQ ID NO: 71236 - DNA, 1563 bp, Artificial Sequence
  Description of Artificial Sequence: Synthetic coding sequence
atgcccctggagctgacccagagcagagtgcagaagatctgggtgcccgtggaccacagacccagcctgcccagaagctgcggccccaagctgaccaacagccccaccgtgatcgtgatggtgggcctgcccgccagaggcaagacctacatcagcaagaagctgaccagatacctgaactggatcggcgtgcccaccaaggtgttcaacgtgggcgagtacagaagagaggccgtgaagcagtacagcagctacaacttcttcagacccgacaacgaggaggccatgaaggtgagaaagcagtgcgccctggccgccctgagagacgtgaagagctacctggccaaggagggcggccagatcgccgtgttcgacgccaccaacaccaccagagagagaagacacatgatcctgcacttcgccaaggagaacgacttcaaggccttcttcatcgagagcgtgtgcgacgaccccaccgtggtggccagcaacatcatggaggtgaagatcagcagccccgactacaaggactgcaacagcgccgaggccatggacgacttcatgaagagaatcagctgctacgaggccagctaccagcccctggaccccgacaagtgcgacagagacctgagcctgatcaaggtgatcgacgtgggcagaagattcctggtgaacagagtgcaggaccacatccagagcagaatcgtgtactacctgatgaacatccacgtgcagcccagaaccatctacctgtgcagacacggcgagaacgagcacaacctgcagggcagaatcggcggcgacagcggcctgagcagcagaggcaagaagttcgccagcgccctgagcaagttcgtggaggagcagaacctgaaggacctgagagtgtggaccagccagctgaagagcaccatccagaccgccgaggccctgagactgccctacgagcagtggaaggccctgaacgagatcgacgccggcgtgtgcgaggagctgacctacgaggagatcagagacacctaccccgaggagtacgccctgagagagcaggacaagtactactacagataccccaccggcgagagctaccaggacctggtgcagagactggagcccgtgatcatggagctggagagacaggagaacgtgctggtgatctgccaccaggccgtgctgagatgcctgctggcctacttcctggacaagagcgccgaggagatgccctacctgaagtgccccctgcacaccgtgctgaagctgacccccgtggcctacggctgcagagtggagagcatctacctgaacgtggagagcgtgtgcacccacagagagagaagcgaggacgccaagaagggccccaaccccctgatgagaagaaacagcgtgacccccctggccagccccgagcccaccaagaagcccagaatcaacagcttcgaggagcacgtggccagcaccagcgccgccctgcccagctgcctgccccccgaggtgcccacccagctgcccggccagaacatgaagggcagcagaagcagcgccgacagcagcagaaagcactag

SEQ ID NO: 71237 - DNA, 354 bp, Artificial Sequence
  Description of Artificial Sequence: Synthetic coding sequence
atgccctacctgaagtgccccctgcacaccgtgctgaagctgacccccgtggcctacggctgcagagtggagagcatctacctgaacgtggagagcgtgtgcacccacagagagagaagcgaggacgccaagaagggccccaaccccctgatgagaagaaacagcgtgacccccctggccagccccgagcccaccaagaagcccagaatcaacagcttcgaggagcacgtggccagcaccagcgccgccctgcccagctgcctgccccccgaggtgcccacccagctgcccggccagcccctgctgggccaggcctgcctgaactggaagggcgtgatgagaaacgccgcctag

SEQ ID NO: 71238 - DNA, 1581 bp, Artificial Sequence
  Description of Artificial Sequence: Synthetic coding sequence
atgcccctggagctgacccagagcagagtgcagaagatctgggtgcccgtggaccacagacccagcctgcccagaagctgcggccccaagctgaccaacagccccaccgtgatcgtgatggtgggcctgcccgccagaggcaagacctacatcagcaagaagctgaccagatacctgaactggatcggcgtgcccaccaaggtgttcaacgtgggcgagtacagaagagaggccgtgaagcagtacagcagctacaacttcttcagacccgacaacgaggaggccatgaaggtgagaaagcagtgcgccctggccgccctgagagacgtgaagagctacctggccaaggagggcggccagatcgccgtgttcgacgccaccaacaccaccagagagagaagacacatgatcctgcacttcgccaaggagaacgacttcaaggccttcttcatcgagagcgtgtgcgacgaccccaccgtggtggccagcaacatcatggaggtgaagatcagcagccccgactacaaggactgcaacagcgccgaggccatggacgacttcatgaagagaatcagctgctacgaggccagctaccagcccctggaccccgacaagtgcgacagagacctgagcctgatcaaggtgatcgacgtgggcagaagattcctggtgaacagagtgcaggaccacatccagagcagaatcgtgtactacctgatgaacatccacgtgcagcccagaaccatctacctgtgcagacacggcgagaacgagcacaacctgcagggcagaatcggcggcgacagcggcctgagcagcagaggcaagaagttcgccagcgccctgagcaagttcgtggaggagcagaacctgaaggacctgagagtgtggaccagccagctgaagagcaccatccagaccgccgaggccctgagactgccctacgagcagtggaaggccctgaacgagatcgacgccggcgtgtgcgaggagctgacctacgaggagatcagagacacctaccccgaggagtacgccctgagagagcaggacaagtactactacagataccccaccggcgagagctaccaggacctggtgcagagactggagcccgtgatcatggagctggagagacaggagaacgtgctggtgatctgccaccaggccgtgctgagatgcctgctggcctacttcctggacaagagcgccgaggagatgccctacctgaagtgccccctgcacaccgtgctgaagctgacccccgtggcctacggctgcagagtggagagcatctacctgaacgtggagagcgtgtgcacccacagagagagaagcgaggacgccaagaagggccccaaccccctgatgagaagaaacagcgtgacccccctggccagccccgagcccaccaagaagcccagaatcaacagcttcgaggagcacgtggccagcaccagcgccgccctgcccagctgcctgccccccgaggtgcccacccagctgcccggccagcccctgctgggccaggcctgcctgagaaccgtgtgccacatcttcagcaagttcagcccctactag

SEQ ID NO: 71239 - DNA, 567 bp, Artificial Sequence
  Description of Artificial Sequence: Synthetic coding sequence
atgaacatccacgtgcagcccagaaccatctacctgtgcagacacggcgagaacgagcacaacctgcagggcagaatcggcggcgacagcggcctgagcagcagaggcaagaagttcgccagcgccctgagcaagttcgtggaggagcagaacctgaaggacctgagagtgtggaccagccagctgaagagcaccatccagaccgccgaggccctgagactgccctacgagcagtggaaggccctgaacgagatcgacgccagctaccaggacctggtgcagagactggagcccgtgatcatggagctggagagacaggagaacgtgctggtgatctgccaccaggccgtgctgagatgcctgctggcctacttcctggacaagagcgccgaggagatgccctacctgaagtgccccctgcacaccgtgctgaagctgacccccgtggcctacggctgcagagtggagagcatctacctgaacgtggagagcgtgtgcacccacagagagagaagcgagaacatgaagggcagcagaagcagcgccgacagcagcagaaagcactag

SEQ ID NO: 71240 - DNA, 1581 bp, Artificial Sequence; identical to SEQ ID NO: 71238
  Description of Artificial Sequence: Synthetic coding sequence

SEQ ID NO: 71241 - DNA, 1503 bp, Artificial Sequence
  Description of Artificial Sequence: Synthetic coding sequence
atgcccttcagaaaggcctgcggccccaagctgaccaacagccccaccgtgatcgtgatggtgggcctgcccgccagaggcaagacctacatcagcaagaagctgaccagatacctgaactggatcggcgtgcccaccaaggtgttcaacgtgggcgagtacagaagagaggccgtgaagcagtacagcagctacaacttcttcagacccgacaacgaggaggccatgaaggtgagaaagcagtgcgccctggccgccctgagagacgtgaagagctacctggccaaggagggcggccagatcgccgtgttcgacgccaccaacaccaccagagagagaagacacatgatcctgcacttcgccaaggagaacgacttcaaggccttcttcatcgagagcgtgtgcgacgaccccaccgtggtggccagcaacatcatggaggtgaagatcagcagccccgactacaaggactgcaacagcgccgaggccatggacgacttcatgaagagaatcagctgctacgaggccagctaccagcccctggaccccgacaagtgcgacagagacctgagcctgatcaaggtgatcgacgtgggcagaagattcctggtgaacagagtgcaggaccacatccagagcagaatcgtgtactacctgatgaacatccacgtgcagcccagaaccatctacctgtgcagacacggcgagaacgagcacaacctgcagggcagaatcggcggcgacagcggcctgagcagcagaggcaagaagttcgccagcgccctgagcaagttcgtggaggagcagaacctgaaggacctgagagtgtggaccagccagctgaagagcaccatccagaccgccgaggccctgagactgccctacgagcagtggaaggccctgaacgagatcgacgccggcgtgtgcgaggagctgacctacgaggagatcagagacacctaccccgaggagtacgccctgagagagcaggacaagtactactacagataccccaccggcgagagctaccaggacctggtgcagagactggagcccgtgatcatggagctggagagacaggagaacgtgctggtgatctgccaccaggccgtgctgagatgcctgctggcctacttcctggacaagagcgccgaggagatgccctacctgaagtgccccctgcacaccgtgctgaagctgacccccgtggcctacggctgcagagtggagagcatctacctgaacgtggagagcgtgtgcacccacagagagagaagcgaggacgccaagaagggccccaaccccctgatgagaagaaacagcgtgacccccctggccagccccgagcccaccaagaagcccagaatcaacagcttcgaggagcacgtggccagcaccagcgccgccctgcccagctgcctgccccccgaggtgcccacccagctgcccggccagaacatgaagggcagcagaagcagcgccgacagcagcagaaagcactag

SEQ ID NO: 71242 - DNA, 279 bp, Artificial Sequence
  Description of Artificial Sequence: Synthetic coding sequence
atctacctgaacgtggagagcgtgtgcacccacagagagagaagcgaggacgccaagaagggccccaaccccctgatgagaagaaacagcgtgacccccctggccagccccgagcccaccaagaagcccagaatcaacagcttcgaggagcacgtggccagcaccagcgccgccctgcccagctgcctgccccccgaggtgcccacccagctgcccggccagcccctgctgggccaggcctgcctgaactggaagggcgtgatgagaaacgccgcctag

SEQ ID NO: 71243 - DNA, 96 bp, Artificial Sequence
  Description of Artificial Sequence: Synthetic coding sequence
atctacctgaacgtggagagcgtgtgcacccacagagagagaagcgagaacatgaagggcagcagaagcagcgccgacagcagcagaaagcactag

SEQ ID NO: 71244 - DNA, 261 bp, Artificial Sequence
  Description of Artificial Sequence: Synthetic coding sequence
atgccctacctgaagtgccccctgcacaccgtgctgaagctgacccccgtggcctacggctgcagagtggagagcatctacctgaacgtggagagcgtgtgcacccacagagagagaagcgagggcctgagcctgttccccagactggagtgcggcggcgccgtgaccgcccactgcagcctgaacctgctgggcagcagcgacccccccgccagcgccagcagagtggccgagaccaccggctgcaaggagggcacctag

SEQ ID NO: 71245 - DNA, 432 bp, Artificial Sequence
  Description of Artificial Sequence: Synthetic coding sequence
tgagtggaggagcagaacctgaaggacctgagagtgtggaccagccagctgaagagcaccatccagaccgccgaggccctgagactgccctacgagcagtggaaggccctgaacgagatcgacgccagctaccaggacctggtgcagagactggagcccgtgatcatggagctggagagacaggagaacgtgctggtgatctgccaccaggccgtgctgagatgcctgctggcctacttcctggacaagagcgccgaggagatgccctacctgaagtgccccctgcacaccgtgctgaagctgacccccgtggcctacggctgcagagtggagagcatctacctgaacgtggagagcgtgtgcacccacagagagagaagcgagaacatgaagggcagcagaagcagcgccgacagcagcagaaagcactag

SEQ ID NO: 71246 - DNA, 555 bp, Artificial Sequence
  Description of Artificial Sequence: Synthetic coding sequence
atgcccttcagaaaggcctgcggccccaagctgaccaacagccccaccgtgatcgtgatggtgggcctgcccgccagaggcaagacctacatcagcaagaagctgaccagatacctgaactggatcggcgtgcccaccaaggtgttcaacgtgggcgagtacagaagagaggccgtgaagcagtacagcagctacaacttcttcagacccgacaacgaggaggccatgaaggtgagaaagcagtgcgccctggccgccctgagagacgtgaagagctacctggccaaggagggcggccagatcgccgtgttcgacgccaccaacaccaccagagagagaagacacatgatcctgcacttcgccaaggagaacgacttcaaggccttcttcatcgagagcgtgtgcgacgaccccaccgtggtggccagcaacatcatgcagaaggccttccagagagacctgagcgccacccccctgtggtgctgcagaaagctgaagagccccgccagaatcaccaagaccgccaccagacagaagccctggaccaccagctag

SEQ ID NO: 71247 - DNA, 1605 bp, Artificial Sequence
  Description of Artificial Sequence: Synthetic coding sequence
atgggcgagggcggccagaaggagggcgacagccagcaggccggcgccctgcccctgctgtgccagctggacaccttcagccccaaggccaccgtgttcggcgtgagcatcaaccccgcctgcggccccaagctgaccaacagccccaccgtgatcgtgatggtgggcctgcccgccagaggcaagacctacatcagcaagaagctgaccagatacctgaactggatcggcgtgcccaccaaggtgttcaacgtgggcgagtacagaagagaggccgtgaagcagtacagcagctacaacttcttcagacccgacaacgaggaggccatgaaggtgagaaagcagtgcgccctggccgccctgagagacgtgaagagctacctggccaaggagggcggccagatcgccgtgttcgacgccaccaacaccaccagagagagaagacacatgatcctgcacttcgccaaggagaacgacttcaaggccttcttcatcgagagcgtgtgcgacgaccccaccgtggtggccagcaacatcatggaggtgaagatcagcagccccgactacaaggactgcaacagcgccgaggccatggacgacttcatgaagagaatcagctgctacgaggccagctaccagcccctggaccccgacaagtgcgacagagacctgagcctgatcaaggtgatcgacgtgggcagaagattcctggtgaacagagtgcaggaccacatccagagcagaatcgtgtactacctgatgaacatccacgtgcagcccagaaccatctacctgtgcagacacggcgagaacgagcacaacctgcagggcagaatcggcggcgacagcggcctgagcagcagaggcaagaagttcgccagcgccctgagcaagttcgtggaggagcagaacctgaaggacctgagagtgtggaccagccagctgaagagcaccatccagaccgccgaggccctgagactgccctacgagcagtggaaggccctgaacgagatcgacgccggcgtgtgcgaggagctgacctacgaggagatcagagacacctaccccgaggagtacgccctgagagagcaggacaagtactactacagataccccaccggcgagagctaccaggacctggtgcagagactggagcccgtgatcatggagctggagagacaggagaacgtgctggtgatctgccaccaggccgtgctgagatgcctgctggcctacttcctggacaagagcgccgaggagatgccctacctgaagtgccccctgcacaccgtgctgaagctgacccccgtggcctacggctgcagagtggagagcatctacctgaacgtggagagcgtgtgcacccacagagagagaagcgaggacgccaagaagggccccaaccccctgatgagaagaaacagcgtgacccccctggccagccccgagcccaccaagaagcccagaatcaacagcttcgaggagcacgtggccagcaccagcgccgccctgcccagctgcctgccccccgaggtgcccacccagctgcccggccagaacatgaagggcagcagaagcagcgccgacagcagcagaaagcactag

SEQ ID NO: 71248 - DNA, 594 bp, Artificial Sequence
  Description of Artificial Sequence: Synthetic coding sequence
atggacccccccgccggcttcgtgagagccggcaaccccgccgtggccgccccccagagccccctgagccccgagggcgcccacttcagagccgcccaccaccccagaagcaccggcagcagatgccccggcagcctgcagcccagcagacccctggtggccaactggctgcagagcctgcccgagatgcccgtggacttcaccggctactggaagatgctggtgaacgagaacttcgaggagtacctgagagccctggacgtgaacgtggccctgagaaagatcgccaacctgctgaagcccgacaaggagatcgtgcaggacggcgaccacatgatcatcagaaccctgagcaccttcagaaactacatcatggacttccaggtgggcaaggagttcgaggaggacctgaccggcatcgacgacagaaagtgcatgaccaccgtgagctgggacggcgacaagctgcagtgcgtgcagaagggcgagaaggagggcagaggctggacccagtggatcgagggcgacgagctgcacctggagatgagagtggagggcgtggtgtgcaagcaggtgttcaagaaggtgcagtag

SEQ ID NO: 71249 - DNA, 528 bp, Artificial Sequence
  Description of Artificial Sequence: Synthetic coding sequence
atgaccaactgccccaccctgatcgtgatggtgggcctgcccgccagaggcaagacctacatcagcaagaagctgaccagatacctgaactggatcggcgtgcccaccagagagttcaacgtgggccagtacagaagagacgtggtgaagacctacaagagcttcgagttcttcctgcccgacaacgaggagggcctgaagatcagaaagcagtgcgccctggccgccctgagagacgtgagaagattcctgagcgaggagggcggccacgtggccgtgttcgacgccaccaacaccaccagagagagaagagccaccatcttcaacttcggcgagcagaacggctacaagaccttcttcgtggagagcatctgcgtggaccccgaggtgatcgccgccaacatcgtgcaggtgaagctgggcagccccgactacgtgaacagagacagcgacgaggccaccgaggacttcatgagaagaatcgagtgctacgagaacagctacgagagcctggacgaggacctgtag

SEQ ID NO: 71250 - DNA, 1377 bp, Artificial Sequence
  Description of Artificial Sequence: Synthetic coding sequence
atggacagaggcagcctgggcggcagcagcctgaccgacctgggccccggcagcagcagaagagtgtgcatgaccaactgccccaccctgatcgtgatggtgggcctgcccgccagaggcaagacctacatcagcaagaagctgaccagatacctgaactggatcggcgtgcccaccagagagttcaacgtgggccagtacagaagagacgtggtgaagacctacaagagcttcgagttcttcctgcccgacaacgaggagggcctgaagatcagaaagcagtgcgccctggccgccctgagagacgtgagaagattcctgagcgaggagggcggccacgtggccgtgttcgacgccaccaacaccaccagagagagaagagccaccatcttcaacttcggcgagcagaacggctacaagaccttcttcgtggagagcatctgcgtggaccccgaggtgatcgccgccaacatcgtgcaggtgaagctgggcagccccgactacgtgaacagagacagcgacgaggccaccgaggacttcatgagaagaatcgagtgctacgagaacagctacgagagcctggacgaggacctggacagagacctgagctacatcaagatcatggacgtgggccagagctacgtggtgaacagagtggccgaccacatccagagcagaatcgtgtactacctgatgaacatccacgtgacccccagaagcatctacctgtgcagacacggcgagagcgagctgaacctgaagggcagaatcggcggcgaccccggcctgagccccagaggcagagagttcgccaagagcctggcccagttcatcagcgaccagaacatcaaggacctgaaggtgtggaccagccagatgaagagaaccatccagaccgccgaggccctgggcgtgccctacgagcagtggaaggtgctgaacgagatcgacgccggcgtgtgcgaggagatgacctacgaggagatccaggacaactaccccctggagttcgccctgagagaccaggacaagtacagatacagataccccaagggcgagagctacgaggacctggtgcagagactggagcccgtgatcatggagctggagagacaggagaacgtgctggtgatctgccaccaggccgtgatgagatgcctgctggcctacttcctggacaaggccgccgagcagctgccctacctgaagtgccccctgcacaccgtgctgaagctgacccccgtggcctacggctgcaaggtggagagcatcttcctgaacgtggccgccgtgaacacccacagagacagaccccagaacgtggacatcagcagaccccccgaggaggccctggtgaccgtgcccgcccaccagtag

SEQ ID NO: 71251 - DNA, 1308 bp, Artificial Sequence
  Description of Artificial Sequence: Synthetic coding sequence
atgaccaactgccccaccctgatcgtgatggtgggcctgcccgccagaggcaagacctacatcagcaagaagctgaccagatacctgaactggatcggcgtgcccaccagagagttcaacgtgggccagtacagaagagacgtggtgaagacctacaagagcttcgagttcttcctgcccgacaacgaggagggcctgaagatcagaaagcagtgcgccctggccgccctgagagacgtgagaagattcctgagcgaggagggcggccacgtggccgtgttcgacgccaccaacaccaccagagagagaagagccaccatcttcaacttcggcgagcagaacggctacaagaccttcttcgtggagagcatctgcgtggaccccgaggtgatcgccgccaacatcgtgcaggtgaagctgggcagccccgactacgtgaacagagacagcgacgaggccaccgaggacttcatgagaagaatcgagtgctacgagaacagctacgagagcctggacgaggacctggacagagacctgagctacatcaagatcatggacgtgggccagagctacgtggtgaacagagtggccgaccacatccagagcagaatcgtgtactacctgatgaacatccacgtgacccccagaagcatctacctgtgcagacacggcgagagcgagctgaacctgaagggcagaatcggcggcgaccccggcctgagccccagaggcagagagttcgccaagagcctggcccagttcatcagcgaccagaacatcaaggacctgaaggtgtggaccagccagatgaagagaaccatccagaccgccgaggccctgggcgtgccctacgagcagtggaaggtgctgaacgagatcgacgccggcgtgtgcgaggagatgacctacgaggagatccaggacaactaccccctggagttcgccctgagagaccaggacaagtacagatacagataccccaagggcgagagctacgaggacctggtgcagagactggagcccgtgatcatggagctggagagacaggagaacgtgctggtgatctgccaccaggccgtgatgagatgcctgctggcctacttcctggacaaggccgccgagcagctgccctacctgaagtgccccctgcacaccgtgctgaagctgacccccgtggcctacggctgcaaggtggagagcatcttcctgaacgtggccgccgtgaacacccacagagacagaccccagaacgtggacatcagcagaccccccgaggaggccctggtgaccgtgcccgcccaccagtag

SEQ ID NO: 71252 - DNA, 429 bp, Artificial Sequence
  Description of Artificial Sequence: Synthetic coding sequence
atggccagccccagagagctgacccagaaccccctgaagaagatctggatgccctacagcaacggcagacccgccctgcacgcctgccagagaggcgtgtgcatgaccaactgccccaccctgatcgtgatggtgggcctgcccgccagaggcaagacctacatcagcaagaagctgaccagatacctgaactggatcggcgtgcccaccagagagttcaacgtgggccagtacagaagagacgtggtgaagacctacaagagcttcgagttcttcctgcccgacaacgaggagggcctgaagatcagaaagttcctgatgccccagaccccccccgagaacggcgagagacccagcctgatcctggagaacagaatggccaccagacccttcctgagcagccccagcgtgtggatcctgagaagctag

SEQ ID NO: 71253 - DNA, 777 bp, Artificial Sequence
  Description of Artificial Sequence: Synthetic coding sequence
atggccgcccccgcccccggcctgatcagcgtgttcagcagcagccaggagctgggcgccgccctggcccagctggtggcccagagagccgcctgctgcctggccggcgccagagccagattcgccctgggcctgagcggcggcagcctggtgagcatgctggccagagagctgcccgccgccgtggcccccgccggccccgccagcctggccagatggaccctgggcttctgcgacgagagactggtgcccttcgaccacgccgagagcacctacggcctgtacagaacccacctgctgagcagactgcccatccccgagagccaggtgatcaccatcaaccccgagctgcccgtggaggaggccgccgaggactacgccaagaagctgagacaggccttccagggcgacagcatccccgtgttcgacctgctgatcctgggcgtgggccccgacggccacacctgcagcctgttccccgaccaccccctgctgcaggagagagagaagatcgtggcccccatcagcgacagccccaagccccccccccagagagtgaccctgaccctgcccgtgctgaacgccgccagaaccgtgatcttcgtggccaccggcgagggcaaggccgccgtgctgaagagaatcctggaggaccaggaggagaaccccctgcccgccgccctggtgcagccccacaccggcaagctgtgctggttcctggacgaggccgccgccagactgctgaccgtgcccttcgagaagcacagcaccctgtag

SEQ ID NO: 71254 - DNA, 1428 bp, Artificial Sequence
  Description of Artificial Sequence: Synthetic coding sequence
atggccgccaagagccagcccaacatccccaaggccaagagcctggacggcgtgaccaacgacagaaccgccagccagggccagtggggcagagcctgggaggtggactggttcagcctggccagcgtgatcttcctgctgctgttcgcccccttcatcgtgtactacttcatcatggcctgcgaccagtacagctgcgccctgaccggccccgtggtggacatcgtgaccggccacgccagactgagcgacatctgggccaagaccccccccatcaccagaaaggccgcccagctgtacaccctgtgggtgaccttccaggtgctgctgtacaccagcctgcccgacttctgccacaagttcctgcccggctacgtgggcggcatccaggagggcgccgtgacccccgccggcgtggtgaacaagtaccagatcaacggcctgcaggcctggctgctgacccacctgctgtggttcgccaacgcccacctgctgagctggttcagccccaccatcatcttcgacaactggatccccctgctgtggtgcgccaacatcctgggctacgccgtgagcaccttcgccatggtgaagggctacttcttccccaccagcgccagagactgcaagttcaccggcaacttcttctacaactacatgatgggcatcgagttcaaccccagaatcggcaagtggttcgacttcaagctgttcttcaacggcagacccggcatcgtggcctggaccctgatcaacctgagcttcgccgccaagcagagagagctgcacagccacgtgaccaacgccatggtgctggtgaacgtgctgcaggccatctacgtgatcgacttcttctggaacgagacctggtacctgaagaccatcgacatctgccacgaccacttcggctggtacctgggctggggcgactgcgtgtggctgccctacctgtacaccctgcagggcctgtacctggtgtaccaccccgtgcagctgagcaccccccacgccgtgggcgtgctgctgctgggcctggtgggctactacatcttcagagtggccaaccaccagaaggacctgttcagaagaaccgacggcagatgcctgatctggggcagaaagcccaaggtgatcgagtgcagctacaccagcgccgacggccagagacaccacagcaagctgctggtgagcggcttctggggcgtggccagacacttcaactacgtgggcgacctgatgggcagcctggcctactgcctggcctgcggcggcggccacctgctgccctacttctacatcatctacatggccatcctgctgacccacagatgcctgagagacgagcacagatgcgccagcaagtacggcagagactgggagagatacaccgccgccgtgccctacagactgctgcccggcatcttctag

SEQ ID NO: 71255 - DNA, 1428 bp, Artificial Sequence; identical to SEQ ID NO: 71254
  Description of Artificial Sequence: Synthetic coding sequence

SEQ ID NO: 71256 - DNA, 327 bp, Artificial Sequence
  Description of Artificial Sequence: Synthetic coding sequence
atggccgccaagagccagcccaacatccccaaggccaagagcctggacggcgtgaccaacgacagaaccgccagccagggccagtggggcagagcctgggaggtggactggttcagcctggccagcgtgatcttcctgctgctgttcgcccccttcatcgtgtactacttcatcatggcctgcgaccagtacagctgcgccctgaccggccccgtggtggacatcgtgaccggccacgccagactgagcgacatctgggccaagaccccccccatcaccagaaaggccgcccagctgtacaccctgtgggtgaccttccaggtgtag

SEQ ID NO: 71257 - DNA, 495 bp, Artificial Sequence
  Description of Artificial Sequence: Synthetic coding sequence
atggccgccaagagccagcccaacatccccaaggccaagagcctggacggcgtgaccaacgacagaaccgccagccagggccagtggggcagagcctgggaggtggactggttcagcctggccagcgtgatcttcctgctgctgttcgcccccttcatcgtgtactacttcatcatggcctgcgaccagtacagctgcgccctgaccggccccgtggtggacatcgtgaccggccacgccagactgagcgacatctgggccaagaccccccccatcaccagaaaggccgcccagctgtacaccctgtgggtgaccttccaggtgctgctgtacaccagcctgcccgacttctgccacaagttcctgcccggctacgtgggcggcatccaggagggcgccgtgacccccgccggcgtggtgaacaagtaccagatcaacggcctgcaggcctggctgctgacccacctgctgtggttcgccaacgcccacctgtag

SEQ ID NO: 71258 - DNA, 276 bp, Artificial Sequence
  Description of Artificial Sequence: Synthetic coding sequence
atggccgccaagagccagcccaacatccccaaggccaagagcctggacggcgtgaccaacgacagaaccgccagccagggccagtggggcagagcctgggaggtggactggttcagcctggccagcgtgatcttcctgctgctgttcgcccccttcatcgtgtactacttcatcatggcctgcgaccagtacagctgcgccctgaccggccccgtggtggacatcgtgaccggccacgccagactgagcgacatctgggccaagacccccccctag

SEQ ID NO: 71259 - DNA, 318 bp, Artificial Sequence
  Description of Artificial Sequence: Synthetic coding sequence
atggccgccaagagccagcccaacatccccaaggccaagagcctggacggcgtgaccaacgacagaaccgccagccagggccagtggggcagagcctgggaggtggactggttcagcctggccagcgtgatcttcctgctgctgttcgcccccttcatcgtgtactacttcatcatggcctgcgaccagtacagctgcgccctgaccggccccgtggtggacatcgtgaccggccacgccagactgagcgacatctgggccaagaccccccccatcaccagaaaggccgcccagctgtacaccctgtgggtgacctag

SEQ ID NO: 71260 - DNA, 846 bp, Artificial Sequence
  Description of Artificial Sequence: Synthetic coding sequence
atggacagctacagcacctacctggccaccgtgaaggtgagcggcagctggctggaggagcaggacgaggacatctacgaggtggagagcagagtgcccctgccccaccccttccccctgtgcgagcacctggacgagaacaacagcgtgatcgtgaacaccagcatcttccacttcatccacaagagaaacggccacatcctgaagctgatcagcaagatcagcctgcccacccccccctacagcctggagcacgccaaggtgacccagaccgagctgatgagagagagcttcagacagaagcaggaggccaccgagagcctgaagtgccaggaggagctgagagagagactgcacgaggagagcagagccagagagcagctggccgtggagctgagcaaggccgagggcgtgatcgacggctacgccgacgagaagaccctgttcgagagacagatccaggagaagaccgacatcatcgacagactggagcaggagctgctgtgcgccagcaacagactgcaggagctggaggccgagcagcagcagatccaggaggagagagagctgctgagcagacagaaggaggccatgaaggccgaggccggccccgtggagcagcagctgctgcaggagaccgagaagctgatgaaggagaagctggaggtgcagtgccaggccgagaaggtgagagacgacctgcagaagcaggtgaaggccctggagatcgacgtggaggagcaggtgagcagattcatcgagctggagcaggagaagaacaccgagctgatggacctgagacagcagaaccaggccctggagaagcagctggagaagatgagatag

SEQ ID NO: 71261 - DNA, 11724 bp, Artificial Sequence
  Description of Artificial Sequence: Synthetic coding sequence
atggaggacgaggagagacagaagaagctggaggccggcaaggccaagctggcccagttcagacagagaaaggcccagagcgacggccagagccccagcaagaagcagaagaagaagagaaagaccagcagcagcaagcacgacgtgagcgcccaccacgacctgaacatcgaccagagccagtgcaacgagatgtacatcaacagcagccagagagtggagagcaccgtgatccccgagagcaccatcatgagaaccctgcacagcggcgagatcaccagccacgagcagggcttcagcgtggagctggagagcgagatcagcaccaccgccgacgactgcagcagcgaggtgaacggctgcagcttcgtgatgagaaccggcaagcccaccaacctgctgagagaggaggagttcggcgtggacgacagctacagcgagcagggcgcccaggacagccccacccacctggagatgatggagagcgagctggccggcaagcagcacgagatcgaggagctgaacagagagctggaggagatgagagtgacctacggcaccgagggcctgcagcagctgcaggagttcgaggccgccatcaagcagagagacggcatcatcacccagctgaccgccaacctgcagcaggccagaagagagaaggacgagaccatgagagagttcctggagctgaccgagcagagccagaagctgcagatccagttccagcagctgcaggccagcgagaccctgagaaacagcacccacagcagcaccgccgccgacctgctgcaggccaagcagcagatcctgacccaccagcagcagctggaggagcaggaccacctgctggaggactaccagaagaagaaggaggacttcaccatgcagatcagcttcctgcaggagaagatcaaggtgtacgagatggagcaggacaagaaggtggagaacagcaacaaggaggagatccaggagaaggagaccatcatcgaggagctgaacaccaagatcatcgaggaggagaagaagaccctggagctgaaggacaagctgaccaccgccgacaagctgctgggcgagctgcaggagcagatcgtgcagaagaaccaggagatcaagaacatgaagctggagctgaccaacagcaagcagaaggagagacagagcagcgaggagatcaagcagctgatgggcaccgtggaggagctgcagaagagaaaccacaaggacagccagttcgagaccgacatcgtgcagagaatggagcaggagacccagagaaagctggagcagctgagagccgagctggacgagatgtacggccagcagatcgtgcagatgaagcaggagctgatcagacagcacatggcccagatggaggagatgaagaccagacacaagggcgagatggagaacgccctgagaagctacagcaacatcaccgtgaacgaggaccagatcaagctgatgaacgtggccatcaacgagctgaacatcaagctgcaggacaccaacagccagaaggagaagctgaaggaggagctgggcctgatcctggaggagaagtgcgccctgcagagacagctggaggacctggtggaggagctgagcttcagcagagagcagatccagagagccagacagaccatcgccgagcaggagagcaagctgaacgaggcccacaagagcctgagcaccgtggaggacctgaaggccgagatcgtgagcgccagcgagagcagaaaggagctggagctgaagcacgaggccgaggtgaccaactacaagatcaagctggagatgctggagaaggagaagaacgccgtgctggacagaatggccgagagccaggaggccgagctggagagactgagaacccagctgctgttcagccacgaggaggagctgagcaagctgaaggaggacctggagatcgagcacagaatcaacatcgagaagctgaaggacaacctgggcatccactacaagcagcagatcgacggcctgcagaacgagatgagccagaagatcgagaccatgcagttcgagaaggacaacctgatcaccaagcagaaccagctgatcctggagatcagcaagctgaaggacctgcagcagagcctggtgaacagcaagagcgaggagatgaccctgcagatcaacgagctgcagaaggagatcgagatcctgagacaggaggagaaggagaagggcaccctggagcaggaggtgcaggagctgcagctgaagaccgagctgctggagaagcagatgaaggagaaggagaacgacctgcaggagaagttcgcccagctggaggccgagaacagcatcctgaaggacgagaagaagaccctggaggacatgctgaagatccacacccccgtgagccaggaggagagactgatcttcctggacagcatcaagagcaagagcaaggacagcgtgtgggagaaggagatcgagatcctgatcgaggagaacgaggacctgaagcagcagtgcatccagctgaacgaggagatcgagaagcagagaaacaccttcagcttcgccgagaagaacttcgaggtgaactaccaggagctgcaggaggagtacgcctgcctgctgaaggtgaaggacgacctggaggacagcaagaacaagcaggagctggagtacaagagcaagctgaaggccctgaacgaggagctgcacctgcagagaatcaaccccaccaccgtgaagatgaagagcagcgtgttcgacgaggacaagaccttcgtggccgagaccctggagatgggcgaggtggtggagaaggacaccaccgagctgatggagaagctggaggtgaccaagagagagaagctggagctgagccagagactgagcgacctgagcgagcagctgaagcagaagcacggcgagatcagcttcctgaacgaggaggtgaagagcctgaagcaggagaaggagcaggtgagcctgagatgcagagagctggagatcatcatcaaccacaacagagccgagaacgtgcagagctgcgacacccaggtgagcagcctgctggacggcgtggtgaccatgaccagcagaggcgccgagggcagcgtgagcaaggtgaacaagagcttcggcgaggagagcaagatcatggtggaggacaaggtgagcttcgagaacatgaccgtgggcgaggagagcaagcaggagcagctgatcctggaccacctgcccagcgtgaccaaggagagcagcctgagagccacccagcccagcgagaacgacaagctgcagaaggagctgaacgtgctgaagagcgagcagaacgacctgagactgcagatggaggcccagagaatctgcctgagcctggtgtacagcacccacgtggaccaggtgagagagtacatggagaacgagaaggacaaggccctgtgcagcctgaaggaggagctgatcttcgcccaggaggagaagatcaaggagctgcagaagatccaccagctggagctgcagaccatgaagacccaggagaccggcgacgagggcaagcccctgcacctgctgatcggcaagctgcagaaggccgtgagcgaggagtgcagctacttcctgcagaccctgtgcagcgtgctgggcgagtactacacccccgccctgaagtgcgaggtgaacgccgaggacaaggagaacagcggcgactacatcagcgagaacgaggaccccgagctgcaggactacagatacgaggtgcaggacttccaggagaacatgcacaccctgctgaacaaggtgaccgaggagtacaacaagctgctggtgctgcagaccagactgagcaagatctggggccagcagaccgacggcatgaagctggagttcggcgaggagaacctgcccaaggaggagaccgagttcctgagcatccacagccagatgaccaacctggaggacatcgacgtgaaccacaagagcaagctgagcagcctgcaggacctggagaagaccaagctggaggagcaggtgcaggagctggagagcctgatcagcagcctgcagcagcagctgaaggagaccgagcagaactacgaggccgagatccactgcctgcagaagagactgcaggccgtgagcgagagcaccgtgccccccagcctgcccgtggacagcgtggtgatcaccgagagcgacgcccagagaaccatgtaccccggcagctgcgtgaagaagaacatcgacggcaccatcgagttcagcggcgagttcggcgtgaaggaggagaccaacatcgtgaagctgctggagaagcagtaccaggagcagctggaggaggaggtggccaaggtgatcgtgagcatgagcatcgccttcgcccagcagaccgagctgagcagaatcagcggcggcaaggagaacaccgccagcagcaagcaggcccacgccgtgtgccagcaggagcagcactacttcaacgagatgaagctgagccaggaccagatcggcttccagaccttcgagaccgtggacgtgaagttcaaggaggagttcaagcccctgagcaaggagctgggcgagcacggcaaggagatcctgctgagcaacagcgacccccacgacatccccgagagcaaggactgcgtgctgaccatcagcgaggagatgttcagcaaggacaagaccttcatcgtgagacagagcatccacgacgagatcagcgtgagcagcatggacgccagcagacagctgatgctgaacgaggagcagctggaggacatgagacaggagctggtgagacagtaccaggagcaccagcaggccaccgagctgctgagacaggcccacatgagacagatggagagacagagagaggaccaggagcagctgcaggaggagatcaagagactgaacagacagctggcccagagaagcagcatcgacaacgagaacctggtgagcgagagagagagagtgctgctggaggagctggaggccctgaagcagctgagcctggccggcagagagaagctgtgctgcgagctgagaaacagcagcacccagacccagaacggcaacgagaaccagggcgaggtggaggagcagaccttcaaggagaaggagctggacagaaagcccgaggacgtgccccccgagatcctgagcaacgagagatacgccctgcagaaggccaacaacagactgctgaagatcctgctggaggtggtgaagaccaccgccgccgtggaggagaccatcggcagacacgtgctgggcatcctggacagaagcagcaagagccagagcagcgccagcctgatctggagaagcgaggccgaggccagcgtgaagagctgcgtgcacgaggagcacaccagagtgaccgacgagagcatccccagctacagcggcagcgacatgcccagaaacgacatcaacatgtggagcaaggtgaccgaggagggcaccgagctgagccagagactggtgagaagcggcttcgccggcaccgagatcgaccccgagaacgaggagctgatgctgaacatcagcagcagactgcaggccgccgtggagaagctgctggaggccatcagcgagaccagcagccagctggagcacgccaaggtgacccagaccgagctgatgagagagagcttcagacagaagcaggaggccaccgagagcctgaagtgccaggaggagctgagagagagactgcacgaggagagcagagccagagagcagctggccgtggagctgagcaaggccgagggcgtgatcgacggctacgccgacgagaagaccctgttcgagagacagatccaggagaagaccgacatcatcgacagactggagcaggagctgctgtgcgccagcaacagactgcaggagctggaggccgagcagcagcagatccaggaggagagagagctgctgagcagacagaaggaggccatgaaggccgaggccggccccgtggagcagcagctgctgcaggagaccgagaagctgatgaaggagaagctggaggtgcagtgccaggccgagaaggtgagagacgacctgcagaagcaggtgaaggccctggagatcgacgtggaggagcaggtgagcagattcatcgagctggagcaggagaagaacaccgagctgatggacctgagacagcagaaccaggccctggagaagcagctggagaagatgagaaagttcctggacgagcaggccatcgacagagagcacgagagagacgtgttccagcaggagatccagaagctggagcagcagctgaaggtggtgcccagattccagcccatcagcgagcaccagaccagagaggtggagcagctggccaaccacctgaaggagaagaccgacaagtgcagcgagctgctgctgagcaaggagcagctgcagagagacatccaggagagaaacgaggagatcgagaagctggagttcagagtgagagagctggagcaggccctgctggtgagcgccgacaccttccagaaggtggaggacagaaagcacttcggcgccgtggaggccaagcccgagctgagcctggaggtgcagctgcaggccgagagagacgccatcgacagaaaggagaaggagatcaccaacctggaggagcagctggagcagttcagagaggagctggagaacaagaacgaggaggtgcagcagctgcacatgcagctggagatccagaagaaggagagcaccaccagactgcaggagctggagcaggagaacaagctgttcaaggacgacatggagaagctgggcctggccatcaaggagagcgacgccatgagcacccaggaccagcacgtgctgttcggcaagttcgcccagatcatccaggagaaggaggtggagatcgaccagctgaacgagcaggtgaccaagctgcagcagcagctgaagatcaccaccgacaacaaggtgatcgaggagaagaacgagctgatcagagacctggagacccagatcgagtgcctgatgagcgaccaggagtgcgtgaagagaaacagagaggaggagatcgagcagctgaacgaggtgatcgagaagctgcagcaggagctggccaacatcggccagaagaccagcatgaacgcccacagcctgagcgaggaggccgacagcctgaagcaccagctggacgtggtgatcgccgagaagctggccctggagcagcaggtggagaccgccaacgaggagatgaccttcatgaagaacgtgctgaaggagaccaacttcaagatgaaccagctgacccaggagctgttcagcctgaagagagagagagagagcgtggagaagatccagagcatccccgagaacagcgtgaacgtggccatcgaccacctgagcaaggacaagcccgagctggaggtggtgctgaccgaggacgccctgaagagcctggagaaccagacctacttcaagagcttcgaggagaacggcaagggcagcatcatcaacctggagaccagactgctgcagctggagagcaccgtgagcgccaaggacctggagctgacccagtgctacaagcagatcaaggacatgcaggagcagggccagttcgagaccgagatgctgcagaagaagatcgtgaacctgcagaagatcgtggaggagaaggtggccgccgccctggtgagccagatccagctggaggccgtgcaggagtacgccaagttctgccaggacaaccagaccatcagcagcgagcccgagagaaccaacatccagaacctgaaccagctgagagaggacgagctgggcagcgacatcagcgccctgaccctgagaatcagcgagctggagagccaggtggtggagatgcacaccagcctgatcctggagaaggagcaggtggagatcgccgagaagaacgtgctggagaaggagaagaagctgctggagctgcagaagctgctggagggcaacgagaagaagcagagagagaaggagaagaagagaagcccccaggacgtggaggtgctgaagaccaccaccgagctgttccacagcaacgaggagagcggcttcttcaacgagctggaggccctgagagccgagagcgtggccaccaaggccgagctggccagctacaaggagaaggccgagaagctgcaggaggagctgctggtgaaggagaccaacatgaccagcctgcagaaggacctgagccaggtgagagaccacctggccgaggccaaggagaagctgagcatcctggagaaggaggacgagaccgaggtgcaggagagcaagaaggcctgcatgttcgagcccctgcccatcaagctgagcaagagcatcgccagccagaccgacggcaccctgaagatcagcagcagcaaccagaccccccagatcctggtgaagaacgccggcatccagatcaacctgcagagcgagtgcagcagcgaggaggtgaccgagatcatcagccagttcaccgagaagatcgagaagatgcaggagctgcacgccgccgagatcctggacatggagagcagacacatcagcgagaccgagaccctgaagagagagcactacgtggccgtgcagctgctgaaggaggagtgcggcaccctgaaggccgtgatccagtgcctgagaagcaaggagggcagcagcatccccgagctggcccacagcgacgcctaccagaccagagagatctgcagcagcgacagcggcagcgactggggccagggcatctacctgacccacagccagggcttcgacatcgccagcgagggcagaggcgaggagagcgagagcgccaccgacagcttccccaagaagatcaagggcctgctgagagccgtgcacaacgagggcatgcaggtgctgagcctgaccgagagcccctacagcgacggcgaggaccacagcatccagcaggtgagcgagccctggctggaggagagaaaggcctacatcaacaccatcagcagcctgaaggacctgatcaccaagatgcagctgcagagagaggccgaggtgtacgacagcagccagagccacgagagcttcagcgactggagaggcgagctgctgctggccctgcagcaggtgttcctggaggagagaagcgtgctgctggccgccttcagaaccgagctgaccgccctgggcaccaccgacgccgtgggcctgctgaactgcctggagcagagaatccaggagcagggcgtggagtaccaggccgccatggagtgcctgcagaaggccgacagaagaagcctgctgagcgagatccaggccctgcacgcccagatgaacggcagaaagatcaccctgaagagagagcaggagagcgagaagcccagccaggagctgctggagtacaacatccagcagaagcagagccagatgctggagatgcaggtggagctgagcagcatgaaggacagagccaccgagctgcaggagcagctgagcagcgagaagatggtggtggccgagctgaagagcgagctggcccagaccaagctggagctggagaccaccctgaaggcccagcacaagcacctgaaggagctggaggccttcagactggaggtgaaggacaagaccgacgaggtgcacctgctgaacgacaccctggccagcgagcagaagaagagcagagagctgcagtgggccctggagaaggagaaggccaagctgggcagaagcgaggagagagacaaggaggagctggaggacctgaagttcagcctggagagccagaagcagagaaacctgcagctgaacctgctgctggagcagcagaagcagctgctgaacgagagccagcagaagatcgagagccagagaatgctgtacgacgcccagctgagcgaggagcagggcagaaacctggagctgcaggtgctgctggagagcgagaaggtgagaatcagagagatgagcagcaccctggacagagagagagagctgcacgcccagctgcagagcagcgacggcaccggccagagcagaccccccctgcccagcgaggacctgctgaaggagctgcagaagcagctggaggagaagcacagcagaatcgtggagctgctgaacgagaccgagaagtacaagctggacagcctgcagaccagacagcagatggagaaggacagacaggtgcacagaaagaccctgcagaccgagcaggaggccaacaccgagggccagaagaagatgcacgagctgcagagcaaggtggaggacctgcagagacagctggaggagaagagacagcaggtgtacaagctggacctggagggccagagactgcagggcatcatgcaggagttccagaagcaggagctggagagagaggagaagagagagagcagaagaatcctgtaccagaacctgaacgagcccaccacctggagcctgaccagcgacagaaccagaaactgggtgctgcagcagaagatcgagggcgagaccaaggagagcaactacgccaagctgatcgagatgaacggcggcggcaccggctgcaaccacgagctggagatgatcagacagaagctgcagtgcgtggccagcaagctgcaggtgctgccccagaaggccagcgagagactgcagttcgagaccgccgacgacgaggacttcatctgggtgcaggagaacatcgacgagatcatcctgcagctgcagaagctgaccggccagcagggcgaggagcccagcctggtgagccccagcaccagctgcggcagcctgaccgagagactgctgagacagaacgccgagctgaccggccacatcagccagctgaccgaggagaagaacgacctgagaaacatggtgatgaagctggaggagcagatcagatggtacagacagaccggcgccggcagagacaacagcagcagattcagcctgaacggcggcgccaacatcgaggccatcatcgccagcgagaaggaggtgtggaacagagagaagctgaccctgcagaagagcctgaagagagccgaggccgaggtgtacaagctgaaggccgagctgagaaacgacagcctgctgcagaccctgagccccgacagcgagcacgtgaccctgaagagaatctacggcaagtacctgagagccgagagcttcagaaaggccctgatctaccagaagaagtacctgctgctgctgctgggcggcttccaggagtgcgaggacgccaccctggccctgctggccagaatgggcggccagcccgccttcaccgacctggaggtgatcaccaacagacccaagggcttcaccagattcagaagcgccgtgagagtgagcatcgccatcagcagaatgaagttcctggtgagaagatggcacagagtgaccggcagcgtgagcatcaacatcaacagagacggcttcggcctgaaccagggcgccgagaagaccgacagcttctaccacagcagcggcggcctggagctgtacggcgagcccagacacaccacctacagaagcagaagcgacctggactacatcagaagccccctgcccttccagaacagataccccggcacccccgccgacttcaaccccggcagcctggcctgcagccagctgcagaactacgaccccgacagagccctgaccgactacatcaccagactggaggccctgcagagaagactgggcaccatccagagcggcagcaccacccagttccacgccggcatgagaagatag

SEQ ID NO: 71262 - DNA, 11574 bp, Artificial Sequence
  Description of Artificial Sequence: Synthetic coding sequence
atggaggacgaggagagacagaagaagctggaggccggcaaggccaagatcgaggagctgagcctggccttcctggtgagacagctggcccagttcagacagagaaaggcccagagcgacggccagagccccagcaagaagcagaagaagaagagaaagaccagcagcagcaagcacgacgtgagcgcccaccacgacctgaacatcgaccagagccagtgcaacgagatgtacatcaacagcagccagagagtggagagcaccgtgatccccgagagcaccatcatgagaaccctgcacagcggcgagatcaccagccacgagcagggcttcagcgtggagctggagagcgagatcagcaccaccgccgacgactgcagcagcgaggtgaacggctgcagcttcgtgatgagaaccggcaagcccaccaacctgctgagagaggaggagttcggcgtggacgacagctacagcgagcagggcgcccaggacagccccacccacctggagatgatggagagcgagctggccggcaagcagcacgagatcgaggagctgaacagagagctggaggagatgagagtgacctacggcaccgagggcctgcagcagctgcaggagttcgaggccgccatcaagcagagagacggcatcatcacccagctgaccgccaacctgcagcaggccagaagagagaaggacgagaccatgagagagttcctggagctgaccgagcagagccagaagctgcagatccagttccagcagctgcaggccagcgagaccctgagaaacagcacccacagcagcaccgccgccgacctgctgcaggccaagcagcagatcctgacccaccagcagcagctggaggagcaggaccacctgctggaggactaccagaagaagaaggaggacttcaccatgcagatcagcttcctgcaggagaagatcaaggtgtacgagatggagcaggacaagaaggtggagaacagcaacaaggaggagatccaggagaaggagaccatcatcgaggagctgaacaccaagatcatcgaggaggagaagaagaccctggagctgaaggacaagctgaccaccgccgacaagctgctgggcgagctgcaggagcagatcgtgcagaagaaccaggagatcaagaacatgaagctggagctgaccaacagcaagcagaaggagagacagagcagcgaggagatcaagcagctgatgggcaccgtggaggagctgcagaagagaaaccacaaggacagccagttcgagaccgacatcgtgcagagaatggagcaggagacccagagaaagctggagcagctgagagccgagctggacgagatgtacggccagcagatcgtgcagatgaagcaggagctgatcagacagcacatggcccagatggaggagatgaagaccagacacaagggcgagatggagaacgccctgagaagctacagcaacatcaccgtgaacgaggaccagatcaagctgatgaacgtggccatcaacgagctgaacatcaagctgcaggacaccaacagccagaaggagaagctgaaggaggagctgggcctgatcctggaggagaagtgcgccctgcagagacagctggaggacctggtggaggagctgagcttcagcagagagcagatccagagagccagacagaccatcgccgagcaggagagcaagctgaacgaggcccacaagagcctgagcaccgtggaggacctgaaggccgagatcgtgagcgccagcgagagcagaaaggagctggagctgaagcacgaggccgaggtgaccaactacaagatcaagctggagatgctggagaaggagaagaacgccgtgctggacagaatggccgagagccaggaggccgagctggagagactgagaacccagctgctgttcagccacgaggaggagctgagcaagctgaaggaggacctggagatcgagcacagaatcaacatcgagaagctgaaggacaacctgggcatccactacaagcagcagatcgacggcctgcagaacgagatgagccagaagatcgagaccatgcagttcgagaaggacaacctgatcaccaagcagaaccagctgatcctggagatcagcaagctgaaggacctgcagcagagcctggtgaacagcaagagcgaggagatgaccctgcagatcaacgagctgcagaaggagatcgagatcctgagacaggaggagaaggagaagggcaccctggagcaggaggtgcaggagctgcagctgaagaccgagctgctggagaagcagatgaaggagaaggagaacgacctgcaggagaagttcgcccagctggaggccgagaacagcatcctgaaggacgagaagaagaccctggaggacatgctgaagatccacacccccgtgagccaggaggagagactgatcttcctggacagcatcaagagcaagagcaaggacagcgtgtgggagaaggagatcgagatcctgatcgaggagaacgaggacctgaagcagcagtgcatccagctgaacgaggagatcgagaagcagagaaacaccttcagcttcgccgagaagaacttcgaggtgaactaccaggagctgcaggaggagtacgcctgcctgctgaaggtgaaggacgacctggaggacagcaagaacaagcaggagctggagtacaagagcaagctgaaggccctgaacgaggagctgcacctgcagagaatcaaccccaccaccgtgaagatgaagagcagcgtgttcgacgaggacaagaccttcgtggccgagaccctggagatgggcgaggtggtggagaaggacaccaccgagctgatggagaagctggaggtgaccaagagagagaagctggagctgagccagagactgagcgacctgagcgagcagctgaagcagaagcacggcgagatcagcttcctgaacgaggaggtgaagagcctgaagcaggagaaggagcaggtgagcctgagatgcagagagctggagatcatcatcaaccacaacagagccgagaacgtgcagagctgcgacacccaggtgagcagcctgctggacggcgtggtgaccatgaccagcagaggcgccgagggcagcgtgagcaaggtgaacaagagcttcggcgaggagagcaagatcatggtggaggacaaggtgagcttcgagaacatgaccgtgggcgaggagagcaagcaggagcagctgatcctggaccacctgcccagcgtgaccaaggagagcagcctgagagccacccagcccagcgagaacgacaagctgcagaaggagctgaacgtgctgaagagcgagcagaacgacctgagactgcagatggaggcccagagaatctgcctgagcctggtgtacagcacccacgtggaccaggtgagagagtacatggagaacgagaaggacaaggccctgtgcagcctgaaggaggagctgatcttcgcccaggaggagaagatcaaggagctgcagaagatccaccagctggagctgcagaccatgaagacccaggagaccggcgacgagggcaagcccctgcacctgctgatcggcaagctgcagaaggccgtgagcgaggagtgcagctacttcctgcagaccctgtgcagcgtgctgggcgagtactacacccccgccctgaagtgcgaggtgaacgccgaggacaaggagaacagcggcgactacatcagcgagaacgaggaccccgagctgcaggactacagatacgaggtgcaggacttccaggagaacatgcacaccctgctgaacaaggtgaccgaggagtacaacaagctgctggtgctgcagaccagactgagcaagatctggggccagcagaccgacggcatgaagctggagttcggcgaggagaacctgcccaaggaggagaccgagttcctgagcatccacagccagatgaccaacctggaggacatcgacgtgaaccacaagagcaagctgagcagcctgcaggacctggagaagaccaagctggaggagcaggtgcaggagctggagagcctgatcagcagcctgcagcagcagctgaaggagaccgagcagaactacgaggccgagatccactgcctgcagaagagactgcaggccgtgagcgagagcaccgtgccccccagcctgcccgtggacagcgtggtgatcaccgagagcgacgcccagagaaccatgtaccccggcagctgcgtgaagaagaacatcgacggcaccatcgagttcagcggcgagttcggcgtgaaggaggagaccaacatcgtgaagctgctggagaagcagtaccaggagcagctggaggaggaggtggccaaggtgatcgtgagcatgagcatcgccttcgcccagcagaccgagctgagcagaatcagcggcggcaaggagaacaccgccagcagcaagcaggcccacgccgtgtgccagcaggagcagcactacttcaacgagatgaagctgagccaggaccagatcggcttccagaccttcgagaccgtggacgtgaagttcaaggaggagttcaagcccctgagcaaggagctgggcgagcacggcaaggagatcctgctgagcaacagcgacccccacgacatccccgagagcaaggactgcgtgctgaccatcagcgaggagatgttcagcaaggacaagaccttcatcgtgagacagagcatccacgacgagatcagcgtgagcagcatggacgccagcagacagctgatgctgaacgaggagcagctggaggacatgagacaggagctggtgagacagtaccaggagcaccagcaggccaccgagctgctgagacaggcccacatgagacagatggagagacagagagaggaccaggagcagctgcaggaggagatcaagagactgaacagacagctggcccagagaagcagcatcgacaacgagaacctggtgagcgagagagagagagtgctgctggaggagctggaggccctgaagcagctgagcctggccggcagagagaagctgtgctgcgagctgagaaacagcagcacccagacccagaacggcaacgagaaccagggcgaggtggaggagcagaccttcaaggagaaggagctggacagaaagcccgaggacgtgccccccgagatcctgagcaacgagagatacgccctgcagaaggccaacaacagactgctgaagatcctgctggaggtggtgaagaccaccgccgccgtggaggagaccatcggcagacacgtgctgggcatcctggacagaagcagcaagagccagagcagcgccagcctgatctggagaagcgaggccgaggccagcgtgaagagctgcgtgcacgaggagcacaccagagtgaccgacgagagcatccccagctacagcggcagcgacatgcccagaaacgacatcaacatgtggagcaaggtgaccgaggagggcaccgagctgagccagagactggtgagaagcggcttcgccggcaccgagatcgaccccgagaacgaggagctgatgctgaacatcagcagcagactgcaggccgccgtggagaagctgctggaggccatcagcgagaccagcagccagctggagcacgccaaggtgacccagaccgagctgatgagagagagcttcagacagaagcaggaggccaccgagagcctgaagtgccaggaggagctgagagagagactgcacgaggagagcagagccagagagcagctggccgtggagctgagcaaggccgagggcgtgatcgacggctacgccgacgagaagaccctgttcgagagacagatccaggagaagaccgacatcatcgacagactggagcaggagctgctgtgcgccagcaacagactgcaggagctggaggccgagcagcagcagatccaggaggagagagagctgctgagcagacagaaggaggccatgaaggccgaggccggccccgtggagcagcagctgctgcaggagaccgagaagctgatgaaggagaagctggaggtgcagtgccaggccgagaaggtgagagacgacctgcagaagcaggtgaaggccctggagatcgacgtggaggagcaggtgagcagattcatcgagctggagcaggagaagaacaccgagctgatggacctgagacagcagaaccaggccctggagaagcagctggagaagatgagaaagttcctggacgagcaggccatcgacagagagcacgagagagacgtgttccagcaggagatccagaagctggagcagcagctgaaggtggtgcccagattccagcccatcagcgagcaccagaccagagaggtggagcagctggccaaccacctgaaggagaagaccgacaagtgcagcgagctgctgctgagcaaggagcagctgcagagagacatccaggagagaaacgaggagatcgagaagctggagttcagagtgagagagctggagcaggccctgctggtgagcgccgacaccttccagaaggtggaggacagaaagcacttcggcgccgtggaggccaagcccgagctgagcctggaggtgcagctgcaggccgagagagacgccatcgacagaaaggagaaggagatcaccaacctggaggagcagctggagcagttcagagaggagctggagaacaagaacgaggaggtgcagcagctgcacatgcagctggagatccagaagaaggagagcaccaccagactgcaggagctggagcaggagaacaagctgttcaaggacgacatggagaagctgggcctggccatcaaggagagcgacgccatgagcacccaggaccagcacgtgctgttcggcaagttcgcccagatcatccaggagaaggaggtggagatcgaccagctgaacgagcaggtgaccaagctgcagcagcagctgaagatcaccaccgacaacaaggtgatcgaggagaagaacgagctgatcagagacctggagacccagatcgagtgcctgatgagcgaccaggagtgcgtgaagagaaacagagaggaggagatcgagcagctgaacgaggtgatcgagaagctgcagcaggagctggccaacatcggccagaagaccagcatgaacgcccacagcctgagcgaggaggccgacagcctgaagcaccagctggacgtggtgatcgccgagaagctggccctggagcagcaggtggagaccgccaacgaggagatgaccttcatgaagaacgtgctgaaggagaccaacttcaagatgaaccagctgacccaggagctgttcagcctgaagagagagagagagagcgtggagaagatccagagcatccccgagaacagcgtgaacgtggccatcgaccacctgagcaaggacaagcccgagctggaggtggtgctgaccgaggacgccctgaagagcctggagaaccagacctacttcaagagcttcgaggagaacggcaagggcagcatcatcaacctggagaccagactgctgcagctggagagcaccgtgagcgccaaggacctggagctgacccagtgctacaagcagatcaaggacatgcaggagcagggccagttcgagaccgagatgctgcagaagaagatcgtgaacctgcagaagatcgtggaggagaaggtggccgccgccctggtgagccagatccagctggaggccgtgcaggagtacgccaagttctgccaggacaaccagaccatcagcagcgagcccgagagaaccaacatccagaacctgaaccagctgagagaggacgagctgggcagcgacatcagcgccctgaccctgagaatcagcgagctggagagccaggtggtggagatgcacaccagcctgatcctggagaaggagcaggtggagatcgccgagaagaacgtgctggagaaggagaagaagctgctggagctgcagaagctgctggagggcaacgagaagaagcagagagagaaggagaagaagagaagcccccaggacgtggaggtgctgaagaccaccaccgagctgttccacagcaacgaggagagcggcttcttcaacgagctggaggccctgagagccgagagcgtggccaccaaggccgagctggccagctacaaggagaaggccgagaagctgcaggaggagctgctggtgaaggagaccaacatgaccagcctgcagaaggacctgagccaggtgagagaccacctggccgaggccaaggagaagctgagcatcctggagaaggaggacgagaccgaggtgcaggagagcaagaaggcctgcatgttcgagcccctgcccatcaagctgagcaagagcatcgccagccagaccgacggcaccctgaagatcagcagcagcaaccagaccccccagatcctggtgaagaacgccggcatccagatcaacctgcagagcgagtgcagcagcgaggaggtgaccgagatcatcagccagttcaccgagaagatcgagaagatgcaggagctgcacgccgccgagatcctggacatggagagcagacacatcagcgagaccgagaccctgaagagagagcactacgtggccgtgcagctgctgaaggaggagtgcggcaccctgaaggccgtgatccagtgcctgagaagcaaggagggcctgctgagagccgtgcacaacgagggcatgcaggtgctgagcctgaccgagagcccctacagcgacggcgaggaccacagcatccagcaggtgagcgagccctggctggaggagagaaaggcctacatcaacaccatcagcagcctgaaggacctgatcaccaagatgcagctgcagagagaggccgaggtgtacgacagcagccagagccacgagagcttcagcgactggagaggcgagctgctgctggccctgcagcaggtgttcctggaggagagaagcgtgctgctggccgccttcagaaccgagctgaccgccctgggcaccaccgacgccgtgggcctgctgaactgcctggagcagagaatccaggagcagggcgtggagtaccaggccgccatggagtgcctgcagaaggccgacagaagaagcctgctgagcgagatccaggccctgcacgcccagatgaacggcagaaagatcaccctgaagagagagcaggagagcgagaagcccagccaggagctgctggagtacaacatccagcagaagcagagccagatgctggagatgcaggtggagctgagcagcatgaaggacagagccaccgagctgcaggagcagctgagcagcgagaagatggtggtggccgagctgaagagcgagctggcccagaccaagctggagctggagaccaccctgaaggcccagcacaagcacctgaaggagctggaggccttcagactggaggtgaaggacaagaccgacgaggtgcacctgctgaacgacaccctggccagcgagcagaagaagagcagagagctgcagtgggccctggagaaggagaaggccaagctgggcagaagcgaggagagagacaaggaggagctggaggacctgaagttcagcctggagagccagaagcagagaaacctgcagctgaacctgctgctggagcagcagaagcagctgctgaacgagagccagcagaagatcgagagccagagaatgctgtacgacgcccagctgagcgaggagcagggcagaaacctggagctgcaggtgctgctggagagcgagaaggtgagaatcagagagatgagcagcaccctggacagagagagagagctgcacgcccagctgcagagcagcgacggcaccggccagagcagaccccccctgcccagcgaggacctgctgaaggagctgcagaagcagctggaggagaagcacagcagaatcgtggagctgctgaacgagaccgagaagtacaagctggacagcctgcagaccagacagcagatggagaaggacagacaggtgcacagaaagaccctgcagaccgagcaggaggccaacaccgagggccagaagaagatgcacgagctgcagagcaaggtggaggacctgcagagacagctggaggagaagagacagcaggtgtacaagctggacctggagggccagagactgcagggcatcatgcaggagttccagaagcaggagctggagagagaggagaagagagagagcagaagaatcctgtaccagaacctgaacgagcccaccacctggagcctgaccagcgacagaaccagaaactgggtgctgcagcagaagatcgagggcgagaccaaggagagcaactacgccaagctgatcgagatgaacggcggcggcaccggctgcaaccacgagctggagatgatcagacagaagctgcagtgcgtggccagcaagctgcaggtgctgccccagaaggccagcgagagactgcagttcgagaccgccgacgacgaggacttcatctgggtgcaggagaacatcgacgagatcatcctgcagctgcagaagctgaccggccagcagggcgaggagcccagcctggtgagccccagcaccagctgcggcagcctgaccgagagactgctgagacagaacgccgagctgaccggccacatcagccagctgaccgaggagaagaacgacctgagaaacatggtgatgaagctggaggagcagatcagatggtacagacagaccggcgccggcagagacaacagcagcagattcagcctgaacggcggcgccaacatcgaggccatcatcgccagcgagaaggaggtgtggaacagagagaagctgaccctgcagaagagcctgaagagagccgaggccgaggtgtacaagctgaaggccgagctgagaaacgacagcctgctgcagaccctgagccccgacagcgagcacgtgaccctgaagagaatctacggcaagtacctgagagccgagagcttcagaaaggccctgatctaccagaagaagtacctgctgctgctgctgggcggcttccaggagtgcgaggacgccaccctggccctgctggccagaatgggcggccagcccgccttcaccgacctggaggtgatcaccaacagacccaagggcttcaccagattcagaagcgccgtgagagtgagcatcgccatcagcagaatgaagttcctggtgagaagatggcacagagtgaccggcagcgtgagcatcaacatcaacagagacggcttcggcctgaaccagggcgccgagaagaccgacagcttctaccacagcagcggcggcctggagctgtacggcgagcccagacacaccacctacagaagcagaagcgacctggactacatcagaagccccctgcccttccagaacagataccccggcacccccgccgacttcaaccccggcagcctggcctgcagccagctgcagaactacgaccccgacagagccctgaccgactacatcaccagactggaggccctgcagagaagactgggcaccatccagagcggcagcaccacccagttccacgccggcatgagaagatag

SEQ ID NO: 71263 - DNA, 11736 bp, Artificial Sequence
  Description of Artificial Sequence: Synthetic coding sequence
atggaggacgaggagagacagaagaagctggaggccggcaaggccaagatcgaggagctgagcctggccttcctggtgagacagctggcccagttcagacagagaaaggcccagagcgacggccagagccccagcaagaagcagaagaagaagagaaagaccagcagcagcaagcacgacgtgagcgcccaccacgacctgaacatcgaccagagccagtgcaacgagatgtacatcaacagcagccagagagtggagagcaccgtgatccccgagagcaccatcatgagaaccctgcacagcggcgagatcaccagccacgagcagggcttcagcgtggagctggagagcgagatcagcaccaccgccgacgactgcagcagcgaggtgaacggctgcagcttcgtgatgagaaccggcaagcccaccaacctgctgagagaggaggagttcggcgtggacgacagctacagcgagcagggcgcccaggacagccccacccacctggagatgatggagagcgagctggccggcaagcagcacgagatcgaggagctgaacagagagctggaggagatgagagtgacctacggcaccgagggcctgcagcagctgcaggagttcgaggccgccatcaagcagagagacggcatcatcacccagctgaccgccaacctgcagcaggccagaagagagaaggacgagaccatgagagagttcctggagctgaccgagcagagccagaagctgcagatccagttccagcagctgcaggccagcgagaccctgagaaacagcacccacagcagcaccgccgccgacctgctgcaggccaagcagcagatcctgacccaccagcagcagctggaggagcaggaccacctgctggaggactaccagaagaagaaggaggacttcaccatgcagatcagcttcctgcaggagaagatcaaggtgtacgagatggagcaggacaagaaggtggagaacagcaacaaggaggagatccaggagaaggagaccatcatcgaggagctgaacaccaagatcatcgaggaggagaagaagaccctggagctgaaggacaagctgaccaccgccgacaagctgctgggcgagctgcaggagcagatcgtgcagaagaaccaggagatcaagaacatgaagctggagctgaccaacagcaagcagaaggagagacagagcagcgaggagatcaagcagctgatgggcaccgtggaggagctgcagaagagaaaccacaaggacagccagttcgagaccgacatcgtgcagagaatggagcaggagacccagagaaagctggagcagctgagagccgagctggacgagatgtacggccagcagatcgtgcagatgaagcaggagctgatcagacagcacatggcccagatggaggagatgaagaccagacacaagggcgagatggagaacgccctgagaagctacagcaacatcaccgtgaacgaggaccagatcaagctgatgaacgtggccatcaacgagctgaacatcaagctgcaggacaccaacagccagaaggagaagctgaaggaggagctgggcctgatcctggaggagaagtgcgccctgcagagacagctggaggacctggtggaggagctgagcttcagcagagagcagatccagagagccagacagaccatcgccgagcaggagagcaagctgaacgaggcccacaagagcctgagcaccgtggaggacctgaaggccgagatcgtgagcgccagcgagagcagaaaggagctggagctgaagcacgaggccgaggtgaccaactacaagatcaagctggagatgctggagaaggagaagaacgccgtgctggacagaatggccgagagccaggaggccgagctggagagactgagaacccagctgctgttcagccacgaggaggagctgagcaagctgaaggaggacctggagatcgagcacagaatcaacatcgagaagctgaaggacaacctgggcatccactacaagcagcagatcgacggcctgcagaacgagatgagccagaagatcgagaccatgcagttcgagaaggacaacctgatcaccaagcagaaccagctgatcctggagatcagcaagctgaaggacctgcagcagagcctggtgaacagcaagagcgaggagatgaccctgcagatcaacgagctgcagaaggagatcgagatcctgagacaggaggagaaggagaagggcaccctggagcaggaggtgcaggagctgcagctgaagaccgagctgctggagaagcagatgaaggagaaggagaacgacctgcaggagaagttcgcccagctggaggccgagaacagcatcctgaaggacgagaagaagaccctggaggacatgctgaagatccacacccccgtgagccaggaggagagactgatcttcctggacagcatcaagagcaagagcaaggacagcgtgtgggagaaggagatcgagatcctgatcgaggagaacgaggacctgaagcagcagtgcatccagctgaacgaggagatcgagaagcagagaaacaccttcagcttcgccgagaagaacttcgaggtgaactaccaggagctgcaggaggagtacgcctgcctgctgaaggtgaaggacgacctggaggacagcaagaacaagcaggagctggagtacaagagcaagctgaaggccctgaacgaggagctgcacctgcagagaatcaaccccaccaccgtgaagatgaagagcagcgtgttcgacgaggacaagaccttcgtggccgagaccctggagatgggcgaggtggtggagaaggacaccaccgagctgatggagaagctggaggtgaccaagagagagaagctggagctgagccagagactgagcgacctgagcgagcagctgaagcagaagcacggcgagatcagcttcctgaacgaggaggtgaagagcctgaagcaggagaaggagcaggtgagcctgagatgcagagagctggagatcatcatcaaccacaacagagccgagaacgtgcagagctgcgacacccaggtgagcagcctgctggacggcgtggtgaccatgaccagcagaggcgccgagggcagcgtgagcaaggtgaacaagagcttcggcgaggagagcaagatcatggtggaggacaaggtgagcttcgagaacatgaccgtgggcgaggagagcaagcaggagcagctgatcctggaccacctgcccagcgtgaccaaggagagcagcctgagagccacccagcccagcgagaacgacaagctgcagaaggagctgaacgtgctgaagagcgagcagaacgacctgagactgcagatggaggcccagagaatctgcctgagcctggtgtacagcacccacgtggaccaggtgagagagtacatggagaacgagaaggacaaggccctgtgcagcctgaaggaggagctgatcttcgcccaggaggagaagatcaaggagctgcagaagatccaccagctggagctgcagaccatgaagacccaggagaccggcgacgagggcaagcccctgcacctgctgatcggcaagctgcagaaggccgtgagcgaggagtgcagctacttcctgcagaccctgtgcagcgtgctgggcgagtactacacccccgccctgaagtgcgaggtgaacgccgaggacaaggagaacagcggcgactacatcagcgagaacgaggaccccgagctgcaggactacagatacgaggtgcaggacttccaggagaacatgcacaccctgctgaacaaggtgaccgaggagtacaacaagctgctggtgctgcagaccagactgagcaagatctggggccagcagaccgacggcatgaagctggagttcggcgaggagaacctgcccaaggaggagaccgagttcctgagcatccacagccagatgaccaacctggaggacatcgacgtgaaccacaagagcaagctgagcagcctgcaggacctggagaagaccaagctggaggagcaggtgcaggagctggagagcctgatcagcagcctgcagcagcagctgaaggagaccgagcagaactacgaggccgagatccactgcctgcagaagagactgcaggccgtgagcgagagcaccgtgccccccagcctgcccgtggacagcgtggtgatcaccgagagcgacgcccagagaaccatgtaccccggcagctgcgtgaagaagaacatcgacggcaccatcgagttcagcggcgagttcggcgtgaaggaggagaccaacatcgtgaagctgctggagaagcagtaccaggagcagctggaggaggaggtggccaaggtgatcgtgagcatgagcatcgccttcgcccagcagaccgagctgagcagaatcagcggcggcaaggagaacaccgccagcagcaagcaggcccacgccgtgtgccagcaggagcagcactacttcaacgagatgaagctgagccaggaccagatcggcttccagaccttcgagaccgtggacgtgaagttcaaggaggagttcaagcccctgagcaaggagctgggcgagcacggcaaggagatcctgctgagcaacagcgacccccacgacatccccgagagcaaggactgcgtgctgaccatcagcgaggagatgttcagcaaggacaagaccttcatcgtgagacagagcatccacgacgagatcagcgtgagcagcatggacgccagcagacagctgatgctgaacgaggagcagctggaggacatgagacaggagctggtgagacagtaccaggagcaccagcaggccaccgagctgctgagacaggcccacatgagacagatggagagacagagagaggaccaggagcagctgcaggaggagatcaagagactgaacagacagctggcccagagaagcagcatcgacaacgagaacctggtgagcgagagagagagagtgctgctggaggagctggaggccctgaagcagctgagcctggccggcagagagaagctgtgctgcgagctgagaaacagcagcacccagacccagaacggcaacgagaaccagggcgaggtggaggagcagaccttcaaggagaaggagctggacagaaagcccgaggacgtgccccccgagatcctgagcaacgagagatacgccctgcagaaggccaacaacagactgctgaagatcctgctggaggtggtgaagaccaccgccgccgtggaggagaccatcggcagacacgtgctgggcatcctggacagaagcagcaagagccagagcagcgccagcctgatctggagaagcgaggccgaggccagcgtgaagagctgcgtgcacgaggagcacaccagagtgaccgacgagagcatccccagctacagcggcagcgacatgcccagaaacgacatcaacatgtggagcaaggtgaccgaggagggcaccgagctgagccagagactggtgagaagcggcttcgccggcaccgagatcgaccccgagaacgaggagctgatgctgaacatcagcagcagactgcaggccgccgtggagaagctgctggaggccatcagcgagaccagcagccagctggagcacgccaaggtgacccagaccgagctgatgagagagagcttcagacagaagcaggaggccaccgagagcctgaagtgccaggaggagctgagagagagactgcacgaggagagcagagccagagagcagctggccgtggagctgagcaaggccgagggcgtgatcgacggctacgccgacgagaagaccctgttcgagagacagatccaggagaagaccgacatcatcgacagactggagcaggagctgctgtgcgccagcaacagactgcaggagctggaggccgagcagcagcagatccaggaggagagagagctgctgagcagacagaaggaggccatgaaggccgaggccggccccgtggagcagcagctgctgcaggagaccgagaagctgatgaaggagaagctggaggtgcagtgccaggccgagaaggtgagagacgacctgcagaagcaggtgaaggccctggagatcgacgtggaggagcaggtgagcagattcatcgagctggagcaggagaagaacaccgagctgatggacctgagacagcagaaccaggccctggagaagcagctggagaagatgagaaagttcctggacgagcaggccatcgacagagagcacgagagagacgtgttccagcaggagatccagaagctggagcagcagctgaaggtggtgcccagattccagcccatcagcgagcaccagaccagagaggtggagcagctggccaaccacctgaaggagaagaccgacaagtgcagcgagctgctgctgagcaaggagcagctgcagagagacatccaggagagaaacgaggagatcgagaagctggagttcagagtgagagagctggagcaggccctgctggtgagcgccgacaccttccagaaggtggaggacagaaagcacttcggcgccgtggaggccaagcccgagctgagcctggaggtgcagctgcaggccgagagagacgccatcgacagaaaggagaaggagatcaccaacctggaggagcagctggagcagttcagagaggagctggagaacaagaacgaggaggtgcagcagctgcacatgcagctggagatccagaagaaggagagcaccaccagactgcaggagctggagcaggagaacaagctgttcaaggacgacatggagaagctgggcctggccatcaaggagagcgacgccatgagcacccaggaccagcacgtgctgttcggcaagttcgcccagatcatccaggagaaggaggtggagatcgaccagctgaacgagcaggtgaccaagctgcagcagcagctgaagatcaccaccgacaacaaggtgatcgaggagaagaacgagctgatcagagacctggagacccagatcgagtgcctgatgagcgaccaggagtgcgtgaagagaaacagagaggaggagatcgagcagctgaacgaggtgatcgagaagctgcagcaggagctggccaacatcggccagaagaccagcatgaacgcccacagcctgagcgaggaggccgacagcctgaagcaccagctggacgtggtgatcgccgagaagctggccctggagcagcaggtggagaccgccaacgaggagatgaccttcatgaagaacgtgctgaaggagaccaacttcaagatgaaccagctgacccaggagctgttcagcctgaagagagagagagagagcgtggagaagatccagagcatccccgagaacagcgtgaacgtggccatcgaccacctgagcaaggacaagcccgagctggaggtggtgctgaccgaggacgccctgaagagcctggagaaccagacctacttcaagagcttcgaggagaacggcaagggcagcatcatcaacctggagaccagactgctgcagctggagagcaccgtgagcgccaaggacctggagctgacccagtgctacaagcagatcaaggacatgcaggagcagggccagttcgagaccgagatgctgcagaagaagatcgtgaacctgcagaagatcgtggaggagaaggtggccgccgccctggtgagccagatccagctggaggccgtgcaggagtacgccaagttctgccaggacaaccagaccatcagcagcgagcccgagagaaccaacatccagaacctgaaccagctgagagaggacgagctgggcagcgacatcagcgccctgaccctgagaatcagcgagctggagagccaggtggtggagatgcacaccagcctgatcctggagaaggagcaggtggagatcgccgagaagaacgtgctggagaaggagaagaagctgctggagctgcagaagctgctggagggcaacgagaagaagcagagagagaaggagaagaagagaagcccccaggacgtggaggtgctgaagaccaccaccgagctgttccacagcaacgaggagagcggcttcttcaacgagctggaggccctgagagccgagagcgtggccaccaaggccgagctggccagctacaaggagaaggccgagaagctgcaggaggagctgctggtgaaggagaccaacatgaccagcctgcagaaggacctgagccaggtgagagaccacctggccgaggccaaggagaagctgagcatcctggagaaggaggacgagaccgaggtgcaggagagcaagaaggcctgcatgttcgagcccctgcccatcaagctgagcaagagcatcgccagccagaccgacggcaccctgaagatcagcagcagcaaccagaccccccagatcctggtgaagaacgccggcatccagatcaacctgcagagcgagtgcagcagcgaggaggtgaccgagatcatcagccagttcaccgagaagatcgagaagatgcaggagctgcacgccgccgagatcctggacatggagagcagacacatcagcgagaccgagaccctgaagagagagcactacgtggccgtgcagctgctgaaggaggagtgcggcaccctgaaggccgtgatccagtgcctgagaagcaaggaggtgttcggcttctacaacatgtgcttcagcaccctgtgcgacagcggcagcgactggggccagggcatctacctgacccacagccagggcttcgacatcgccagcgagggcagaggcgaggagagcgagagcgccaccgacagcttccccaagaagatcaagggcctgctgagagccgtgcacaacgagggcatgcaggtgctgagcctgaccgagagcccctacagcgacggcgaggaccacagcatccagcaggtgagcgagccctggctggaggagagaaaggcctacatcaacaccatcagcagcctgaaggacctgatcaccaagatgcagctgcagagagaggccgaggtgtacgacagcagccagagccacgagagcttcagcgactggagaggcgagctgctgctggccctgcagcaggtgttcctggaggagagaagcgtgctgctggccgccttcagaaccgagctgaccgccctgggcaccaccgacgccgtgggcctgctgaactgcctggagcagagaatccaggagcagggcgtggagtaccaggccgccatggagtgcctgcagaaggccgacagaagaagcctgctgagcgagatccaggccctgcacgcccagatgaacggcagaaagatcaccctgaagagagagcaggagagcgagaagcccagccaggagctgctggagtacaacatccagcagaagcagagccagatgctggagatgcaggtggagctgagcagcatgaaggacagagccaccgagctgcaggagcagctgagcagcgagaagatggtggtggccgagctgaagagcgagctggcccagaccaagctggagctggagaccaccctgaaggcccagcacaagcacctgaaggagctggaggccttcagactggaggtgaaggacaagaccgacgaggtgcacctgctgaacgacaccctggccagcgagcagaagaagagcagagagctgcagtgggccctggagaaggagaaggccaagctgggcagaagcgaggagagagacaaggaggagctggaggacctgaagttcagcctggagagccagaagcagagaaacctgcagctgaacctgctgctggagcagcagaagcagctgctgaacgagagccagcagaagatcgagagccagagaatgctgtacgacgcccagctgagcgaggagcagggcagaaacctggagctgcaggtgctgctggagagcgagaaggtgagaatcagagagatgagcagcaccctggacagagagagagagctgcacgcccagctgcagagcagcgacggcaccggccagagcagaccccccctgcccagcgaggacctgctgaaggagctgcagaagcagctggaggagaagcacagcagaatcgtggagctgctgaacgagaccgagaagtacaagctggacagcctgcagaccagacagcagatggagaaggacagacaggtgcacagaaagaccctgcagaccgagcaggaggccaacaccgagggccagaagaagatgcacgagctgcagagcaaggtggaggacctgcagagacagctggaggagaagagacagcaggtgtacaagctggacctggagggccagagactgcagggcatcatgcaggagttccagaagcaggagctggagagagaggagaagagagagagcagaagaatcctgtaccagaacctgaacgagcccaccacctggagcctgaccagcgacagaaccagaaactgggtgctgcagcagaagatcgagggcgagaccaaggagagcaactacgccaagctgatcgagatgaacggcggcggcaccggctgcaaccacgagctggagatgatcagacagaagctgcagtgcgtggccagcaagctgcaggtgctgccccagaaggccagcgagagactgcagttcgagaccgccgacgacgaggacttcatctgggtgcaggagaacatcgacgagatcatcctgcagctgcagaagctgaccggccagcagggcgaggagcccagcctggtgagccccagcaccagctgcggcagcctgaccgagagactgctgagacagaacgccgagctgaccggccacatcagccagctgaccgaggagaagaacgacctgagaaacatggtgatgaagctggaggagcagatcagatggtacagacagaccggcgccggcagagacaacagcagcagattcagcctgaacggcggcgccaacatcgaggccatcatcgccagcgagaaggaggtgtggaacagagagaagctgaccctgcagaagagcctgaagagagccgaggccgaggtgtacaagctgaaggccgagctgagaaacgacagcctgctgcagaccctgagccccgacagcgagcacgtgaccctgaagagaatctacggcaagtacctgagagccgagagcttcagaaaggccctgatctaccagaagaagtacctgctgctgctgctgggcggcttccaggagtgcgaggacgccaccctggccctgctggccagaatgggcggccagcccgccttcaccgacctggaggtgatcaccaacagacccaagggcttcaccagattcagaagcgccgtgagagtgagcatcgccatcagcagaatgaagttcctggtgagaagatggcacagagtgaccggcagcgtgagcatcaacatcaacagagacggcttcggcctgaaccagggcgccgagaagaccgacagcttctaccacagcagcggcggcctggagctgtacggcgagcccagacacaccacctacagaagcagaagcgacctggactacatcagaagccccctgcccttccagaacagataccccggcacccccgccgacttcaaccccggcagcctggcctgcagccagctgcagaactacgaccccgacagagccctgaccgactacatcaccagactggaggccctgcagagaagactgggcaccatccagagcggcagcaccacccagttccacgccggcatgagaagatag

SEQ ID NO: 71264 - DNA, 4932 bp, Artificial Sequence
  Description of Artificial Sequence: Synthetic coding sequence
atggaggacgaggagagacagaagaagctggaggccggcaaggccaagatcgaggagctgagcctggccttcctggtgagacagctggcccagttcagacagagaaaggcccagagcgacggccagagccccagcaagaagcagaagaagaagagaaagaccagcagcagcaagcacgacgtgagcgcccaccacgacctgaacatcgaccagagccagtgcaacgagatgtacatcaacagcagccagagagtggagagcaccgtgatccccgagagcaccatcatgagaaccctgcacagcggcgagatcaccagccacgagcagggcttcagcgtggagctggagagcgagatcagcaccaccgccgacgactgcagcagcgaggtgaacggctgcagcttcgtgatgagaaccggcaagcccaccaacctgctgagagaggaggagttcggcgtggacgacagctacagcgagcagggcgcccaggacagccccacccacctggagatgatggagagcgagctggccggcaagcagcacgagatcgaggagctgaacagagagctggaggagatgagagtgacctacggcaccgagggcctgcagcagctgcaggagttcgaggccgccatcaagcagagagacggcatcatcacccagctgaccgccaacctgcagcaggccagaagagagaaggacgagaccatgagagagttcctggagctgaccgagcagagccagaagctgcagatccagttccagcagctgcaggccagcgagaccctgagaaacagcacccacagcagcaccgccgccgacctgctgcaggccaagcagcagatcctgacccaccagcagcagctggaggagcaggaccacctgctggaggactaccagaagaagaaggaggacttcaccatgcagatcagcttcctgcaggagaagatcaaggtgtacgagatggagcaggacaagaaggtggagaacagcaacaaggaggagatccaggagaaggagaccatcatcgaggagctgaacaccaagatcatcgaggaggagaagaagaccctggagctgaaggacaagctgaccaccgccgacaagctgctgggcgagctgcaggagcagatcgtgcagaagaaccaggagatcaagaacatgaagctggagctgaccaacagcaagcagaaggagagacagagcagcgaggagatcaagcagctgatgggcaccgtggaggagctgcagaagagaaaccacaaggacagccagttcgagaccgacatcgtgcagagaatggagcaggagacccagagaaagctggagcagctgagagccgagctggacgagatgtacggccagcagatcgtgcagatgaagcaggagctgatcagacagcacatggcccagatggaggagatgaagaccagacacaagggcgagatggagaacgccctgagaagctacagcaacatcaccgtgaacgaggaccagatcaagctgatgaacgtggccatcaacgagctgaacatcaagctgcaggacaccaacagccagaaggagaagctgaaggaggagctgggcctgatcctggaggagaagtgcgccctgcagagacagctggaggacctggtggaggagctgagcttcagcagagagcagatccagagagccagacagaccatcgccgagcaggagagcaagctgaacgaggcccacaagagcctgagcaccgtggaggacctgaaggccgagatcgtgagcgccagcgagagcagaaaggagctggagctgaagcacgaggccgaggtgaccaactacaagatcaagctggagatgctggagaaggagaagaacgccgtgctggacagaatggccgagagccaggaggccgagctggagagactgagaacccagctgctgttcagccacgaggaggagctgagcaagctgaaggaggacctggagatcgagcacagaatcaacatcgagaagctgaaggacaacctgggcatccactacaagcagcagatcgacggcctgcagaacgagatgagccagaagatcgagaccatgcagttcgagaaggacaacctgatcaccaagcagaaccagctgatcctggagatcagcaagctgaaggacctgcagcagagcctggtgaacagcaagagcgaggagatgaccctgcagatcaacgagctgcagaaggagatcgagatcctgagacaggaggagaaggagaagggcaccctggagcaggaggtgcaggagctgcagctgaagaccgagctgctggagaagcagatgaaggagaaggagaacgacctgcaggagaagttcgcccagctggaggccgagaacagcatcctgaaggacgagaagaagaccctggaggacatgctgaagatccacacccccgtgagccaggaggagagactgatcttcctggacagcatcaagagcaagagcaaggacagcgtgtgggagaaggagatcgagatcctgatcgaggagaacgaggacctgaagcagcagtgcatccagctgaacgaggagatcgagaagcagagaaacaccttcagcttcgccgagaagaacttcgaggtgaactaccaggagctgcaggaggagtacgcctgcctgctgaaggtgaaggacgacctggaggacagcaagaacaagcaggagctggagtacaagagcaagctgaaggccctgaacgaggagctgcacctgcagagaatcaaccccaccaccgtgaagatgaagagcagcgtgttcgacgaggacaagaccttcgtggccgagaccctggagatgggcgaggtggtggagaaggacaccaccgagctgatggagaagctggaggtgaccaagagagagaagctggagctgagccagagactgagcgacctgagcgagcagctgaagcagaagcacggcgagatcagcttcctgaacgaggaggtgaagagcctgaagcaggagaaggagcaggtgagcctgagatgcagagagctggagatcatcatcaaccacaacagagccgagaacgtgcagagctgcgacacccaggtgagcagcctgctggacggcgtggtgaccatgaccagcagaggcgccgagggcagcgtgagcaaggtgaacaagagcttcggcgaggagagcaagatcatggtggaggacaaggtgagcttcgagaacatgaccgtgggcgaggagagcaagcaggagcagctgatcctggaccacctgcccagcgtgaccaaggagagcagcctgagagccacccagcccagcgagaacgacaagctgcagaaggagctgaacgtgctgaagagcgagcagaacgacctgagactgcagatggaggcccagagaatctgcctgagcctggtgtacagcacccacgtggaccaggtgagagagtacatggagaacgagaaggacaaggccctgtgcagcctgaaggaggagctgatcttcgcccaggaggagaagatcaaggagctgcagaagatccaccagctggagctgcagaccatgaagacccaggagaccggcgacgagggcaagcccctgcacctgctgatcggcaagctgcagaaggccgtgagcgaggagtgcagctacttcctgcagaccctgtgcagcgtgctgggcgagtactacacccccgccctgaagtgcgaggtgaacgccgaggacaaggagaacagcggcgactacatcagcgagaacgaggaccccgagctgcaggactacagatacgaggtgcaggacttccaggagaacatgcacaccctgctgaacaaggtgaccgaggagtacaacaagctgctggtgctgcagaccagactgagcaagatctggggccagcagaccgacggcatgaagctggagttcggcgaggagaacctgcccaaggaggagaccgagttcctgagcatccacagccagatgaccaacctggaggacatcgacgtgaaccacaagagcaagctgagcagcctgcaggacctggagaagaccaagctggaggagcaggtgcaggagctggagagcctgatcagcagcctgcagcagcagctgaaggagaccgagcagaactacgaggccgagatccactgcctgcagaagagactgcaggccgtgagcgagagcaccgtgccccccagcctgcccgtggacagcgtggtgatcaccgagagcgacgcccagagaaccatgtaccccggcagctgcgtgaagaagaacatcgacggcaccatcgagttcagcggcgagttcggcgtgaaggaggagaccaacatcgtgaagctgctggagaagcagtaccaggagcagctggaggaggaggtggccaaggtgatcgtgagcatgagcatcgccttcgcccagcagaccgagctgagcagaatcagcggcggcaaggagaacaccgccagcagcaagcaggcccacgccgtgtgccagcaggagcagcactacttcaacgagatgaagctgagccaggaccagatcggcttccagaccttcgagaccgtggacgtgaagttcaaggaggagttcaagcccctgagcaaggagctgggcgagcacggcaaggagatcctgctgagcaacagcgacccccacgacatccccgagagcaaggactgcgtgctgaccatcagcgaggagatgttcagcaaggacaagaccttcatcgtgagacagagcatccacgacgagatcagcgtgagcagcatggacgccagcagacagctgatgctgaacgaggagcagctggaggacatgagacaggagctggtgagacagtaccaggagcaccagcaggccaccgagctgctgagacaggcccacatgagacagatggagagacagagagaggaccaggagcagctgcaggtgagagtgctgtag

SEQ ID NO: 71265 - DNA, 11631 bp, Artificial Sequence
  Description of Artificial Sequence: Synthetic coding sequence
atggaggacgaggagagacagaagaagctggaggccggcaaggccaagatcgaggagctgagcctggccttcctggtgagacagctggcccagttcagacagagaaaggcccagagcgacggccagagccccagcaagaagcagaagaagaagagaaagaccagcagcagcaagcacgacgtgagcgcccaccacgacctgaacatcgaccagagccagtgcaacgagatgtacatcaacagcagccagagagtggagagcaccgtgatccccgagagcaccatcatgagaaccctgcacagcggcgagatcaccagccacgagcagggcttcagcgtggagctggagagcgagatcagcaccaccgccgacgactgcagcagcgaggtgaacggctgcagcttcgtgatgagaaccggcaagcccaccaacctgctgagagaggaggagttcggcgtggacgacagctacagcgagcagggcgcccaggacagccccacccacctggagatgatggagagcgagctggccggcaagcagcacgagatcgaggagctgaacagagagctggaggagatgagagtgacctacggcaccgagggcctgcagcagctgcaggagttcgaggccgccatcaagcagagagacggcatcatcacccagctgaccgccaacctgcagcaggccagaagagagaaggacgagaccatgagagagttcctggagctgaccgagcagagccagaagctgcagatccagttccagcagctgcaggccagcgagaccctgagaaacagcacccacagcagcaccgccgccgacctgctgcaggccaagcagcagatcctgacccaccagcagcagctggaggagcaggaccacctgctggaggactaccagaagaagaaggaggacttcaccatgcagatcagcttcctgcaggagaagatcaaggtgtacgagatggagcaggacaagaaggtggagaacagcaacaaggaggagatccaggagaaggagaccatcatcgaggagctgaacaccaagatcatcgaggaggagaagaagaccctggagctgaaggacaagctgaccaccgccgacaagctgctgggcgagctgcaggagcagatcgtgcagaagaaccaggagatcaagaacatgaagctggagctgaccaacagcaagcagaaggagagacagagcagcgaggagatcaagcagctgatgggcaccgtggaggagctgcagaagagaaaccacaaggacagccagttcgagaccgacatcgtgcagagaatggagcaggagacccagagaaagctggagcagctgagagccgagctggacgagatgtacggccagcagatcgtgcagatgaagcaggagctgatcagacagcacatggcccagatggaggagatgaagaccagacacaagggcgagatggagaacgccctgagaagctacagcaacatcaccgtgaacgaggaccagatcaagctgatgaacgtggccatcaacgagctgaacatcaagctgcaggacaccaacagccagaaggagaagctgaaggaggagctgggcctgatcctggaggagaagtgcgccctgcagagacagctggaggacctggtggaggagctgagcttcagcagagagcagatccagagagccagacagaccatcgccgagcaggagagcaagctgaacgaggcccacaagagcctgagcaccgtggaggacctgaaggccgagatcgtgagcgccagcgagagcagaaaggagctggagctgaagcacgaggccgaggtgaccaactacaagatcaagctggagatgctggagaaggagaagaacgccgtgctggacagaatggccgagagccaggaggccgagctggagagactgagaacccagctgctgttcagccacgaggaggagctgagcaagctgaaggaggacctggagatcgagcacagaatcaacatcgagaagctgaaggacaacctgggcatccactacaagcagcagatcgacggcctgcagaacgagatgagccagaagatcgagaccatgcagttcgagaaggacaacctgatcaccaagcagaaccagctgatcctggagatcagcaagctgaaggacctgcagcagagcctggtgaacagcaagagcgaggagatgaccctgcagatcaacgagctgcagaaggagatcgagatcctgagacaggaggagaaggagaagggcaccctggagcaggaggtgcaggagctgcagctgaagaccgagctgctggagaagcagatgaaggagaaggagaacgacctgcaggagaagttcgcccagctggaggccgagaacagcatcctgaaggacgagaagaagaccctggaggacatgctgaagatccacacccccgtgagccaggaggagagactgatcttcctggacagcatcaagagcaagagcaaggacagcgtgtgggagaaggagatcgagatcctgatcgaggagaacgaggacctgaagcagcagtgcatccagctgaacgaggagatcgagaagcagagaaacaccttcagcttcgccgagaagaacttcgaggtgaactaccaggagctgcaggaggagtacgcctgcctgctgaaggtgaaggacgacctggaggacagcaagaacaagcaggagctggagtacaagagcaagctgaaggccctgaacgaggagctgcacctgcagagaatcaaccccaccaccgtgaagatgaagagcagcgtgttcgacgaggacaagaccttcgtggccgagaccctggagatgggcgaggtggtggagaaggacaccaccgagctgatggagaagctggaggtgaccaagagagagaagctggagctgagccagagactgagcgacctgagcgagcagctgaagcagaagcacggcgagatcagcttcctgaacgaggaggtgaagagcctgaagcaggagaaggagcaggtgagcctgagatgcagagagctggagatcatcatcaaccacaacagagccgagaacgtgcagagctgcgacacccaggtgagcagcctgctggacggcgtggtgaccatgaccagcagaggcgccgagggcagcgtgagcaaggtgaacaagagcttcggcgaggagagcaagatcatggtggaggacaaggtgagcttcgagaacatgaccgtgggcgaggagagcaagcaggagcagctgatcctggaccacctgcccagcgtgaccaaggagagcagcctgagagccacccagcccagcgagaacgacaagctgcagaaggagctgaacgtgctgaagagcgagcagaacgacctgagactgcagatggaggcccagagaatctgcctgagcctggtgtacagcacccacgtggaccaggtgagagagtacatggagaacgagaaggacaaggccctgtgcagcctgaaggaggagctgatcttcgcccaggaggagaagatcaaggagctgcagaagatccaccagctggagctgcagaccatgaagacccaggagaccggcgacgagggcaagcccctgcacctgctgatcggcaagctgcagaaggccgtgagcgaggagtgcagctacttcctgcagaccctgtgcagcgtgctgggcgagtactacacccccgccctgaagtgcgaggtgaacgccgaggacaaggagaacagcggcgactacatcagcgagaacgaggaccccgagctgcaggactacagatacgaggtgcaggacttccaggagaacatgcacaccctgctgaacaaggtgaccgaggagtacaacaagctgctggtgctgcagaccagactgagcaagatctggggccagcagaccgacggcatgaagctggagttcggcgaggagaacctgcccaaggaggagaccgagttcctgagcatccacagccagatgaccaacctggaggacatcgacgtgaaccacaagagcaagctgagcagcctgcaggacctggagaagaccaagctggaggagcaggtgcaggagctggagagcctgatcagcagcctgcagcagcagctgaaggagaccgagcagaactacgaggccgagatccactgcctgcagaagagactgcaggccgtgagcgagagcaccgtgccccccagcctgcccgtggacagcgtggtgatcaccgagagcgacgcccagagaaccatgtaccccggcagctgcgtgaagaagaacatcgacggcaccatcgagttcagcggcgagttcggcgtgaaggaggagaccaacatcgtgaagctgctggagaagcagtaccaggagcagctggaggaggaggtggccaaggtgatcgtgagcatgagcatcgccttcgcccagcagaccgagctgagcagaatcagcggcggcaaggagaacaccgccagcagcaagcaggcccacgccgtgtgccagcaggagcagcactacttcaacgagatgaagctgagccaggaccagatcggcttccagaccttcgagaccgtggacgtgaagttcaaggaggagttcaagcccctgagcaaggagctgggcgagcacggcaaggagatcctgctgagcaacagcgacccccacgacatccccgagagcaaggactgcgtgctgaccatcagcgaggagatgttcagcaaggacaagaccttcatcgtgagacagagcatccacgacgagatcagcgtgagcagcatggacgccagcagacagctgatgctgaacgaggagcagctggaggacatgagacaggagctggtgagacagtaccaggagcaccagcaggccaccgagctgctgagacaggcccacatgagacagatggagagacagagagaggaccaggagcagctgcaggaggagatcaagagactgaacagacagctggcccagagaagcagcatcgacaacgagaacctggtgagcgagagagagagagtgctgctggaggagctggaggccctgaagcagctgagcctggccggcagagagaagctgtgctgcgagctgagaaacagcagcacccagacccagaacggcaacgagaaccagggcgaggtggaggagcagaccttcaaggagaaggagctggacagaaagcccgaggacgtgccccccgagatcctgagcaacgagagatacgccctgcagaaggccaacaacagactgctgaagatcctgctggaggtggtgaagaccaccgccgccgtggaggagaccatcggcagacacgtgctgggcatcctggacagaagcagcaagagccagagcagcgccagcctgatctggagaagcgaggccgaggccagcgtgaagagctgcgtgcacgaggagcacaccagagtgaccgacgagagcatccccagctacagcggcagcgacatgcccagaaacgacatcaacatgtggagcaaggtgaccgaggagggcaccgagctgagccagagactggtgagaagcggcttcgccggcaccgagatcgaccccgagaacgaggagctgatgctgaacatcagcagcagactgcaggccgccgtggagaagctgctggaggccatcagcgagaccagcagccagctggagcacgccaaggtgacccagaccgagctgatgagagagagcttcagacagaagcaggaggccaccgagagcctgaagtgccaggaggagctgagagagagactgcacgaggagagcagagccagagagcagctggccgtggagctgagcaaggccgagggcgtgatcgacggctacgccgacgagaagaccctgttcgagagacagatccaggagaagaccgacatcatcgacagactggagcaggagctgctgtgcgccagcaacagactgcaggagctggaggccgagcagcagcagatccaggaggagagagagctgctgagcagacagaaggaggccatgaaggccgaggccggccccgtggagcagcagctgctgcaggagaccgagaagctgatgaaggagaagctggaggtgcagtgccaggccgagaaggtgagagacgacctgcagaagcaggtgaaggccctggagatcgacgtggaggagcaggtgagcagattcatcgagctggagcaggagaagaacaccgagctgatggacctgagacagcagaaccaggccctggagaagcagctggagaagatgagaaagttcctggacgagcaggccatcgacagagagcacgagagagacgtgttccagcaggagatccagaagctggagcagcagctgaaggtggtgcccagattccagcccatcagcgagcaccagaccagagaggtggagcagctggccaaccacctgaaggagaagaccgacaagtgcagcgagctgctgctgagcaaggagcagctgcagagagacatccaggagagaaacgaggagatcgagaagctggagttcagagtgagagagctggagcaggccctgctggtggaggacagaaagcacttcggcgccgtggaggccaagcccgagctgagcctggaggtgcagctgcaggccgagagagacgccatcgacagaaaggagaaggagatcaccaacctggaggagcagctggagcagttcagagaggagctggagaacaagaacgaggaggtgcagcagctgcacatgcagctggagatccagaagaaggagagcaccaccagactgcaggagctggagcaggagaacaagctgttcaaggacgacatggagaagctgggcctggccatcaaggagagcgacgccatgagcacccaggaccagcacgtgctgttcggcaagttcgcccagatcatccaggagaaggaggtggagatcgaccagctgaacgagcaggtgaccaagctgcagcagcagctgaagatcaccaccgacaacaaggtgatcgaggagaagaacgagctgatcagagacctggagacccagatcgagtgcctgatgagcgaccaggagtgcgtgaagagaaacagagaggaggagatcgagcagctgaacgaggtgatcgagaagctgcagcaggagctggccaacatcggccagaagaccagcatgaacgcccacagcctgagcgaggaggccgacagcctgaagcaccagctggacgtggtgatcgccgagaagctggccctggagcagcaggtggagaccgccaacgaggagatgaccttcatgaagaacgtgctgaaggagaccaacttcaagatgaaccagctgacccaggagctgttcagcctgaagagagagagagagagcgtggagaagatccagagcatccccgagaacagcgtgaacgtggccatcgaccacctgagcaaggacaagcccgagctggaggtggtgctgaccgaggacgccctgaagagcctggagaaccagacctacttcaagagcttcgaggagaacggcaagggcagcatcatcaacctggagaccagactgctgcagctggagagcaccgtgagcgccaaggacctggagctgacccagtgctacaagcagatcaaggacatgcaggagcagggccagttcgagaccgagatgctgcagaagaagatcgtgaacctgcagaagatcgtggaggagaaggtggccgccgccctggtgagccagatccagctggaggccgtgcaggagtacgccaagttctgccaggacaaccagaccatcagcagcgagcccgagagaaccaacatccagaacctgaaccagctgagagaggacgagctgggcagcgacatcagcgccctgaccctgagaatcagcgagctggagagccaggtggtggagatgcacaccagcctgatcctggagaaggagcaggtggagatcgccgagaagaacgtgctggagaaggagaagaagctgctggagctgcagaagctgctggagggcaacgagaagaagcagagagagaaggagaagaagagaagcccccaggacgtggaggtgctgaagaccaccaccgagctgttccacagcaacgaggagagcggcttcttcaacgagctggaggccctgagagccgagagcgtggccaccaaggccgagctggccagctacaaggagaaggccgagaagctgcaggaggagctgctggtgaaggagaccaacatgaccagcctgcagaaggacctgagccaggtgagagaccacctggccgaggccaaggagaagctgagcatcctggagaaggaggacgagaccgaggtgcaggagagcaagaaggcctgcatgttcgagcccctgcccatcaagctgagcaagagcatcgccagccagaccgacggcaccctgaagatcagcagcagcaaccagaccccccagatcctggtgaagaacgccggcatccagatcaacctgcagagcgagtgcagcagcgaggaggtgaccgagatcatcagccagttcaccgagaagatcgagaagatgcaggagctgcacgccgccgagatcctggacatggagagcagacacatcagcgagaccgagaccctgaagagagagcactacgtggccgtgcagctgctgaaggaggagtgcggcaccctgaaggccgtgatccagtgcctgagaagcaaggagggcagcagcatccccgagctggcccacagcgacgcctaccagaccagagagatctgcagcagcgacagcggcagcgactggggccagggcatctacctgacccacagccagggcttcgacatcgccagcgagggcagaggcgaggagagcgagagcgccaccgacagcttccccaagaagatcaagggcctgctgagagccgtgcacaacgagggcatgcaggtgctgagcctgaccgagagcccctacagcgacggcgaggaccacagcatccagcaggtgagcgagccctggctggaggagagaaaggcctacatcaacaccatcagcagcctgaaggacctgatcaccaagatgcagctgcagagagaggccgaggtgtacgacagcagccagagccacgagagcttcagcgactggagaggcgagctgctgctggccctgcagcaggtgttcctggaggagagaagcgtgctgctggccgccttcagaaccgagctgaccgccctgggcaccaccgacgccgtgggcctgctgaactgcctggagcagagaatccaggagcagggcgtggagtaccaggccgccatggagtgcctgcagaaggccgacagaagaagcctgctgagcgagatccaggccctgcacgcccagatgaacggcagaaagatcaccctgaagagagagcaggagagcgagaagcccagccaggagctgctggagtacaacatccagcagaagcagagccagatgctggagatgcaggtggagctgagcagcatgaaggacagagccaccgagctgcaggagcagctgagcagcgagaagatggtggtggccgagctgaagagcgagctggcccagaccaagctggagctggagaccaccctgaaggcccagcacaagcacctgaaggagctggaggccttcagactggaggtgaaggacaagaccgacgaggtgcacctgctgaacgacaccctggccagcgagcagaagaagagcagagagctgcagtgggccctggagaaggagaaggccaagctgggcagaagcgaggagagagacaaggaggagctggaggacctgaagttcagcctggagagccagaagcagagaaacctgcagctgaacctgctgctggagcagcagaagcagctgctgaacgagagccagcagaagatcgagagccagagaatgctgtacgacgcccagctgagcgaggagcagggcagaaacctggagctgcaggtgctgctggagagcgagaaggtgagaatcagagagatgagcagcaccctggacagagagagagagctgcacgcccagctgcagagcagcgacggcaccggccagagcagaccccccctgcccagcgaggacctgctgaaggagctgcagaagcagctggaggagaagcacagcagaatcgtggagctgctgaacgagaccgagaagtacaagctggacagcctgcagaccagacagcagatggagaaggacagacaggtgcacagaaagaccctgcagaccgagcaggaggccaacaccgagggccagaagaagatgcacgagctgcagagcaaggtggaggacctgcagagacagctggaggagaagagacagcaggtgtacaagctggacctggagggccagagactgcagggcatcatgcaggagttccagaagcaggagctggagagagaggagaagagagagagcagaagaatcctgtaccagaacctgaacgagcccaccacctggagcctgaccagcgacagaaccagaaactgggtgctgcagcagaagatcgagggcgagaccaaggagagcaactacgccaagctgatcgagatgaacggcggcggcaccggctgcaaccacgagctggagatgatcagacagaagctgcagtgcgtggccagcaagctgcaggtgctgccccagaaggccagcgagagactgcagttcgagaccgccgacgacgaggacttcatctgggtgcaggagaacatcgacgagatcatcctgcagctgcagaagctgaccggccagcagggcgaggagcccagcctggtgagccccagcaccagctgcggcagcctgaccgagagactgctgagacagaacgccgagctgaccggccacatcagccagctgaccgaggagaagaacgacctgagaaacatggtgatgaagctggaggagcagatcagatggtacagacagaccggcgccggcagagacaacagcagcagattcagcctgaacggcggcgccaacatcgaggccatcatcgccagcgagaaggaggtgtggaacagagagaagctgaccctgcagaagagcctgaagagagccgaggccgaggtgtacaagctgaaggccgagctgagaaacgacagcctgctgcagaccctgagccccgacagcgagcacgtgaccctgaagagaatctacggcaagtacctgagagccgagagcttcagaaaggccctgatctaccagaagaagtacctgctgctgctgctgggcggcttccaggagtgcgaggacgccaccctggccctgctggccagaatgggcggccagcccgccttcaccgacctggaggtgatcaccaacagacccaagggcttcaccagattcagaagcgccgtgagagtgagcatcgccatcagcagaatgaagttcctggtgagaagatggcacagagtgaccggcagcgtgagcatcaacatcaacagagacggcttcggcctgaaccagggcgccgagaagaccgacagcttctaccacagcagcggcggcctggagctgtacggcgagcccagacacaccacctacagaagcagaagcgacctggactacatcagaagccccctgcccttccagaacagataccccggcacccccgccgacttcaaccccggcagcctggcctgcagccagctgcagaactacgacccctag

SEQ ID NO: 71266 - DNA, 1782 bp, Artificial Sequence
  Description of Artificial Sequence: Synthetic coding sequence
atggccatccagttcagaagcctgttccccctggccctgcccggcatgctggccctgctgggctggtggtggttcttcagcagaaagaagggccacgtgagcagccacgacgagcagcaggtggaggccggcgccgtgcagctgagagccgaccccgccatcaaggagcccctgcccgtggaggacgtgtgccccaaggtggtgagcaccccccccagcgtgaccgagccccccgagaaggagctgagcaccgtgagcaagctgcccgccgagccccccgccctgctgcagacccaccccccctgcagaagaagcgagagcagcggcatcctgcccaacaccaccgacatgagactgagacccggcaccagaagagacgacagcaccaagctggagctggccctgaccggcggcgaggccaagagcatccccctggagtgccccctgagcagccccaagggcgtgctgttcagcagcaagagcgccgaggtgtgcaagcaggacagccccttcagcagagtgcccagaaaggtgcagcccggctaccccgtggtgcccgccgagaagagaagcagcggcgagagagccagagagaccggcggcgccgagggcaccggcgacgccgtgctgggcgagaaggtgctggaggaggccctgctgagcagagagcacgtgctggagctggagaacagcaagggccccagcctggccagcctggagggcgaggaggacaagggcaagagcagcagcagccaggtggtgggccccgtgcaggaggaggagtacgtggccgagaagctgcccagcagattcatcgagagcgcccacaccgagctggccaaggacgacgccgcccccgccccccccgtggccgacgccaaggcccaggacagaggcgtggagggcgagctgggcaacgaggagagcctggacagaaacgaggagggcctggacagaaacgaggagggcctggacagaaacgaggagagcctggacagaaacgaggagggcctggacagaaacgaggagatcaagagagccgccttccagatcatcagccaggtgatcagcgaggccaccgagcaggtgctggccaccaccgtgggcaaggtggccggcagagtgtgccaggccagccagctgcagggccagaaggaggagagctgcgtgcccgtgcaccagaagaccgtgctgggccccgacaccgccgagcccgccaccgccgaggccgccgtggccccccccgacgccggcctgcccctgcccggcctgcccgccgagggcagccccccccccaagacctacgtgagctgcctgaagagcctgctgagcagccccaccaaggacagcaagcccaacatcagcgcccaccacatcagcctggccagctgcctggccctgaccacccccagcgaggagctgcccgacagagccggcatcctggtggaggacgccacctgcgtgacctgcatgagcgacagcagccagagcgtgcccctggtggccagccccggccactgcagcgacagcttcagcaccagcggcctggaggacagctgcaccgagaccagcagcagccccagagacaaggccatcaccccccccctgcccgagagcaccgtgcccttcagcaacggcgtgctgaagggcgagctgagcgacctgggcgccgaggacggctggaccatggacgccgaggccgaccacagcggcgtggccgcccccccccccggcaagagaggcaccctgatcaccagatgccccggcttcttcgagtgctag

SEQ ID NO: 71267 - DNA, 2712 bp, Artificial Sequence
  Description of Artificial Sequence: Synthetic coding sequence
atggccatccagttcagaagcctgttccccctggccctgcccggcatgctggccctgctgggctggtggtggttcttcagcagaaagaagggccacgtgagcagccacgacgagcagcaggtggaggccggcgccgtgcagctgagagccgaccccgccatcaaggagcccctgcccgtggaggacgtgtgccccaaggtggtgagcaccccccccagcgtgaccgagccccccgagaaggagctgagcaccgtgagcaagctgcccgccgagccccccgccctgctgcagacccaccccccctgcagaagaagcgagagcagcggcatcctgcccaacaccaccgacatgagactgagacccggcaccagaagagacgacagcaccaagctggagctggccctgaccggcggcgaggccaagagcatccccctggagtgccccctgagcagccccaagggcgtgctgttcagcagcaagagcgccgaggtgtgcaagcaggacagccccttcagcagagtgcccagaaaggtgcagcccggctaccccgtggtgcccgccgagaagagaagcagcggcgagagagccagagagaccggcggcgccgagggcaccggcgacgccgtgctgggcgagaaggtgctggaggaggccctgctgagcagagagcacgtgctggagctggagaacagcaagggccccagcctggccagcctggagggcgaggaggacaagggcaagagcagcagcagccaggtggtgggccccgtgcaggaggaggagtacgtggccgagaagctgcccagcagattcatcgagagcgcccacaccgagctggccaaggacgacgccgcccccgccccccccgtggccgacgccaaggcccaggacagaggcgtggagggcgagctgggcaacgaggagagcctggacagaaacgaggagggcctggacagaaacgaggagggcctggacagaaacgaggagagcctggacagaaacgaggagggcctggacagaaacgaggagatcaagagagccgccttccagatcatcagccaggtgatcagcgaggccaccgagcaggtgctggccaccaccgtgggcaaggtggccggcagagtgtgccaggccagccagctgcagggccagaaggaggagagctgcgtgcccgtgcaccagaagaccgtgctgggccccgacaccgccgagcccgccaccgccgaggccgccgtggccccccccgacgccggcctgcccctgcccggcctgcccgccgagggcagccccccccccaagacctacgtgagctgcctgaagagcctgctgagcagccccaccaaggacagcaagcccaacatcagcgcccaccacatcagcctggccagctgcctggccctgaccacccccagcgaggagctgcccgacagagccggcatcctggtggaggacgccacctgcgtgacctgcatgagcgacagcagccagagcgtgcccctggtggccagccccggccactgcagcgacagcttcagcaccagcggcctggaggacagctgcaccgagaccagcagcagccccagagacaaggccatcaccccccccctgcccgagagcaccgtgcccttcagcaacggcgtgctgaagggcgagctgagcgacctgggcgccgaggacggctggaccatggacgccgaggccgaccacagcggcggcagcgacagaaacagcatggacagcgtggacagctgctgcagcctgaagaagaccgagagcttccagaacgcccaggccggcagcaaccccaagaaggtggacctgatcatctgggagatcgaggtgcccaagcacctggtgggcagactgatcggcaagcagggcagatacgtgagcttcctgaagcagaccagcggcgccaagatctacatcagcaccctgccctacacccagagcgtgcagatctgccacatcgagggcagccagcaccacgtggacaaggccctgaacctgatcggcaagaagttcaaggagctgaacctgaccaacatctacgccccccccctgcccagcctggccctgcccagcctgcccatgaccagctggctgatgctgcccgacggcatcaccgtggaggtgatcgtggtgaaccaggtgaacgccggccacctgttcgtgcagcagcacacccaccccaccttccacgccctgagaagcctggaccagcagatgtacctgtgctacagccagcccggcatccccaccctgcccacccccgtggagatcaccgtgatctgcgccgcccccggcgccgacggcgcctggtggagagcccaggtggtggccagctacgaggagaccaacgaggtggagatcagatacgtggactacggcggctacaagagagtgaaggtggacgtgctgagacagatcagaagcgacttcgtgaccctgcccttccagggcgccgaggtgctgctggacagcgtgatgcccctgagcgacgacgaccagttcagccccgaggccgacgccgccatgagcgagatgaccggcaacaccgccctgctggcccaggtgaccagctacagccccaccggcctgcccctgatccagctgtggagcgtggtgggcgacgaggtggtgctgatcaacagaagcctggtggagagaggcctggcccagtgggtggacagctactacaccagcctgtag

SEQ ID NO: 71268 - DNA, 2838 bp, Artificial Sequence
  Description of Artificial Sequence: Synthetic coding sequence
atgggcgccctgggcgtgagcggcagcagcagccccggcggctgccccggctggagaagactgcccgccgccgtgaacaccaaccccgtggacttcgcccccggcgtgatcacccaggccagcagaatggccatccagttcagaagcctgttccccctggccctgcccggcatgctggccctgctgggctggtggtggttcttcagcagaaagaagggccacgtgagcagccacgacgagcagcaggtggaggccggcgccgtgcagctgagagccgaccccgccatcaaggagcccctgcccgtggaggacgtgtgccccaaggtggtgagcaccccccccagcgtgaccgagccccccgagaaggagctgagcaccgtgagcaagctgcccgccgagccccccgccctgctgcagacccaccccccctgcagaagaagcgagagcagcggcatcctgcccaacaccaccgacatgagactgagacccggcaccagaagagacgacagcaccaagctggagctggccctgaccggcggcgaggccaagagcatccccctggagtgccccctgagcagccccaagggcgtgctgttcagcagcaagagcgccgaggtgtgcaagcaggacagccccttcagcagagtgcccagaaaggtgcagcccggctaccccgtggtgcccgccgagaagagaagcagcggcgagagagccagagagaccggcggcgccgagggcaccggcgacgccgtgctgggcgagaaggtgctggaggaggccctgctgagcagagagcacgtgctggagctggagaacagcaagggccccagcctggccagcctggagggcgaggaggacaagggcaagagcagcagcagccaggtggtgggccccgtgcaggaggaggagtacgtggccgagaagctgcccagcagattcatcgagagcgcccacaccgagctggccaaggacgacgccgcccccgccccccccgtggccgacgccaaggcccaggacagaggcgtggagggcgagctgggcaacgaggagagcctggacagaaacgaggagggcctggacagaaacgaggagggcctggacagaaacgaggagagcctggacagaaacgaggagggcctggacagaaacgaggagatcaagagagccgccttccagatcatcagccaggtgatcagcgaggccaccgagcaggtgctggccaccaccgtgggcaaggtggccggcagagtgtgccaggccagccagctgcagggccagaaggaggagagctgcgtgcccgtgcaccagaagaccgtgctgggccccgacaccgccgagcccgccaccgccgaggccgccgtggccccccccgacgccggcctgcccctgcccggcctgcccgccgagggcagccccccccccaagacctacgtgagctgcctgaagagcctgctgagcagccccaccaaggacagcaagcccaacatcagcgcccaccacatcagcctggccagctgcctggccctgaccacccccagcgaggagctgcccgacagagccggcatcctggtggaggacgccacctgcgtgacctgcatgagcgacagcagccagagcgtgcccctggtggccagccccggccactgcagcgacagcttcagcaccagcggcctggaggacagctgcaccgagaccagcagcagccccagagacaaggccatcaccccccccctgcccgagagcaccgtgcccttcagcaacggcgtgctgaagggcgagctgagcgacctgggcgccgaggacggctggaccatggacgccgaggccgaccacagcggcggcagcgacagaaacagcatggacagcgtggacagctgctgcagcctgaagaagaccgagagcttccagaacgcccaggccggcagcaaccccaagaaggtggacctgatcatctgggagatcgaggtgcccaagcacctggtgggcagactgatcggcaagcagggcagatacgtgagcttcctgaagcagaccagcggcgccaagatctacatcagcaccctgccctacacccagagcgtgcagatctgccacatcgagggcagccagcaccacgtggacaaggccctgaacctgatcggcaagaagttcaaggagctgaacctgaccaacatctacgccccccccctgcccagcctggccctgcccagcctgcccatgaccagctggctgatgctgcccgacggcatcaccgtggaggtgatcgtggtgaaccaggtgaacgccggccacctgttcgtgcagcagcacacccaccccaccttccacgccctgagaagcctggaccagcagatgtacctgtgctacagccagcccggcatccccaccctgcccacccccgtggagatcaccgtgatctgcgccgcccccggcgccgacggcgcctggtggagagcccaggtggtggccagctacgaggagaccaacgaggtggagatcagatacgtggactacggcggctacaagagagtgaaggtggacgtgctgagacagatcagaagcgacttcgtgaccctgcccttccagggcgccgaggtgctgctggacagcgtgatgcccctgagcgacgacgaccagttcagccccgaggccgacgccgccatgagcgagatgaccggcaacaccgccctgctggcccaggtgaccagctacagccccaccggcctgcccctgatccagctgtggagcgtggtgggcgacgaggtggtgctgatcaacagaagcctggtggagagaggcctggcccagtgggtggacagctactacaccagcctgtag

SEQ ID NO: 71269 - DNA, 2712 bp, Artificial Sequence; identical to SEQ ID NO: 71267
  Description of Artificial Sequence: Synthetic coding sequence

SEQ ID NO: 71270 - DNA, 1095 bp, Artificial Sequence
  Description of Artificial Sequence: Synthetic coding sequence
atgggcatcctggagaagatcagcgagatcgagaaggagatcgccagaacccagaagaacaaggccaccgagtaccacctgggcctgctgaaggccaagctggccaagtacagagcccagctgctggagcccagcaagagcgccagcagcaagggcgagggcttcgacgtgatgaagagcggcgacgccagagtggccctgatcggcttccccagcgtgggcaagagcaccttcctgagcctgatgaccagcaccgccagcgaggccgccagctacgagttcaccaccctgacctgcatccccggcgtgatcgagtacaagggcgccaacatccagctgctggacctgcccggcatcatcgagggcgccgcccagggcaagggcagaggcagacaggtgatcgccgtggccagaaccgccgacgtgatcatcatgatgctggacgccaccaagggcgaggtgcagagaagcctgctggagaaggagctggagagcgtgggcatcagactgaacaagcacaagcccaacatctacttcaagcccaagaagggcggcggcatcagcttcaacagcaccgtgaccctgacccagtgcagcgagaagctggtgcagctgatcctgcacgagtacaagatcttcaacgccgaggtgctgttcagagaggactgcagccccgacgagttcatcgacgtgatcgtgggcaacagagtgtacatgccctgcctgtacgtgtacaacaagatcgaccagatcagcatggaggaggtggacagactggccagaaagcccaacagcgtggtgatcagctgcggcatgaagctgaacctggactacctgctggagatgctgtgggagtacctggccctgacctgcatctacaccaagaagagaggccagagacccgacttcaccgacgccatcatcctgagaaagggcgccagcgtggagcacgtgtgccacagaatccacagaagcctggccagccagttcaagtacgccctggtgtggggcaccagcaccaagtacagcccccagagagtgggcctgacccacaccatggagcacgaggacgtgatccagatcgtgaagaagtag

SEQ ID NO: 71271 - DNA, 1815 bp, Artificial Sequence
  Description of Artificial Sequence: Synthetic coding sequence
atgagaggcgccggccccagccccagacagagccccagaaccctgagacccgaccccggccccgccatgagcttcttcagaagaaaggtgaagggcaaggagcaggagaagaccagcgacgtgaagagcatcaaggccagcatcagcgtgcacagcccccagaagagcaccaagaaccacgccctgctggaggccgccggccccagccacgtggccatcaacgccatcagcgccaacatggacagcttcagcagcagcagaaccgccaccctgaagaagcagcccagccacatggaggccgcccacttcggcgacctgggcagaagctgcctggactaccagacccaggagaccaagagcagcctgagcaagaccctggagcaggtgctgcacgacaccatcgtgctgccctacttcatccagttcatggagctgagaagaatggagcacctggtgaagttctggctggaggccgagagcttccacagcaccacctggagcagaatcagagcccacagcctgaacaccgtgaagcagagcagcctggccgagcccgtgagccccagcaagaagcacgagaccaccgccagcttcctgaccgacagcctggacaagagactggaggacagcggcagcgcccagctgttcatgacccacagcgagggcatcgacctgaacaacagaaccaacagcacccagaaccacctgctgctgagccaggagtgcgacagcgcccacagcctgagactggagatggccagagccggcacccaccaggtgagcatggagacccaggagagcagcagcaccctgaccgtggccagcagaaacagccccgccagccccctgaaggagctgagcggcaagctgatgaagagcatcgagcaggacgccgtgaacaccttcaccaagtacatcagccccgacgccgccaagcccatccccatcaccgaggccatgagaaacgacatcatcgccagaatctgcggcgaggacggccaggtggaccccaactgcttcgtgctggcccagagcatcgtgttcagcgccatggagcaggagcacttcagcgagttcctgagaagccaccacttctgcaagtaccagatcgaggtgctgaccagcggcaccgtgtacctggccgacatcctgttctgcgagagcgccctgttctacttcagcgagtacatggagaaggaggacgccgtgaacatcctgcagttctggctggccgccgacaacttccagagccagctggccgccaagaagggccagtacgacggccaggaggcccagaacgacgccatgatcctgtacgacaagtacttcagcctgcaggccacccaccccctgggcttcgacgacgtggtgagactggagatcgagagcaacatctgcagagagggcggccccctgcccaactgcttcaccacccccctgagacaggcctggaccaccatggagaagagcagcgtgaagaaggccagcatcaagatcctgaagaacttcgacgaggccatcatcgtggacgccgccagcctggaccccgagagcctgtaccagagaacctacgccggcaagatgaccttcggcagagtgagcgacctgggccagttcatcagagagagcgagcccgagcccgacgtgagaaagagcaagggcagcatgttcagccaggccatgaagaagtgggtgcagggcaacaccgacgaggcccaggaggagctggcctggaagatcgccaagatgatcgtgagcgacatcatgcagcaggcccagtacgaccagcccctggagaagagcaccaaggtgtag

SEQ ID NO: 71272 - DNA, 8454 bp, Artificial Sequence
  Description of Artificial Sequence: Synthetic coding sequence
atgaagctgaacccccagcaggcccccctgtacggcgactgcgtggtgaccgtgctgctggccgaggaggacaaggccgaggacgacgtggtgttctacctggtgttcctgggcagcaccctgagacactgcaccagcaccagaaaggtgagcagcgacaccctggagaccatcgcccccggccacgactgctgcgagaccgtgaaggtgcagctgtgcgccagcaaggagggcctgcccgtgttcgtggtggccgaggaggacttccacttcgtgcaggacgaggcctacgacgccgcccagttcctggccaccagcgccggcaaccagcaggccctgaacttcaccagattcctggaccagagcggcccccccagcggcgacgtgaacagcctggacaagaagctggtgctggccttcagacacctgaagctgcccaccgagtggaacgtgctgggcaccgaccagagcctgcacgacgccggccccagagagaccctgatgcacttcgccgtgagactgggcctgctgagactgacctggttcctgctgcagaagcccggcggcagaggcgccctgagcatccacaaccaggagggcgccacccccgtgagcctggccctggagagaggctaccacaagctgcaccagctgctgaccgaggagaacgccggcgagcccgacagctggagcagcctgagctacgagatcccctacggcgactgcagcgtgagacaccacagagagctggacatctacaccctgaccagcgagagcgacagccaccacgagcaccccttccccggcgacggctgcaccggccccatcttcaagctgatgaacatccagcagcagctgatgaagaccaacctgaagcagatggacagcctgatgcccctgatgatgaccgcccaggaccccagcagcgcccccgagaccgacggccagttcctgccctgcgcccccgagcccaccgacccccagagactgagcagcagcgaggagaccgagagcacccagtgctgccccggcagccccgtggcccagaccgagagcccctgcgacctgagcagcatcgtggaggaggagaacaccgacagaagctgcagaaagaagaacaagggcgtggagagaaagggcgaggaggtggagcccgcccccatcgtggacagcggcaccgtgagcgaccaggacagctgcctgcagagcctgcccgactgcggcgtgaagggcaccgagggcctgagcagctgcggcaacagaaacgaggagaccggcaccaagagcagcggcatgcccaccgaccaggagagcctgagcagcggcgacgccgtgctgcagagagacctggtgatggagcccggcaccgcccagtacagcagcggcggcgagctgggcggcatcagcaccaccaacgtgagcacccccgacaccgccggcgagatggagcacggcctgatgaaccccgacgccaccgtgtggaagaacgtgctgcagggcggcgagagcaccaaggagagattcgagaacagcaacatcggcaccgccggcgccagcgacgtgcacgtgaccagcaagcccgtggacaagatcagcgtgcccaactgcgcccccgccgccagcagcctggacggcaacaagcccgccgagagcagcctggccttcagcaacgaggagaccagcaccgagaagaccgccgagaccgagaccagcagaagcagagaggagagcgccgacgcccccgtggaccagaacagcgtggtgatccccgccgccgccaaggacaagatcagcgacggcctggagccctacaccctgctggccgccggcatcggcgaggccatgagccccagcgacctggccctgctgggcctggaggaggacgtgatgccccaccagaacagcgagaccaacagcagccacgcccagagccagaagggcaagagcagccccatctgcagcaccaccggcgacgacaagctgtgcgccgacagcgcctgccagcagaacaccgtgaccagcagcggcgacctggtggccaagctgtgcgacaacatcgtgagcgagagcgagagcaccaccgccagacagcccagcagccaggacccccccgacgccagccactgcgaggacccccaggcccacaccgtgaccagcgaccccgtgagagacacccaggagagagccgacttctgccccttcaaggtggtggacaacaagggccagagaaaggacgtgaagctggacaagcccctgaccaacatgctggaggtggtgagccacccccaccccgtggtgcccaagatggagaaggagctggtgcccgaccaggccgtgatcagcgacagcaccttcagcctggccaacagccccggcagcgagagcgtgaccaaggacgacgccctgagcttcgtgcccagccagaaggagaagggcaccgccacccccgagctgcacaccgccaccgactacagagacggccccgacggcaacagcaacgagcccgacaccagacccctggaggacagagccgtgggcctgagcaccagcagcaccgccgccgagctgcagcacggcatgggcaacaccagcctgaccggcctgggcggcgagcacgagggccccgccccccccgccatccccgaggccctgaacatcaagggcaacaccgacagcagcctgcagagcgtgggcaaggccaccctggccctggacagcgtgctgaccgaggagggcaagctgctggtggtgagcgagagcagcgccgcccaggagcaggacaaggacaaggccgtgacctgcagcagcatcaaggagaacgccctgagcagcggcaccctgcaggaggagcagagaacccccccccccggccaggacacccagcagttccacgagaagagcatcagcgccgactgcgccaaggacaaggccctgcagctgagcaacagccccggcgccagcagcgccttcctgaaggccgagaccgagcacaacaaggaggtggccccccaggtgagcctgctgacccagggcggcgccgcccagagcctggtgccccccggcgccagcctggccaccgagagcagacaggaggccctgggcgccgagcacaacagcagcgccctgctgccctgcctgctgcccgacggcagcgacggcagcgacgccctgaactgcagccagcccagccccctggacgtgggcgtgaagaacacccagagccagggcaagaccagcgcctgcgaggtgagcggcgacgtgaccgtggacgtgaccggcgtgaacgccctgcagggcatggccgagcccagaagagagaacatcagccacaacacccaggacatcctgatccccaacgtgctgctgagccaggagaagaacgccgtgctgggcctgcccgtggccctgcaggacaaggccgtgaccgacccccagggcgtgggcacccccgagatgatccccctggactgggagaagggcaagctggagggcgccgaccacagctgcaccatgggcgacgccgaggaggcccagatcgacgacgaggcccaccccgtgctgctgcagcccgtggccaaggagctgcccaccgacatggagctgagcgcccacgacgacggcgcccccgccggcgtgagagaggtgatgagagccccccccagcggcagagagagaagcacccccagcctgccctgcatggtgagcgcccaggacgcccccctgcccaagggcgccgacctgatcgaggaggccgccagcagaatcgtggacgccgtgatcgagcaggtgaaggccgccggcgccctgctgaccgagggcgaggcctgccacatgagcctgagcagccccgagctgggccccctgaccaagggcctggagagcgccttcaccgagaaggtgagcaccttcccccccggcgagagcctgcccatgggcagcacccccgaggaggccaccggcagcctggccggctgcttcgccggcagagaggagcccgagaagatcatcctgcccgtgcagggccccgagcccgccgccgagatgcccgacgtgaaggccgaggacgaggtggacttcagagccagcagcatcagcgaggaggtggccgtgggcagcatcgccgccaccctgaagatgaagcagggccccatgacccaggccatcaacagagagaactggtgcaccatcgagccctgccccgacgccgccagcctgctggccagcaagcagagccccgagtgcgagaacttcctggacgtgggcctgggcagagagtgcaccagcaagcagggcgtgctgaagagagagagcggcagcgacagcgacctgttccacagccccagcgacgacatggacagcatcatcttccccaagcccgaggaggagcacctggcctgcgacatcaccggcagcagcagcagcaccgacgacaccgccagcctggacagacacagcagccacggcagcgacgtgagcctgagccagatcctgaagcccaacagaagcagagacagacagagcctggacggcttctacagccacggcatgggcgccgagggcagagagagcgagagcgagcccgccgaccccggcgacgtggaggaggaggagatggacagcatcaccgaggtgcccgccaactgcagcgtgctgagaagcagcatgagaagcctgagccccttcagaagacacagctggggccccggcaagaacgccgccagcgacgccgagatgaaccacagaagcatgagctggtgccccagcggcgtgcagtacagcgccggcctgagcgccgacttcaactacagaagcttcagcctggagggcctgaccggcggcgccggcgtgggcaacaagcccagcagcagcctggaggtgagcagcgccaacgccgaggagctgagacaccccttcagcggcgaggagagagtggacagcctggtgagcctgagcgaggaggacctggagagcgaccagagagagcacagaatgttcgaccagcagatctgccacagaagcaagcagcagggcttcaactactgcaccagcgccatcagcagccccctgaccaagagcatcagcctgatgaccatcagccaccccggcctggacaacagcagacccttccacagcaccttccacaacaccagcgccaacctgaccgagagcatcaccgaggagaactacaacttcctgccccacagccccagcaagaaggacagcgagtggaagagcggcaccaaggtgagcagaaccttcagctacatcaagaacaagatgagcagcagcaagaagagcaaggagaaggagaaggagaaggacaagatcaaggagaaggagaaggacagcaaggacaaggagaaggacaagaagaccgtgaacggccacaccttcagcagcatccccgtggtgggccccatcagctgcagccagtgcatgaagcccttcaccaacaaggacgcctacacctgcgccaactgcagcgccttcgtgcacaagggctgcagagagagcctggccagctgcgccaaggtgaagatgaagcagcccaagggcagcctgcaggcccacgacaccagcagcctgcccaccgtgatcatgagaaacaagcccagccagcccaaggagagacccagaagcgccgtgctgctggtggacgagaccgccaccacccccatcttcgccaacagaagaagccagcagagcgtgagcctgagcaagagcgtgagcatccagaacatcaccggcgtgggcaacgacgagaacatgagcaacacctggaagttcctgagccacagcaccgacagcctgaacaagatcagcaaggtgaacgagagcaccgagagcctgaccgacgagggcgtgggcaccgacatgaacgagggccagctgctgggcgacttcgagatcgagagcaagcagctggaggccgagagctggagcagaatcatcgacagcaagttcctgaagcagcagaagaaggacgtggtgaagagacaggaggtgatctacgagctgatgcagaccgagttccaccacgtgagaaccctgaagatcatgagcggcgtgtacagccagggcatgatggccgacctgctgttcgagcagcagatggtggagaagctgttcccctgcctggacgagctgatcagcatccacagccagttcttccagagaatcctggagagaaagaaggagagcctggtggacaagagcgagaagaacttcctgatcaagagaatcggcgacgtgctggtgaaccagttcagcggcgagaacgccgagagactgaagaagacctacggcaagttctgcggccagcacaaccagagcgtgaactacttcaaggacctgtacgccaaggacaagagattccaggccttcgtgaagaagaagatgagcagcagcgtggtgagaagactgggcatccccgagtgcatcctgctggtgacccagagaatcaccaagtaccccgtgctgttccagagaatcctgcagtgcaccaaggacaacgaggtggagcaggaggacctggcccagagcctgagcctggtgaaggacgtgatcggcgccgtggacagcaaggtggccagctacgagaagaaggtgagactgaacgagatctacaccaagaccgacagcaagagcatcatgagaatgaagagcggccagatgttcgccaaggaggacctgaagagaaagaagctggtgagagacggcagcgtgttcctgaagaacgccgccggcagactgaaggaggtgcaggccgtgctgctgaccgacatcctggtgttcctgcaggagaaggaccagaagtacatcttcgccagcctggaccagaagagcaccgtgatcagcctgaagaagctgatcgtgagagaggtggcccacgaggagaagggcctgttcctgatcagcatgggcatgaccgaccccgagatggtggaggtgcacgccagcagcaaggaggagagaaacagctggatccagatcatccaggacaccatcaacaccctgaacagagacgaggacgagggcatccccagcgagaacgaggaggagaagaagatgctggacaccagagccagagagctgaaggagcagctgcaccagaaggaccagaagatcctgctgctgctggaggagaaggagatgatcttcagagacatggccgagtgcagcacccccctgcccgaggactgcagccccacccacagccccagagtgctgttcagaagcaacaccgaggaggccctgaagggcggccccctgatgaagagcgccatcaacgaggtggagatcctgcagggcctggtgagcggcaacctgggcggcaccctgggccccaccgtgagcagccccatcgagcaggacgtggtgggccccgtgagcctgcccagaagagccgagaccttcggcggcttcgacagccaccagatgaacgccagcaagggcggcgagaaggaggagggcgacgacggccaggacctgagaagaaccgagagcgacagcggcctgaagaagggcggcaacgccaacctggtgttcatgctgaagagaaacagcgagcaggtggtgcagagcgtggtgcacctgtacgagctgctgagcgccctgcagggcgtggtgctgcagcaggacagctacatcgaggaccagaagctggtgctgagcgagagagccctgaccagaagcctgagcagacccagcagcctgatcgagcaggagaagcagagaagcctggagaagcagagacaggacctggccaacctgcagaagcagcaggcccagtacctggaggagaagagaagaagagagagagagtgggaggccagagagagagagctgagagagagagaggccctgctggcccagagagaggaggaggtgcagcagggccagcaggacctggagaaggagagagaggagctgcagcagaagaagggcacctaccagtacgacctggagagactgagagccgcccagaagcagctggagagagagcaggagcagctgagaagagaggccgagagactgagccagagacagaccgagagagacctgtgccaggtgagccacccccacaccaagctgatgagaatccccagcttcttccccagccccgaggagccccccagccccagcgcccccagcatcgccaagagcggcagcctggacagcgagctgagcgtgagccccaagagaaacagcatcagcagaacccacaaggacaagggccccttccacatcctgagcagcaccagccagaccaacaagggccccgagggccagagccaggcccccgccagcaccagcgccagcaccagactgttcggcctgaccaagcccaaggagaagaaggagaagaagaagaagaacaagaccagcagaagccagcccggcgacggccccgccagcgaggtgagcgccgagggcgaggagatcttctgctag

SEQ ID NO: 71273 - DNA, 3177 bp, Artificial Sequence
  Description of Artificial Sequence: Synthetic coding sequence
atgagcagcagcaagaagagcaaggagaaggagaaggagaaggacaagatcaaggagaaggagaaggacagcaaggacaaggagaaggacaagaagaccgtgaacggccacaccttcagcagcatccccgtggtgggccccatcagctgcagccagtgcatgaagcccttcaccaacaaggacgcctacacctgcgccaactgcagcgccttcgtgcacaagggctgcagagagagcctggccagctgcgccaaggtgaagatgaagcagcccaagggcagcctgcaggcccacgacaccagcagcctgcccaccgtgatcatgagaaacaagcccagccagcccaaggagagacccagaagcgccgtgctgctggtggacgagaccgccaccacccccatcttcgccaacagaagaagccagcagagcgtgagcctgagcaagagcgtgagcatccagaacatcaccggcgtgggcaacgacgagaacatgagcaacacctggaagttcctgagccacagcaccgacagcctgaacaagatcagcaaggtgaacgagagcaccgagagcctgaccgacgagggcgtgggcaccgacatgaacgagggccagctgctgggcgacttcgagatcgagagcaagcagctggaggccgagagctggagcagaatcatcgacagcaagttcctgaagcagcagaagaaggacgtggtgaagagacaggaggtgatctacgagctgatgcagaccgagttccaccacgtgagaaccctgaagatcatgagcggcgtgtacagccagggcatgatggccgacctgctgttcgagcagcagatggtggagaagctgttcccctgcctggacgagctgatcagcatccacagccagttcttccagagaatcctggagagaaagaaggagagcctggtggacaagagcgagaagaacttcctgatcaagagaatcggcgacgtgctggtgaaccagttcagcggcgagaacgccgagagactgaagaagacctacggcaagttctgcggccagcacaaccagagcgtgaactacttcaaggacctgtacgccaaggacaagagattccaggccttcgtgaagaagaagatgagcagcagcgtggtgagaagactgggcatccccgagtgcatcctgctggtgacccagagaatcaccaagtaccccgtgctgttccagagaatcctgcagtgcaccaaggacaacgaggtggagcaggaggacctggcccagagcctgagcctggtgaaggacgtgatcggcgccgtggacagcaaggtggccagctacgagaagaaggtgagactgaacgagatctacaccaagaccgacagcaagagcatcatgagaatgaagagcggccagatgttcgccaaggaggacctgaagagaaagaagctggtgagagacggcagcgtgttcctgaagaacgccgccggcagactgaaggaggtgcaggccgtgctgctgaccgacatcctggtgttcctgcaggagaaggaccagaagtacatcttcgccagcctggaccagaagagcaccgtgatcagcctgaagaagctgatcgtgagagaggtggcccacgaggagaagggcctgttcctgatcagcatgggcatgaccgaccccgagatggtggaggtgcacgccagcagcaaggaggagagaaacagctggatccagatcatccaggacaccatcaacaccctgaacagagacgaggacgagggcatccccagcgagaacgaggaggagaagaagatgctggacaccagagccagagagctgaaggagcagctgcaccagaaggaccagaagatcctgctgctgctggaggagaaggagatgatcttcagagacatggccgagtgcagcacccccctgcccgaggactgcagccccacccacagccccagagtgctgttcagaagcaacaccgaggaggccctgaagggcggccccctgatgaagagcgccatcaacgaggtggagatcctgcagggcctggtgagcggcaacctgggcggcaccctgggccccaccgtgagcagccccatcgagcaggacgtggtgggccccgtgagcctgcccagaagagccgagaccttcggcggcttcgacagccaccagatgaacgccagcaagggcggcgagaaggaggagggcgacgacggccaggacctgagaagaaccgagagcgacagcggcctgaagaagggcggcaacgccaacctggtgttcatgctgaagagaaacagcgagcaggtggtgcagagcgtggtgcacctgtacgagctgctgagcgccctgcagggcgtggtgctgcagcaggacagctacatcgaggaccagaagctggtgctgagcgagagagccctgaccagaagcctgagcagacccagcagcctgatcgagcaggagaagcagagaagcctggagaagcagagacaggacctggccaacctgcagaagcagcaggcccagtacctggaggagaagagaagaagagagagagagtgggaggccagagagagagagctgagagagagagaggccctgctggcccagagagaggaggaggtgcagcagggccagcaggacctggagaaggagagagaggagctgcagcagaagaagggcacctaccagtacgacctggagagactgagagccgcccagaagcagctggagagagagcaggagcagctgagaagagaggccgagagactgagccagagacagaccgagagagacctgtgccaggtgagccacccccacaccaagctgatgagaatccccagcttcttccccagccccgaggagccccccagccccagcgcccccagcatcgccaagagcggcagcctggacagcgagctgagcgtgagccccaagagaaacagcatcagcagaacccacaaggacaagggccccttccacatcctgagcagcaccagccagaccaacaagggccccgagggccagagccaggcccccgccagcaccagcgccagcaccagactgttcggcctgaccaagcccaaggagaagaaggagaagaagaagaagaacaagaccagcagaagccagcccggcgacggccccgccagcgaggtgagcgccgagggcgaggagatcttctgctag

SEQ ID NO: 71274 - DNA, 8451 bp, Artificial Sequence
  Description of Artificial Sequence: Synthetic coding sequence
aagctgctggagaagcagccccccatcgagggcgactgcgtggtgaccgtgctgctggccgaggaggacaaggccgaggacgacgtggtgttctacctggtgttcctgggcagcaccctgagacactgcaccagcaccagaaaggtgagcagcgacaccctggagaccatcgcccccggccacgactgctgcgagaccgtgaaggtgcagctgtgcgccagcaaggagggcctgcccgtgttcgtggtggccgaggaggacttccacttcgtgcaggacgaggcctacgacgccgcccagttcctggccaccagcgccggcaaccagcaggccctgaacttcaccagattcctggaccagagcggcccccccagcggcgacgtgaacagcctggacaagaagctggtgctggccttcagacacctgaagctgcccaccgagtggaacgtgctgggcaccgaccagagcctgcacgacgccggccccagagagaccctgatgcacttcgccgtgagactgggcctgctgagactgacctggttcctgctgcagaagcccggcggcagaggcgccctgagcatccacaaccaggagggcgccacccccgtgagcctggccctggagagaggctaccacaagctgcaccagctgctgaccgaggagaacgccggcgagcccgacagctggagcagcctgagctacgagatcccctacggcgactgcagcgtgagacaccacagagagctggacatctacaccctgaccagcgagagcgacagccaccacgagcaccccttccccggcgacggctgcaccggccccatcttcaagctgatgaacatccagcagcagctgatgaagaccaacctgaagcagatggacagcctgatgcccctgatgatgaccgcccaggaccccagcagcgcccccgagaccgacggccagttcctgccctgcgcccccgagcccaccgacccccagagactgagcagcagcgaggagaccgagagcacccagtgctgccccggcagccccgtggcccagaccgagagcccctgcgacctgagcagcatcgtggaggaggagaacaccgacagaagctgcagaaagaagaacaagggcgtggagagaaagggcgaggaggtggagcccgcccccatcgtggacagcggcaccgtgagcgaccaggacagctgcctgcagagcctgcccgactgcggcgtgaagggcaccgagggcctgagcagctgcggcaacagaaacgaggagaccggcaccaagagcagcggcatgcccaccgaccaggagagcctgagcagcggcgacgccgtgctgcagagagacctggtgatggagcccggcaccgcccagtacagcagcggcggcgagctgggcggcatcagcaccaccaacgtgagcacccccgacaccgccggcgagatggagcacggcctgatgaaccccgacgccaccgtgtggaagaacgtgctgcagggcggcgagagcaccaaggagagattcgagaacagcaacatcggcaccgccggcgccagcgacgtgcacgtgaccagcaagcccgtggacaagatcagcgtgcccaactgcgcccccgccgccagcagcctggacggcaacaagcccgccgagagcagcctggccttcagcaacgaggagaccagcaccgagaagaccgccgagaccgagaccagcagaagcagagaggagagcgccgacgcccccgtggaccagaacagcgtggtgatccccgccgccgccaaggacaagatcagcgacggcctggagccctacaccctgctggccgccggcatcggcgaggccatgagccccagcgacctggccctgctgggcctggaggaggacgtgatgccccaccagaacagcgagaccaacagcagccacgcccagagccagaagggcaagagcagccccatctgcagcaccaccggcgacgacaagctgtgcgccgacagcgcctgccagcagaacaccgtgaccagcagcggcgacctggtggccaagctgtgcgacaacatcgtgagcgagagcgagagcaccaccgccagacagcccagcagccaggacccccccgacgccagccactgcgaggacccccaggcccacaccgtgaccagcgaccccgtgagagacacccaggagagagccgacttctgccccttcaaggtggtggacaacaagggccagagaaaggacgtgaagctggacaagcccctgaccaacatgctggaggtggtgagccacccccaccccgtggtgcccaagatggagaaggagctggtgcccgaccaggccgtgatcagcgacagcaccttcagcctggccaacagccccggcagcgagagcgtgaccaaggacgacgccctgagcttcgtgcccagccagaaggagaagggcaccgccacccccgagctgcacaccgccaccgactacagagacggccccgacggcaacagcaacgagcccgacaccagacccctggaggacagagccgtgggcctgagcaccagcagcaccgccgccgagctgcagcacggcatgggcaacaccagcctgaccggcctgggcggcgagcacgagggccccgccccccccgccatccccgaggccctgaacatcaagggcaacaccgacagcagcctgcagagcgtgggcaaggccaccctggccctggacagcgtgctgaccgaggagggcaagctgctggtggtgagcgagagcagcgccgcccaggagcaggacaaggacaaggccgtgacctgcagcagcatcaaggagaacgccctgagcagcggcaccctgcaggaggagcagagaacccccccccccggccaggacacccagcagttccacgagaagagcatcagcgccgactgcgccaaggacaaggccctgcagctgagcaacagccccggcgccagcagcgccttcctgaaggccgagaccgagcacaacaaggaggtggccccccaggtgagcctgctgacccagggcggcgccgcccagagcctggtgccccccggcgccagcctggccaccgagagcagacaggaggccctgggcgccgagcacaacagcagcgccctgctgccctgcctgctgcccgacggcagcgacggcagcgacgccctgaactgcagccagcccagccccctggacgtgggcgtgaagaacacccagagccagggcaagaccagcgcctgcgaggtgagcggcgacgtgaccgtggacgtgaccggcgtgaacgccctgcagggcatggccgagcccagaagagagaacatcagccacaacacccaggacatcctgatccccaacgtgctgctgagccaggagaagaacgccgtgctgggcctgcccgtggccctgcaggacaaggccgtgaccgacccccagggcgtgggcacccccgagatgatccccctggactgggagaagggcaagctggagggcgccgaccacagctgcaccatgggcgacgccgaggaggcccagatcgacgacgaggcccaccccgtgctgctgcagcccgtggccaaggagctgcccaccgacatggagctgagcgcccacgacgacggcgcccccgccggcgtgagagaggtgatgagagccccccccagcggcagagagagaagcacccccagcctgccctgcatggtgagcgcccaggacgcccccctgcccaagggcgccgacctgatcgaggaggccgccagcagaatcgtggacgccgtgatcgagcaggtgaaggccgccggcgccctgctgaccgagggcgaggcctgccacatgagcctgagcagccccgagctgggccccctgaccaagggcctggagagcgccttcaccgagaaggtgagcaccttcccccccggcgagagcctgcccatgggcagcacccccgaggaggccaccggcagcctggccggctgcttcgccggcagagaggagcccgagaagatcatcctgcccgtgcagggccccgagcccgccgccgagatgcccgacgtgaaggccgaggacgaggtggacttcagagccagcagcatcagcgaggaggtggccgtgggcagcatcgccgccaccctgaagatgaagcagggccccatgacccaggccatcaacagagagaactggtgcaccatcgagccctgccccgacgccgccagcctgctggccagcaagcagagccccgagtgcgagaacttcctggacgtgggcctgggcagagagtgcaccagcaagcagggcgtgctgaagagagagagcggcagcgacagcgacctgttccacagccccagcgacgacatggacagcatcatcttccccaagcccgaggaggagcacctggcctgcgacatcaccggcagcagcagcagcaccgacgacaccgccagcctggacagacacagcagccacggcagcgacgtgagcctgagccagatcctgaagcccaacagaagcagagacagacagagcctggacggcttctacagccacggcatgggcgccgagggcagagagagcgagagcgagcccgccgaccccggcgacgtggaggaggaggagatggacagcatcaccgaggtgcccgccaactgcagcgtgctgagaagcagcatgagaagcctgagccccttcagaagacacagctggggccccggcaagaacgccgccagcgacgccgagatgaaccacagaagcatgagctggtgccccagcggcgtgcagtacagcgccggcctgagcgccgacttcaactacagaagcttcagcctggagggcctgaccggcggcgccggcgtgggcaacaagcccagcagcagcctggaggtgagcagcgccaacgccgaggagctgagacaccccttcagcggcgaggagagagtggacagcctggtgagcctgagcgaggaggacctggagagcgaccagagagagcacagaatgttcgaccagcagatctgccacagaagcaagcagcagggcttcaactactgcaccagcgccatcagcagccccctgaccaagagcatcagcctgatgaccatcagccaccccggcctggacaacagcagacccttccacagcaccttccacaacaccagcgccaacctgaccgagagcatcaccgaggagaactacaacttcctgccccacagccccagcaagaaggacagcgagtggaagagcggcaccaaggtgagcagaaccttcagctacatcaagaacaagatgagcagcagcaagaagagcaaggagaaggagaaggagaaggacaagatcaaggagaaggagaaggacagcaaggacaaggagaaggacaagaagaccgtgaacggccacaccttcagcagcatccccgtggtgggccccatcagctgcagccagtgcatgaagcccttcaccaacaaggacgcctacacctgcgccaactgcagcgccttcgtgcacaagggctgcagagagagcctggccagctgcgccaaggtgaagatgaagcagcccaagggcagcctgcaggcccacgacaccagcagcctgcccaccgtgatcatgagaaacaagcccagccagcccaaggagagacccagaagcgccgtgctgctggtggacgagaccgccaccacccccatcttcgccaacagaagaagccagcagagcgtgagcctgagcaagagcgtgagcatccagaacatcaccggcgtgggcaacgacgagaacatgagcaacacctggaagttcctgagccacagcaccgacagcctgaacaagatcagcaaggtgaacgagagcaccgagagcctgaccgacgagggcgtgggcaccgacatgaacgagggccagctgctgggcgacttcgagatcgagagcaagcagctggaggccgagagctggagcagaatcatcgacagcaagttcctgaagcagcagaagaaggacgtggtgaagagacaggaggtgatctacgagctgatgcagaccgagttccaccacgtgagaaccctgaagatcatgagcggcgtgtacagccagggcatgatggccgacctgctgttcgagcagcagatggtggagaagctgttcccctgcctggacgagctgatcagcatccacagccagttcttccagagaatcctggagagaaagaaggagagcctggtggacaagagcgagaagaacttcctgatcaagagaatcggcgacgtgctggtgaaccagttcagcggcgagaacgccgagagactgaagaagacctacggcaagttctgcggccagcacaaccagagcgtgaactacttcaaggacctgtacgccaaggacaagagattccaggccttcgtgaagaagaagatgagcagcagcgtggtgagaagactgggcatccccgagtgcatcctgctggtgacccagagaatcaccaagtaccccgtgctgttccagagaatcctgcagtgcaccaaggacaacgaggtggagcaggaggacctggcccagagcctgagcctggtgaaggacgtgatcggcgccgtggacagcaaggtggccagctacgagaagaaggtgagactgaacgagatctacaccaagaccgacagcaagagcatcatgagaatgaagagcggccagatgttcgccaaggaggacctgaagagaaagaagctggtgagagacggcagcgtgttcctgaagaacgccgccggcagactgaaggaggtgcaggccgtgctgctgaccgacatcctggtgttcctgcaggagaaggaccagaagtacatcttcgccagcctggaccagaagagcaccgtgatcagcctgaagaagctgatcgtgagagaggtggcccacgaggagaagggcctgttcctgatcagcatgggcatgaccgaccccgagatggtggaggtgcacgccagcagcaaggaggagagaaacagctggatccagatcatccaggacaccatcaacaccctgaacagagacgaggacgagggcatccccagcgagaacgaggaggagaagaagatgctggacaccagagccagagagctgaaggagcagctgcaccagaaggaccagaagatcctgctgctgctggaggagaaggagatgatcttcagagacatggccgagtgcagcacccccctgcccgaggactgcagccccacccacagccccagagtgctgttcagaagcaacaccgaggaggccctgaagggcggccccctgatgaagagcgccatcaacgaggtggagatcctgcagggcctggtgagcggcaacctgggcggcaccctgggccccaccgtgagcagccccatcgagcaggacgtggtgggccccgtgagcctgcccagaagagccgagaccttcggcggcttcgacagccaccagatgaacgccagcaagggcggcgagaaggaggagggcgacgacggccaggacctgagaagaaccgagagcgacagcggcctgaagaagggcggcaacgccaacctggtgttcatgctgaagagaaacagcgagcaggtggtgcagagcgtggtgcacctgtacgagctgctgagcgccctgcagggcgtggtgctgcagcaggacagctacatcgaggaccagaagctggtgctgagcgagagagccctgaccagaagcctgagcagacccagcagcctgatcgagcaggagaagcagagaagcctggagaagcagagacaggacctggccaacctgcagaagcagcaggcccagtacctggaggagaagagaagaagagagagagagtgggaggccagagagagagagctgagagagagagaggccctgctggcccagagagaggaggaggtgcagcagggccagcaggacctggagaaggagagagaggagctgcagcagaagaagggcacctaccagtacgacctggagagactgagagccgcccagaagcagctggagagagagcaggagcagctgagaagagaggccgagagactgagccagagacagaccgagagagacctgtgccaggtgagccacccccacaccaagctgatgagaatccccagcttcttccccagccccgaggagccccccagccccagcgcccccagcatcgccaagagcggcagcctggacagcgagctgagcgtgagccccaagagaaacagcatcagcagaacccacaaggacaagggccccttccacatcctgagcagcaccagccagaccaacaagggccccgagggccagagccaggcccccgccagcaccagcgccagcaccagactgttcggcctgaccaagcccaaggagaagaaggagaagaagaagaagaacaagaccagcagaagccagcccggcgacggccccgccagcgaggtgagcgccgagggcgaggagatcttctgctag

SEQ ID NO: 71275 - DNA, 8442 bp, Artificial Sequence
  Description of Artificial Sequence: Synthetic coding sequence
atgaagctgaacccccagcaggcccccctgtacggcgactgcgtggtgaccgtgctgctggccgaggaggacaaggccgaggacgacgtggtgttctacctggtgttcctgggcagcaccctgagacactgcaccagcaccagaaaggtgagcagcgacaccctggagaccatcgcccccggccacgactgctgcgagaccgtgaaggtgcagctgtgcgccagcaaggagggcctgcccgtgttcgtggtggccgaggaggacttccacttcgtgcaggacgaggcctacgacgccgcccagttcctggccaccagcgccggcaaccagcaggccctgaacttcaccagattcctggaccagagcggcccccccagcggcgacgtgaacagcctggacaagaagctggtgctggccttcagacacctgaagctgcccaccgagtggaacgtgctgggcaccgaccagagcctgcacgacgccggccccagagagaccctgatgcacttcgccgtgagactgggcctgctgagactgacctggttcctgctgcagaagcccggcggcagaggcgccctgagcatccacaaccaggagggcgccacccccgtgagcctggccctggagagaggctaccacaagctgcaccagctgctgaccgaggagaacgccggcgagcccgacagctggagcagcctgagctacgagatcccctacggcgactgcagcgtgagacaccacagagagctggacatctacaccctgaccagcgagagcgacagccaccacgagcaccccttccccggcgacggctgcaccggccccatcttcaagctgatgaacatccagcagcagctgatgaagaccaacctgaagcagatggacagcctgatgcccctgatgatgaccgcccaggaccccagcagcgcccccgagaccgacggccagttcctgccctgcgcccccgagcccaccgacccccagagactgagcagcagcgaggagaccgagagcacccagtgctgccccggcagccccgtggcccagaccgagagcccctgcgacctgagcagcatcgtggaggaggagaacaccgacagaagctgcagaaagaagaacaagggcgtggagagaaagggcgaggaggtggagcccgcccccatcgtggacagcggcaccgtgagcgaccaggacagctgcctgcagagcctgcccgactgcggcgtgaagggcaccgagggcctgagcagctgcggcaacagaaacgaggagaccggcaccaagagcagcggcatgcccaccgaccaggagagcctgagcagcggcgacgccgtgctgcagagagacctggtgatggagcccggcaccgcccagtacagcagcggcggcgagctgggcggcatcagcaccaccaacgtgagcacccccgacaccgccggcgagatggagcacggcctgatgaaccccgacgccaccgtgtggaagaacgtgctgcagggcggcgagagcaccaaggagagattcgagaacagcaacatcggcaccgccggcgccagcgacgtgcacgtgaccagcaagcccgtggacaagatcagcgtgcccaactgcgcccccgccgccagcagcctggacggcaacaagcccgccgagagcagcctggccttcagcaacgaggagaccagcaccgagaagaccgccgagaccgagaccagcagaagcagagaggagagcgccgacgcccccgtggaccagaacagcgtggtgatccccgccgccgccaaggacaagatcagcgacggcctggagccctacaccctgctggccgccggcatcggcgaggccatgagccccagcgacctggccctgctgggcctggaggaggacgtgatgccccaccagaacagcgagaccaacagcagccacgcccagagccagaagggcaagagcagccccatctgcagcaccaccggcgacgacaagctgtgcgccgacagcgcctgccagcagaacaccgtgaccagcagcggcgacctggtggccaagctgtgcgacaacatcgtgagcgagagcgagagcaccaccgccagacagcccagcagccaggacccccccgacgccagccactgcgaggacccccaggcccacaccgtgaccagcgaccccgtgagagacacccaggagagagccgacttctgccccttcaaggtggtggacaacaagggccagagaaaggacgtgaagctggacaagcccctgaccaacatgctggaggtggtgagccacccccaccccgtggtgcccaagatggagaaggagctggtgcccgaccaggccgtgatcagcgacagcaccttcagcctggccaacagccccggcagcgagagcgtgaccaaggacgacgccctgagcttcgtgcccagccagaaggagaagggcaccgccacccccgagctgcacaccgccaccgactacagagacggccccgacggcaacagcaacgagcccgacaccagacccctggaggacagagccgtgggcctgagcaccagcagcaccgccgccgagctgcagcacggcatgggcaacaccagcctgaccggcctgggcggcgagcacgagggccccgccccccccgccatccccgaggccctgaacatcaagggcaacaccgacagcagcctgcagagcgtgggcaaggccaccctggccctggacagcgtgctgaccgaggagggcaagctgctggtggtgagcgagagcagcgccgcccaggagcaggacaaggacaaggccgtgacctgcagcagcatcaaggagaacgccctgagcagcggcaccctgcaggaggagcagagaacccccccccccggccaggacacccagcagttccacgagaagagcatcagcgccgactgcgccaaggacaaggccctgcagctgagcaacagccccggcgccagcagcgccttcctgaaggccgagaccgagcacaacaaggaggtggccccccaggtgagcctgctgacccagggcggcgccgcccagagcctggtgccccccggcgccagcctggccaccgagagcagacaggaggccctgggcgccgagcacaacagcagcgccctgctgccctgcctgctgcccgacggcagcgacggcagcgacgccctgaactgcagccagcccagccccctggacgtgggcgtgaagaacacccagagccagggcaagaccagcgcctgcgaggtgagcggcgacgtgaccgtggacgtgaccggcgtgaacgccctgcagggcatggccgagcccagaagagagaacatcagccacaacacccaggacatcctgatccccaacgtgctgctgagccaggagaagaacgccgtgctgggcctgcccgtggccctgcaggacaaggccgtgaccgacccccagggcgtgggcacccccgagatgatccccctggactgggagaagggcaagctggagggcgccgaccacagctgcaccatgggcgacgccgaggaggcccagatcgacgacgaggcccaccccgtgctgctgcagcccgtggccaaggagctgcccaccgacatggagctgagcgcccacgacgacggcgcccccgccggcgtgagagaggtgatgagagccccccccagcggcagagagagaagcacccccagcctgccctgcatggtgagcgcccaggacgcccccctgcccaagggcgccgacctgatcgaggaggccgccagcagaatcgtggacgccgtgatcgagcaggtgaaggccgccggcgccctgctgaccgagggcgaggcctgccacatgagcctgagcagccccgagctgggccccctgaccaagggcctggagagcgccttcaccgagaaggtgagcaccttcccccccggcgagagcctgcccatgggcagcacccccgaggaggccaccggcagcctggccggctgcttcgccggcagagaggagcccgagaagatcatcctgcccgtgcagggccccgagcccgccgccgagatgcccgacgtgaaggccgaggacgaggtggacttcagagccagcagcatcagcgaggaggtggccgtgggcagcatcgccgccaccctgaagatgaagcagggccccatgacccaggccatcaacagagagaactggtgcaccatcgagccctgccccgacgccgccagcctgctggccagcaagcagagccccgagtgcgagaacttcctggacgtgggcctgggcagagagtgcaccagcaagcagggcgtgctgaagagagagagcggcagcgacagcgacctgttccacagccccagcgacgacatggacagcatcatcttccccaagcccgaggaggagcacctggcctgcgacatcaccggcagcagcagcagcaccgacgacaccgccagcctggacagacacagcagccacggcagcgacgtgagcctgagccagatcctgaagcccaacagaagcagagacagacagagcctggacggcttctacagccacggcatgggcgccgagggcagagagagcgagagcgagcccgccgaccccggcgacgtggaggaggaggagatggacagcatcaccgaggtgcccgccaactgcagcgtgctgagaagcagcatgagaagcctgagccccttcagaagacacagctggggccccggcaagaacgccgccagcgacgccgagatgaaccacagaagcagcatgagagtgctgggcgacgtggtgagaagaccccccatccacagaagaagcttcagcctggagggcctgaccggcggcgccggcgtgggcaacaagcccagcagcagcctggaggtgagcagcgccaacgccgaggagctgagacaccccttcagcggcgaggagagagtggacagcctggtgagcctgagcgaggaggacctggagagcgaccagagagagcacagaatgttcgaccagcagatctgccacagaagcaagcagcagggcttcaactactgcaccagcgccatcagcagccccctgaccaagagcatcagcctgatgaccatcagccaccccggcctggacaacagcagacccttccacagcaccttccacaacaccagcgccaacctgaccgagagcatcaccgaggagaactacaacttcctgccccacagccccagcaagaaggacagcgagtggaagagcggcaccaaggtgagcagaaccttcagctacatcaagaacaagatgagcagcagcaagaagagcaaggagaaggagaaggagaaggacaagatcaaggagaaggagaaggacagcaaggacaaggagaaggacaagaagaccgtgaacggccacaccttcagcagcatccccgtggtgggccccatcagctgcagccagtgcatgaagcccttcaccaacaaggacgcctacacctgcgccaactgcagcgccttcgtgcacaagggctgcagagagagcctggccagctgcgccaaggtgaagatgaagcagcccaagggcagcctgcaggcccacgacaccagcagcctgcccaccgtgatcatgagaaacaagcccagccagcccaaggagagacccagaagcgccgtgctgctggtggacgagaccgccaccacccccatcttcgccaacagaagaagccagcagagcgtgagcctgagcaagagcgtgagcatccagaacatcaccggcgtgggcaacgacgagaacatgagcaacacctggaagttcctgagccacagcaccgacagcctgaacaagatcagcaaggtgaacgagagcaccgagagcctgaccgacgagggcgtgggcaccgacatgaacgagggccagctgctgggcgacttcgagatcgagagcaagcagctggaggccgagagctggagcagaatcatcgacagcaagttcctgaagcagcagaagaaggacgtggtgaagagacaggaggtgatctacgagctgatgcagaccgagttccaccacgtgagaaccctgaagatcatgagcggcgtgtacagccagggcatgatggccgacctgctgttcgagcagcagatggtggagaagctgttcccctgcctggacgagctgatcagcatccacagccagttcttccagagaatcctggagagaaagaaggagagcctggtggacaagagcgagaagaacttcctgatcaagagaatcggcgacgtgctggtgaaccagttcagcggcgagaacgccgagagactgaagaagacctacggcaagttctgcggccagcacaaccagagcgtgaactacttcaaggacctgtacgccaaggacaagagattccaggccttcgtgaagaagaagatgagcagcagcgtggtgagaagactgggcatccccgagtgcatcctgctggtgacccagagaatcaccaagtaccccgtgctgttccagagaatcctgcagtgcaccaaggacaacgaggtggagcaggaggacctggcccagagcctgagcctggtgaaggacgtgatcggcgccgtggacagcaaggtggccagctacgagaagaaggtgagactgaacgagatctacaccaagaccgacagcaagagcatcatgagaatgaagagcggccagatgttcgccaaggaggacctgaagagaaagaagctggtgagagacggcagcgtgttcctgaagaacgccgccggcagactgaaggaggtgcaggccgtgctgctgaccgacatcctggtgttcctgcaggagaaggaccagaagtacatcttcgccagcctggaccagaagagcaccgtgatcagcctgaagaagctgatcgtgagagaggtggcccacgaggagaagggcctgttcctgatcagcatgggcatgaccgaccccgagatggtggaggtgcacgccagcagcaaggaggagagaaacagctggatccagatcatccaggacaccatcaacaccctgaacagagacgaggacgagggcatccccagcgagaacgaggaggagaagaagatgctggacaccagagccagagagctgaaggagcagctgcaccagaaggaccagaagatcctgctgctgctggaggagaaggagatgatcttcagagacatggccgagtgcagcacccccctgcccgaggactgcagccccacccacagccccagagtgctgttcagaagcaacaccgaggaggccctgaagggcggccccctgatgaagagcgccatcaacgaggtggagatcctgcagggcctggtgagcggcaacctgggcggcaccctgggccccaccgtgagcagccccatcgagcaggacgtggtgggccccgtgagcctgcccagaagagccgagaccttcggcggcttcgacagccaccagatgaacgccagcaagggcggcgagaaggaggagggcgacgacggccaggacctgagaagaaccgagagcgacagcggcctgaagaagggcggcaacgccaacctggtgttcatgctgaagagaaacagcgagcaggtggtgcagagcgtggtgcacctgtacgagctgctgagcgccctgcagggcgtggtgctgcagcaggacagctacatcgaggaccagaagctggtgctgagcgagagagccctgaccagaagcctgagcagacccagcagcctgatcgagcaggagaagcagagaagcctggagaagcagagacaggacctggccaacctgcagaagcagcaggcccagtacctggaggagaagagaagaagagagagagagtgggaggccagagagagagagctgagagagagagaggccctgctggcccagagagaggaggaggtgcagcagggccagcaggacctggagaaggagagagaggagctgcagcagaagaagggcacctaccagtacgacctggagagactgagagccgcccagaagcagctggagagagagcaggagcagctgagaagagaggccgagagactgagccagagacagaccgagagagacctgtgccaggtgagccacccccacaccaagctgatgagaatccccagcttcttccccagccccgaggagccccccagccccagcgcccccagcatcgccaagagcggcagcctggacagcgagctgagcgtgagccccaagagaaacagcatcagcagaacccacaaggacaagggccccttccacatcctgagcagcaccagccagaccaacaagggccccgagggccagagccaggcccccgccagcaccagcgccagcaccagactgttcggcctgaccaagcccaaggagaagaaggagaagaagaagaagaacaagaccagcagaagccagcccggcgacggccccgccagcgaggtgagcgccgagggcgaggagatcttctgctag

SEQ ID NO: 71276 - DNA, 1245 bp, Artificial Sequence
  Description of Artificial Sequence: Synthetic coding sequence
atgagcaacacctggaagttcctgagccacagcaccgacagcctgaacaagatcagcaaggtgaacgagagcaccgagagcctgaccgacgagggcaccgacatgaacgagggccagctgctgggcgacttcgagatcgagagcaagcagctggaggccgagagctggagcagaatcatcgacagcaagttcctgaagcagcagaagaaggacgtggtgaagagacaggaggtgatctacgagctgatgcagaccgagttccaccacgtgagaaccctgaagatcatgagcggcgtgtacagccagggcatgatggccgacctgctgttcgagcagcagatggtggagaagctgttcccctgcctggacgagctgatcagcatccacagccagttcttccagagaatcctggagagaaagaaggagagcctggtggacaagagcgagaagaacttcctgatcaagagaatcggcgacgtgctggtgaaccagttcagcggcgagaacgccgagagactgaagaagacctacggcaagttctgcggccagcacaaccagagcgtgaactacttcaaggacctgtacgccaaggacaagagattccaggccttcgtgaagaagaagatgagcagcagcgtggtgagaagactgggcatccccgagtgcatcctgctggtgacccagagaatcaccaagtaccccgtgctgttccagagaatcctgcagtgcaccaaggacaacgaggtggagcaggaggacctggcccagagcctgagcctggtgaaggacgtgatcggcgccgtggacagcaaggtggccagctacgagaagaaggtgagactgaacgagatctacaccaagaccgacagcaagagcatcatgagaatgaagagcggccagatgttcgccaaggaggacctgaagagaaagaagctggtgagagacggcagcgtgttcctgaagaacgccgccggcagactgaaggaggtgcaggccgtgctgctgaccgacatcctggtgttcctgcaggagaaggaccagaagtacatcttcgccagcctggaccagaagagcaccgtgatcagcctgaagaagctgatcgtgagagaggtggcccacgaggagaagggcctgttcctgatcagcatgggcatgaccgaccccgagatggtggaggtgcacgccagcagcaaggaggagagaaacagctggatccagatcatccaggacaccatcaacacctag

SEQ ID NO: 71277 - DNA, 1158 bp, Artificial Sequence
  Description of Artificial Sequence: Synthetic coding sequence
atgtacgagagacacaagagaagatacagcctgtgcgacatcagcaaggtggacagaaccgtggacgtggtgctgctgaagatcaacagagagaactggtgcaccatcgagccctgccccgacgccgccagcctgctggccagcaagcagagccccgagtgcgagaacttcctggacgtgggcctgggcagagagtgcaccagcaagcagggcgtgctgaagagagagagcggcagcgacagcgacctgttccacagccccagcgacgacatggacagcatcatcttccccaagcccgaggaggagcacctggcctgcgacatcaccggcagcagcagcagcaccgacgacaccgccagcctggacagacacagcagccacggcagcgacgtgagcctgagccagatcctgaagcccaacagaagcagagacagacagagcctggacggcttctacagccacggcatgggcgccgagggcagagagagcgagagcgagcccgccgaccccggcgacgtggaggaggaggagatggacagcatcaccgaggtgcccgccaactgcagcgtgctgagaagcagcatgagaagcctgagccccttcagaagacacagctggggccccggcaagaacgccgccagcgacgccgagatgaaccacagaagcttcagcctggagggcctgaccggcggcgccggcgtgggcaacaagcccagcagcagcctggaggtgagcagcgccaacgccgaggagctgagacaccccttcagcggcgaggagagagtggacagcctggtgagcctgagcgaggaggacctggagagcgaccagagagagcacagaatgttcgaccagcagatctgccacagaagcaagcagcagggcttcaactactgcaccagcgccatcagcagccccctgaccaagagcatcagcctgatgaccatcagccaccccggcctggacaacagcagacccttccacagcaccttccacaacaccagcgccaacctgaccgagagcatcaccgaggagaactacaacttcctgccccacagccccagcaagaaggacagcgagtggaagagcggcaccaaggtgagcagaaccttcagctacatcaagaacaagatgagcagcagcaagaagagcaagtag

SEQ ID NO: 71278 - DNA, 8379 bp, Artificial Sequence
  Description of Artificial Sequence: Synthetic coding sequence
aagctgctggagaagcagccccccatcgagggcgactgcgtggtgaccgtgctgctggccgaggaggacaaggccgaggacgacgtggtgttctacctggtgttcctgggcagcaccctgagacactgcaccagcaccagaaaggtgagcagcgacaccctggagaccatcgcccccggccacgactgctgcgagaccgtgaaggtgcagctgtgcgccagcaaggagggcctgcccgtgttcgtggtggccgaggaggacttccacttcgtgcaggacgaggcctacgacgccgcccagttcctggccaccagcgccggcaaccagcaggccctgaacttcaccagattcctggaccagagcggcccccccagcggcgacgtgaacagcctggacaagaagctggtgctggccttcagacacctgaagctgcccaccgagtggaacgtgctgggcaccgaccagagcctgcacgacgccggccccagagagaccctgatgcacttcgccgtgagactgggcctgctgagactgacctggttcctgctgcagaagcccggcggcagaggcgccctgagcatccacaaccaggagggcgccacccccgtgagcctggccctggagagaggctaccacaagctgcaccagctgctgaccgaggagaacgccggcgagcccgacagctggagcagcctgagctacgagatcccctacggcgactgcagcgtgagacaccacagagagctggacatctacaccctgaccagcgagagcgacagccaccacgagcaccccttccccggcgacggctgcaccggccccatcttcaagctgatgaacatccagcagcagctgatgaagaccaacctgaagcagatggacagcctgatgcccctgatgatgaccgcccaggaccccagcagcgcccccgagaccgacggccagttcctgccctgcgcccccgagcccaccgacccccagagactgagcagcagcgaggagaccgagagcacccagtgctgccccggcagccccgtggcccagaccgagagcccctgcgacctgagcagcatcgtggaggaggagaacaccgacagaagctgcagaaagaagaacaagggcgtggagagaaagggcgaggaggtggagcccgcccccatcgtggacagcggcaccgtgagcgaccaggacagctgcctgcagagcctgcccgactgcggcgtgaagggcaccgagggcctgagcagctgcggcaacagaaacgaggagaccggcaccaagagcagcggcatgcccaccgaccaggagagcctgagcagcggcgacgccgtgctgcagagagacctggtgatggagcccggcaccgcccagtacagcagcggcggcgagctgggcggcatcagcaccaccaacgtgagcacccccgacaccgccggcgagatggagcacggcctgatgaaccccgacgccaccgtgtggaagaacgtgctgcagggcggcgagagcaccaaggagagattcgagaacagcaacatcggcaccgccggcgccagcgacgtgcacgtgaccagcaagcccgtggacaagatcagcgtgcccaactgcgcccccgccgccagcagcctggacggcaacaagcccgccgagagcagcctggccttcagcaacgaggagaccagcaccgagaagaccgccgagaccgagaccagcagaagcagagaggagagcgccgacgcccccgtggaccagaacagcgtggtgatccccgccgccgccaaggacaagatcagcgacggcctggagccctacaccctgctggccgccggcatcggcgaggccatgagccccagcgacctggccctgctgggcctggaggaggacgtgatgccccaccagaacagcgagaccaacagcagccacgcccagagccagaagggcaagagcagccccatctgcagcaccaccggcgacgacaagctgtgcgccgacagcgcctgccagcagaacaccgtgaccagcagcggcgacctggtggccaagctgtgcgacaacatcgtgagcgagagcgagagcaccaccgccagacagcccagcagccaggacccccccgacgccagccactgcgaggacccccaggcccacaccgtgaccagcgaccccgtgagagacacccaggagagagccgacttctgccccttcaaggtggtggacaacaagggccagagaaaggacgtgaagctggacaagcccctgaccaacatgctggaggtggtgagccacccccaccccgtggtgcccaagatggagaaggagctggtgcccgaccaggccgtgatcagcgacagcaccttcagcctggccaacagccccggcagcgagagcgtgaccaaggacgacgccctgagcttcgtgcccagccagaaggagaagggcaccgccacccccgagctgcacaccgccaccgactacagagacggccccgacggcaacagcaacgagcccgacaccagacccctggaggacagagccgtgggcctgagcaccagcagcaccgccgccgagctgcagcacggcatgggcaacaccagcctgaccggcctgggcggcgagcacgagggccccgccccccccgccatccccgaggccctgaacatcaagggcaacaccgacagcagcctgcagagcgtgggcaaggccaccctggccctggacagcgtgctgaccgaggagggcaagctgctggtggtgagcgagagcagcgccgcccaggagcaggacaaggacaaggccgtgacctgcagcagcatcaaggagaacgccctgagcagcggcaccctgcaggaggagcagagaacccccccccccggccaggacacccagcagttccacgagaagagcatcagcgccgactgcgccaaggacaaggccctgcagctgagcaacagccccggcgccagcagcgccttcctgaaggccgagaccgagcacaacaaggaggtggccccccaggtgagcctgctgacccagggcggcgccgcccagagcctggtgccccccggcgccagcctggccaccgagagcagacaggaggccctgggcgccgagcacaacagcagcgccctgctgccctgcctgctgcccgacggcagcgacggcagcgacgccctgaactgcagccagcccagccccctggacgtgggcgtgaagaacacccagagccagggcaagaccagcgcctgcgaggtgagcggcgacgtgaccgtggacgtgaccggcgtgaacgccctgcagggcatggccgagcccagaagagagaacatcagccacaacacccaggacatcctgatccccaacgtgctgctgagccaggagaagaacgccgtgctgggcctgcccgtggccctgcaggacaaggccgtgaccgacccccagggcgtgggcacccccgagatgatccccctggactgggagaagggcaagctggagggcgccgaccacagctgcaccatgggcgacgccgaggaggcccagatcgacgacgaggcccaccccgtgctgctgcagcccgtggccaaggagctgcccaccgacatggagctgagcgcccacgacgacggcgcccccgccggcgtgagagaggtgatgagagccccccccagcggcagagagagaagcacccccagcctgccctgcatggtgagcgcccaggacgcccccctgcccaagggcgccgacctgatcgaggaggccgccagcagaatcgtggacgccgtgatcgagcaggtgaaggccgccggcgccctgctgaccgagggcgaggcctgccacatgagcctgagcagccccgagctgggccccctgaccaagggcctggagagcgccttcaccgagaaggtgagcaccttcccccccggcgagagcctgcccatgggcagcacccccgaggaggccaccggcagcctggccggctgcttcgccggcagagaggagcccgagaagatcatcctgcccgtgcagggccccgagcccgccgccgagatgcccgacgtgaaggccgaggacgaggtggacttcagagccagcagcatcagcgaggaggtggccgtgggcagcatcgccgccaccctgaagatgaagcagggccccatgacccaggccatcaacagagagaactggtgcaccatcgagccctgccccgacgccgccagcctgctggccagcaagcagagccccgagtgcgagaacttcctggacgtgggcctgggcagagagtgcaccagcaagcagggcgtgctgaagagagagagcggcagcgacagcgacctgttccacagccccagcgacgacatggacagcatcatcttccccaagcccgaggaggagcacctggcctgcgacatcaccggcagcagcagcagcaccgacgacaccgccagcctggacagacacagcagccacggcagcgacgtgagcctgagccagatcctgaagcccaacagaagcagagacagacagagcctggacggcttctacagccacggcatgggcgccgagggcagagagagcgagagcgagcccgccgaccccggcgacgtggaggaggaggagatggacagcatcaccgaggtgcccgccaactgcagcgtgctgagaagcagcatgagaagcctgagccccttcagaagacacagctggggccccggcaagaacgccgccagcgacgccgagatgaaccacagaagcttcagcctggagggcctgaccggcggcgccggcgtgggcaacaagcccagcagcagcctggaggtgagcagcgccaacgccgaggagctgagacaccccttcagcggcgaggagagagtggacagcctggtgagcctgagcgaggaggacctggagagcgaccagagagagcacagaatgttcgaccagcagatctgccacagaagcaagcagcagggcttcaactactgcaccagcgccatcagcagccccctgaccaagagcatcagcctgatgaccatcagccaccccggcctggacaacagcagacccttccacagcaccttccacaacaccagcgccaacctgaccgagagcatcaccgaggagaactacaacttcctgccccacagccccagcaagaaggacagcgagtggaagagcggcaccaaggtgagcagaaccttcagctacatcaagaacaagatgagcagcagcaagaagagcaaggagaaggagaaggagaaggacaagatcaaggagaaggagaaggacagcaaggacaaggagaaggacaagaagaccgtgaacggccacaccttcagcagcatccccgtggtgggccccatcagctgcagccagtgcatgaagcccttcaccaacaaggacgcctacacctgcgccaactgcagcgccttcgtgcacaagggctgcagagagagcctggccagctgcgccaaggtgaagatgaagcagcccaagggcagcctgcaggcccacgacaccagcagcctgcccaccgtgatcatgagaaacaagcccagccagcccaaggagagacccagaagcgccgtgctgctggtggacgagaccgccaccacccccatcttcgccaacagaagaagccagcagagcgtgagcctgagcaagagcgtgagcatccagaacatcaccggcgtgggcaacgacgagaacatgagcaacacctggaagttcctgagccacagcaccgacagcctgaacaagatcagcaaggtgaacgagagcaccgagagcctgaccgacgagggcaccgacatgaacgagggccagctgctgggcgacttcgagatcgagagcaagcagctggaggccgagagctggagcagaatcatcgacagcaagttcctgaagcagcagaagaaggacgtggtgaagagacaggaggtgatctacgagctgatgcagaccgagttccaccacgtgagaaccctgaagatcatgagcggcgtgtacagccagggcatgatggccgacctgctgttcgagcagcagatggtggagaagctgttcccctgcctggacgagctgatcagcatccacagccagttcttccagagaatcctggagagaaagaaggagagcctggtggacaagagcgagaagaacttcctgatcaagagaatcggcgacgtgctggtgaaccagttcagcggcgagaacgccgagagactgaagaagacctacggcaagttctgcggccagcacaaccagagcgtgaactacttcaaggacctgtacgccaaggacaagagattccaggccttcgtgaagaagaagatgagcagcagcgtggtgagaagactgggcatccccgagtgcatcctgctggtgacccagagaatcaccaagtaccccgtgctgttccagagaatcctgcagtgcaccaaggacaacgaggtggagcaggaggacctggcccagagcctgagcctggtgaaggacgtgatcggcgccgtggacagcaaggtggccagctacgagaagaaggtgagactgaacgagatctacaccaagaccgacagcaagagcatcatgagaatgaagagcggccagatgttcgccaaggaggacctgaagagaaagaagctggtgagagacggcagcgtgttcctgaagaacgccgccggcagactgaaggaggtgcaggccgtgctgctgaccgacatcctggtgttcctgcaggagaaggaccagaagtacatcttcgccagcctggaccagaagagcaccgtgatcagcctgaagaagctgatcgtgagagaggtggcccacgaggagaagggcctgttcctgatcagcatgggcatgaccgaccccgagatggtggaggtgcacgccagcagcaaggaggagagaaacagctggatccagatcatccaggacaccatcaacaccctgaacagagacgaggacgagggcatccccagcgagaacgaggaggagaagaagatgctggacaccagagccagagagctgaaggagcagctgcaccagaaggaccagaagatcctgctgctgctggaggagaaggagatgatcttcagagacatggccgagtgcagcacccccctgcccgaggactgcagccccacccacagccccagagtgctgttcagaagcaacaccgaggaggccctgaagggcggccccctgatgaagagcgccatcaacgaggtggagatcctgcagggcctggtgagcggcaacctgggcggcaccctgggccccaccgtgagcagccccatcgagcaggacgtggtgggccccgtgagcctgcccagaagagccgagaccttcggcggcttcgacagccaccagatgaacgccagcaagggcggcgagaaggaggagggcgacgacggccaggacctgagaagaaccgagagcgacagcggcctgaagaagggcggcaacgccaacctggtgttcatgctgaagagaaacagcgagcaggtggtgcagagcgtggtgcacctgtacgagctgctgagcgccctgcagggcgtggtgctgcagcaggacagctacatcgaggaccagaagctggtgctgagcgagagagccctgaccagaagcctgagcagacccagcagcctgatcgagcaggagaagcagagaagcctggagaagcagagacaggacctggccaacctgcagaagcagcaggcccagtacctggaggagaagagaagaagagagagagagtgggaggccagagagagagagctgagagagagagaggccctgctggcccagagagaggaggaggtgcagcagggccagcaggacctggagaaggagagagaggagctgcagcagaagaagggcacctaccagtacgacctggagagactgagagccgcccagaagcagctggagagagagcaggagcagctgagaagagaggccgagagactgagccagagacagaccgagagagacctgtgccaggtgagccacccccacaccaagctgatgagaatccccagcttcttccccagccccgaggagccccccagccccagcgcccccagcatcgccaagagcggcagcctggacagcgagctgagcgtgagccccaagagaaacagcatcagcagaacccacaaggacaagggccccttccacatcctgagcagcaccagccagaccaacaagggccccgagggccagagccaggcccccgccagcaccagcgccagcaccagactgttcggcctgaccaagcccaaggagaagaaggagaagaagaagaagaacaagaccagcagaagccagcccggcgacggccccgccagcgaggtgagcgccgagggcgaggagatcttctgctag

SEQ ID NO: 71279 - DNA, 5238 bp, Artificial Sequence
  Description of Artificial Sequence: Synthetic coding sequence
atgaagctgaacccccagcaggcccccctgtacggcgactgcgtggtgaccgtgctgctggccgaggaggacaaggccgaggacgacgtggtgttctacctggtgttcctgggcagcaccctgagacactgcaccagcaccagaaaggtgagcagcgacaccctggagaccatcgcccccggccacgactgctgcgagaccgtgaaggtgcagctgtgcgccagcaaggagggcctgcccgtgttcgtggtggccgaggaggacttccacttcgtgcaggacgaggcctacgacgccgcccagttcctggccaccagcgccggcaaccagcaggccctgaacttcaccagattcctggaccagagcggcccccccagcggcgacgtgaacagcctggacaagaagctggtgctggccttcagacacctgaagctgcccaccgagtggaacgtgctgggcaccgaccagagcctgcacgacgccggccccagagagaccctgatgcacttcgccgtgagactgggcctgctgagactgacctggttcctgctgcagaagcccggcggcagaggcgccctgagcatccacaaccaggagggcgccacccccgtgagcctggccctggagagaggctaccacaagctgcaccagctgctgaccgaggagaacgccggcgagcccgacagctggagcagcctgagctacgagatcccctacggcgactgcagcgtgagacaccacagagagctggacatctacaccctgaccagcgagagcgacagccaccacgagcaccccttccccggcgacggctgcaccggccccatcttcaagctgatgaacatccagcagcagctgatgaagaccaacctgaagcagatggacagcctgatgcccctgatgatgaccgcccaggaccccagcagcgcccccgagaccgacggccagttcctgccctgcgcccccgagcccaccgacccccagagactgagcagcagcgaggagaccgagagcacccagtgctgccccggcagccccgtggcccagaccgagagcccctgcgacctgagcagcatcgtggaggaggagaacaccgacagaagctgcagaaagaagaacaagggcgtggagagaaagggcgaggaggtggagcccgcccccatcgtggacagcggcaccgtgagcgaccaggacagctgcctgcagagcctgcccgactgcggcgtgaagggcaccgagggcctgagcagctgcggcaacagaaacgaggagaccggcaccaagagcagcggcatgcccaccgaccaggagagcctgagcagcggcgacgccgtgctgcagagagacctggtgatggagcccggcaccgcccagtacagcagcggcggcgagctgggcggcatcagcaccaccaacgtgagcacccccgacaccgccggcgagatggagcacggcctgatgaaccccgacgccaccgtgtggaagaacgtgctgcagggcggcgagagcaccaaggagagattcgagaacagcaacatcggcaccgccggcgccagcgacgtgcacgtgaccagcaagcccgtggacaagatcagcgtgcccaactgcgcccccgccgccagcagcctggacggcaacaagcccgccgagagcagcctggccttcagcaacgaggagaccagcaccgagaagaccgccgagaccgagaccagcagaagcagagaggagagcgccgacgcccccgtggaccagaacagcgtggtgatccccgccgccgccaaggacaagatcagcgacggcctggagccctacaccctgctggccgccggcatcggcgaggccatgagccccagcgacctggccctgctgggcctggaggaggacgtgatgccccaccagaacagcgagaccaacagcagccacgcccagagccagaagggcaagagcagccccatctgcagcaccaccggcgacgacaagctgtgcgccgacagcgcctgccagcagaacaccgtgaccagcagcggcgacctggtggccaagctgtgcgacaacatcgtgagcgagagcgagagcaccaccgccagacagcccagcagccaggacccccccgacgccagccactgcgaggacccccaggcccacaccgtgaccagcgaccccgtgagagacacccaggagagagccgacttctgccccttcaaggtggtggacaacaagggccagagaaaggacgtgaagctggacaagcccctgaccaacatgctggaggtggtgagccacccccaccccgtggtgcccaagatggagaaggagctggtgcccgaccaggccgtgatcagcgacagcaccttcagcctggccaacagccccggcagcgagagcgtgaccaaggacgacgccctgagcttcgtgcccagccagaaggagaagggcaccgccacccccgagctgcacaccgccaccgactacagagacggccccgacggcaacagcaacgagcccgacaccagacccctggaggacagagccgtgggcctgagcaccagcagcaccgccgccgagctgcagcacggcatgggcaacaccagcctgaccggcctgggcggcgagcacgagggccccgccccccccgccatccccgaggccctgaacatcaagggcaacaccgacagcagcctgcagagcgtgggcaaggccaccctggccctggacagcgtgctgaccgaggagggcaagctgctggtggtgagcgagagcagcgccgcccaggagcaggacaaggacaaggccgtgacctgcagcagcatcaaggagaacgccctgagcagcggcaccctgcaggaggagcagagaacccccccccccggccaggacacccagcagttccacgagaagagcatcagcgccgactgcgccaaggacaaggccctgcagctgagcaacagccccggcgccagcagcgccttcctgaaggccgagaccgagcacaacaaggaggtggccccccaggtgagcctgctgacccagggcggcgccgcccagagcctggtgccccccggcgccagcctggccaccgagagcagacaggaggccctgggcgccgagcacaacagcagcgccctgctgccctgcctgctgcccgacggcagcgacggcagcgacgccctgaactgcagccagcccagccccctggacgtgggcgtgaagaacacccagagccagggcaagaccagcgcctgcgaggtgagcggcgacgtgaccgtggacgtgaccggcgtgaacgccctgcagggcatggccgagcccagaagagagaacatcagccacaacacccaggacatcctgatccccaacgtgctgctgagccaggagaagaacgccgtgctgggcctgcccgtggccctgcaggacaaggccgtgaccgacccccagggcgtgggcacccccgagatgatccccctggactgggagaagggcaagctggagggcgccgaccacagctgcaccatgggcgacgccgaggaggcccagatcgacgacgaggcccaccccgtgctgctgcagcccgtggccaaggagctgcccaccgacatggagctgagcgcccacgacgacggcgcccccgccggcgtgagagaggtgatgagagccccccccagcggcagagagagaagcacccccagcctgccctgcatggtgagcgcccaggacgcccccctgcccaagggcgccgacctgatcgaggaggccgccagcagaatcgtggacgccgtgatcgagcaggtgaaggccgccggcgccctgctgaccgagggcgaggcctgccacatgagcctgagcagccccgagctgggccccctgaccaagggcctggagagcgccttcaccgagaaggtgagcaccttcccccccggcgagagcctgcccatgggcagcacccccgaggaggccaccggcagcctggccggctgcttcgccggcagagaggagcccgagaagatcatcctgcccgtgcagggccccgagcccgccgccgagatgcccgacgtgaaggccgaggacgaggtggacttcagagccagcagcatcagcgaggaggtggccgtgggcagcatcgccgccaccctgaagatgaagcagggccccatgacccaggccatcaacagagagaactggtgcaccatcgagccctgccccgacgccgccagcctgctggccagcaagcagagccccgagtgcgagaacttcctggacgtgggcctgggcagagagtgcaccagcaagcagggcgtgctgaagagagagagcggcagcgacagcgacctgttccacagccccagcgacgacatggacagcatcatcttccccaagcccgaggaggagcacctggcctgcgacatcaccggcagcagcagcagcaccgacgacaccgccagcctggacagacacagcagccacggcagcgacgtgagcctgagccagatcctgaagcccaacagaagcagagacagacagagcctggacggcttctacagccacggcatgggcgccgagggcagagagagcgagagcgagcccgccgaccccggcgacgtggaggaggaggagatggacagcatcaccgaggtgcccgccaactgcagcgtgctgagaagcagcatgagaagcctgagccccttcagaagacacagctggggccccggcaagaacgccgccagcgacgccgagatgaaccacagaagcttcagcctggagggcctgaccggcggcgccggcgtgggcaacaagcccagcagcagcctggaggtgagcagcgccaacgccgaggagctgagacaccccttcagcggcgaggagagagtggacagcctggtgagcctgagcgaggaggacctggagagcgaccagagagagcacagaatgttcgaccagcagatctgccacagaagcaagcagcagggcttcaactactgcaccagcgccatcagcagccccctgaccaagagcatcagcctgatgaccatcagccaccccggcctggacaacagcagacccttccacagcaccttccacaacaccagcgccaacctgaccgagagcatcaccgaggagaactacaacttcctgccccacagccccagcaagaaggacagcgagtggaagagcggcaccaaggtgagcagaaccttcagctacatcaagaacaagatgagcagcagcaagaagagcaagtag

SEQ ID NO: 71280 - DNA, 828 bp, Artificial Sequence
  Description of Artificial Sequence: Synthetic coding sequence
cccagcgacgacatggacagcatcatcttccccaagcccgaggaggagcacctggcctgcgacatcaccggcagcagcagcagcaccgacgacaccgccagcctggacagacacagcagccacggcagcgacgtgagcctgagccagatcctgaagcccaacagaagcagagacagacagagcctggacggcttctacagccacggcatgggcgccgagggcagagagagcgagagcgagcccgccgaccccggcgacgtggaggaggaggagatggacagcatcaccgaggtgcccgccaactgcagcgtgctgagaagcagcatgagaagcctgagccccttcagaagacacagctggggccccggcaagaacgccgccagcgacgccgagatgaaccacagaagcagcatgagagtgctgggcgacgtggtgagaagaccccccatccacagaagaagcatgagctggtgccccagcggcgtgcagtacagcgccggcctgagcgccgacttcaactacagaagcttcagcctggagggcctgaccggcggcgccggcgtgggcaacaagcccagcagcagcctggaggtgagcagcgccaacgccgaggagctgagacaccccttcagcggcgaggagagagtggacagcctggtgagcctgagcgaggaggacctggagagcgaccagagagagcacagaatgttcgaccagcagatctgccacagaagcaagcagcagggcttcaactactgcaccagcgccatcagcagccccctgaccaagagcatcagcctgatgaccatcagccaccccggcctgtag

SEQ ID NO: 71281 - DNA, 117 bp, Artificial Sequence
  Description of Artificial Sequence: Synthetic coding sequence
atgaagctgaacccccagcaggcccccctgtacggcgactgcgtggtgaccgtgctgctggccgaggaggacaaggccgaggacgacgtggtgttctacctggtgttcctgggctag

SEQ ID NO: 71282 - DNA, 540 bp, Artificial Sequence
  Description of Artificial Sequence: Synthetic coding sequence
atgaagctgaacccccagcaggcccccctgtacggcgactgcgtggtgaccgtgctgctggccgaggaggacaaggccgaggacgacgtggtgttctacctggtgttcctgggcagcaccctgagacactgcaccagcaccagaaaggtgagcagcgacaccctggagaccatcgcccccggccacgactgctgcgagaccgtgaaggtgcagctgtgcgccagcaaggagggcctgcccgtgttcgtggtggccgaggaggacttccacttcgtgcaggacgaggcctacgacgccgcccagttcctggccaccagcgccggcaaccagcaggccctgaacttcaccagattcctggaccagagcggcccccccagcggcgacgtgaacagcctggacaagaagctggtgctggccttcagacacctgaagctgcccaccgagtggaacgtgctgggcaccgaccagagcctgcacggcgagaacctgtacgacctgcagacccacttcaagttcgtgatcttcctgctgttcttctag

SEQ ID NO: 71283 - DNA, 414 bp, Artificial Sequence
  Description of Artificial Sequence: Synthetic coding sequence
atgagcgagacccagaacagcaccagccagaaggccatggacgaggacaacaaggccgccagccagaccatgcccaacacccaggacaagaactacgaggacgagctgacccaggtggccctggccctggtggaggacgtgatcaactacgccgtgaagatcgtggaggaggagagaaaccccctgaagaacatcaagtggatgacccacggcgagttcaccgtggagaagggcctgaagcagatcgacgagtacttcagcgacgcccccatcgtggtgagctacgtgggcgaccaccaggccctggtgcacagacccggcatggtgagattcagagagaactggcagaagaacctgaccgacgccaagtacagcttcatggagagcttccccttcctgttcaacagagtgtag

SEQ ID NO: 71284 - DNA, 270 bp, Artificial Sequence
  Description of Artificial Sequence: Synthetic coding sequence
atgagcgagacccagaacagcaccagccagaaggccatggacgaggacaacaaggccgccagccagaccatgcccaacacccaggacaagaactacgaggacgagctgacccaggtggccctggccctggtggaggacgtgatcaactacgccgtgaagatcgtggaggaggagagaaaccccctgaagaacatcaagtggatgacccacggcgagttcaccgtggagaagggcctgaagcagatcgacgagtacttcagcgtgagctag

SEQ ID NO: 71285 - DNA, 417 bp, Artificial Sequence
  Description of Artificial Sequence: Synthetic coding sequence
atgagcgagacccagaacagcaccagccagaaggccatggacgaggacaacaaggccgccagccagaccatgcccaacacccaggacaagaactacgaggacgagctgacccaggtggccctggccctggtggaggacgtgatcaactacgccgtgaagatcgtggaggaggagagaaaccccctgaagaacatcaagtggatgacccacggcgagttcaccgtggagaagggcctgaagcagatcgacgagtacttcagccccgacgcccccatcgtggtgagctacgtgggcgaccaccaggccctggtgcacagacccggcatggtgagattcagagagaactggcagaagaacctgaccgacgccaagtacagcttcatggagagcttccccttcctgttcaacagagtgtag

SEQ ID NO: 71286 - DNA, 414 bp, Artificial Sequence; identical to SEQ ID NO: 71283
  Description of Artificial Sequence: Synthetic coding sequence

SEQ ID NO: 71287 - DNA, 594 bp, Artificial Sequence
  Description of Artificial Sequence: Synthetic coding sequence
atgagcgagacccagaacagcaccagccagaaggccatggacgaggacaacaaggccgccagccagaccatgcccaacacccaggacaagaactacgaggacgagctgacccaggtggccctggccctggtggaggacgtgatcaactacgccgtgaagatcgtggaggaggagagaaaccccctgaagaacatcaagtggatgacccacggcgagttcaccgtggagaagggcctgaagcagatcgacgagtacttcagcaagtgcgtgagcaagaagtgctgggcccacggcgtggagttcgtggagagaaaggacctgatccacagcttcctgtacatctactacgtgcactggagcatcagcaccgccgacctgcccgtggccagaatcagcgccggcacctacttcaccatgaaggtgagcaagaccaagccccccgacgcccccatcgtggtgagctacgtgggcgaccaccaggccctggtgcacagacccggcatggtgagattcagagagaactggcagaagaacctgaccgacgccaagtacagcttcatggagagcttccccttcctgttcaacagagtgtag

SEQ ID NO: 71288 - DNA, 270 bp, Artificial Sequence; identical to SEQ ID NO: 71284
  Description of Artificial Sequence: Synthetic coding sequence

SEQ ID NO: 71289 - DNA, 2088 bp, Artificial Sequence
  Description of Artificial Sequence: Synthetic coding sequence
atggccgccgccaccatcgtgcacgacaccagcgaggccgtggagctgtgccccgcctacggcctgtacctgaagcccatcaccaagatgaccatcagcgtggccctgccccagctgaagcagcccggcaagagcatcagcaactgggaggtgatggagagactgaagggcatggtgcagaaccaccagttcagcaccctgagaatcagcaagagcaccatggacttcatcagattcgagggcgaggtggagaacaagagcctggtgaagagcttcctggcctgcctggacggcaagaccatcaagctgagcggcttcagcgacatcctgaaggtgagagccgccgagttcaagatcgacttccccaccagacacgactgggacagcttcttcagagacgccaaggacatgaacgagaccctgcccggcgagagacccgacaccatccacctggagggcctgccctgcaagtggttcgccctgaaggagagcggcagcgagaagcccagcgaggacgtgctggtgaaggtgttcgagaagttcggcgagatcagaaacgtggacatccccatgctggacccctacagagaggagatgaccggcagaaacttccacaccttcagcttcggcggccacctgaacttcgaggcctacgtgcagtacagagagtacatgggcttcatccaggccatgagcgccctgagaggcatgaagctgatgtacaagggcgaggacggcaaggccgtggcctgcaacatcaaggtgagcttcgacagcaccaagcacctgagcgacgccagcatcaagaagagacagctggagagacagaagctgcaggagctggagcagcagagagaggagcagaagagaagagagaaggaggccgaggagagacagagagccgaggagagaaagcagaaggagctggaggagctggagagagagagaaagagagaggagaagctgagaaagagagagcagaagcagagagacagagagctgagaagaaaccagaagaagctggagaagctgcaggccgaggagcagaagcagctgcaggagaagatcaagctggaggagagaaagctgctgctggcccagagaaacctgcagagcatcagactgatcgccgagctgctgagcagagccaaggccgtgaagctgagagagcaggagcagaaggaggagaagctgagactgcagcagcaggaggagagaagaagactgcaggaggccgagctgagaagagtggaggaggagaaggagagagccctgggcctgcagagaaaggagagagagctgagagagagactgctgagcatcctgctgagcaagaagcccgacgacagccacacccacgacgagctgggcgtggcccacgccgacctgctgcagcccgtgctggacatcctgcagaccgtgagcagcggctgcgtgagcgccaccaccctgcaccccctgggcggccagccccccgccggcgcccccaaggagagccccgcccaccccgaggccgacggcgcccccaagagcgtgaacggcagcgtggccgaggaggccccctgcaaggaggtgcagagcagctgcagagtggtgcccgaggacggcagccccgagaagagatgccccggcggcgtgctgagctgcatccccgacaacaaccagcagcccaagggcatccccgcctgcgagcagaacgtgagcagaaaggacaccagaagcgagcaggacaagtgcaacagagagcccagcaagggcagaggcagagccaccggcgacggcctggccgacagacacaagagagagagaagcagagccagaagagccagcagcagagaggacggcagacccagaaaggagagaagaccccacaagaagcacgcctacaaggacgacagccccagaagaagaagcaccagccccgaccacaccagaagcagaagaagccacagcaaggacagacacagaagagagagaagcagagagagaagaggcagcgccagcagaaagcacagcagacacagaagaagaagcgagagaagcagaagcagaagccccagcagacacagaagcacctggaacagatag

SEQ ID NO: 71290 - DNA, 1341 bp, Artificial Sequence
  Description of Artificial Sequence: Synthetic coding sequence
atggccgccgccaccatcgtgcacgacaccagcgaggccgtggagctgtgccccgcctacggcctgtacctgaagcccatcaccaagatgaccatcagcgtggccctgccccagctgaagcagcccggcaagagcatcagcaactgggaggtgatggagagactgaagggcatggtgcagaaccaccagttcagcaccctgagaatcagcaagagcaccatggacttcatcagattcgagggcgaggtggagaacaagagcctggtgaagagcttcctggcctgcctggacggcaagaccatcaagctgagcggcttcagcgacatcctgaaggtgagagccgccgagttcaagatcgacttccccaccagacacgactgggacagcttcttcagagacgccaaggacatgaacgagaccctgcccggcgagagacccgacaccatccacctggagggcctgccctgcaagtggttcgccctgaaggagagcggcagcgagaagcccagcgaggacgtgctggtgaaggtgttcgagaagttcggcgagatcagaaacgtggacatccccatgctggacccctacagagaggagatgaccggcagaaacttccacaccttcagcttcggcggccacctgaacttcgaggcctacgtgcagtacagagagtacatgggcttcatccaggccatgagcgccctgagaggcatgaagctgatgtacaagggcgaggacggcaaggccgtggcctgcaacatcaaggtgagcttcgacagcaccaagcacctgagcgacgccagcatcaagaagagacagctggagagacagaagctgcaggagctggagcagcagagagaggagcagaagagaagagagaaggaggccgaggagagacagagagccgaggagagaaagcagaaggagctggaggagctggagagagagagaaagagagaggagaagctgagaaagagagagcagaagcagagagacagagagctgagaagaaaccagaagaagctggagaagctgcaggccgaggagcagaagcagctgcaggagaagatcaagctggaggagagaaagctgctgctggcccagagaaacctgcagagcatcagactgatcgccgagctgctgagcagagccaaggtgcccggcggcagcctgtgcagcagacagcccagacccggctgcccccagtgcccccccctgaagtgcggcagaagacacggcgccgtgagcccccccgccgccgccgtggccaccaagcccgccctgatgcccagaatgaccgcccccagcagagagggcgtggccctggtgtgcagaagcagatag

SEQ ID NO: 71291 - DNA, 2580 bp, Artificial Sequence
  Description of Artificial Sequence: Synthetic coding sequence
atggagatcgaggtgagcgtggccgagtgcaagagcgtgcccggcatcaccagcaccccccaccccatggaccaccccagcgccttctacagccccccccacaacggcctgctgaccgaccaccacgagagcctggacaacgacgtggccagagagatcagatacctggacgaggtgctggaggccaactgctgcgacagcgccgtggacggcacctacaacggcaccagcagccccgagcccggcgccgtggtgctggtgggcggcctgagcccccccgtgcacgaggccacccagcccgagcccaccgagagaaccgccagcagacaggcccccccccacatcgagctgagcaacagcagccccgaccccatggccgaggccgagagaaccaacggccacagccccagccagcccagagacgccctgggcgacagcctgcaggtgcccgtgagccccagcagcaccaccagcagcagatgcagcagcagagacggcgagttcaccctgaccaccctgaagaaggaggccaagttcgagctgagagccttccacgaggacaagaagcccagcaagctgttcgaggacgacgagcacgagaaggagcagtactgcatcagaaaggtgagacccagcgaggagatgctggagctggagaaggagagaagagagctgatcagaagccaggccgtgaagaagaaccccggcatcgccgccaagtggtggaaccccccccaggagaagaccatcgaggagcagctggacgaggagcacctggagagccacaagaagtacaaggagagaaaggagagaagagcccagcaggagcagctgctgctgcagaagcagctgcagcagcagcagcagcagccccccagccagctgtgcaccgcccccgccagcagccacgagagagccagcatgatcgacaaggccaaggaggacatcgtgaccgagcagatcgacttcagcgccgccagaaagcagttccagctgatggagaacagcagacaggccgtggccaagggccagagcacccccagactgttcagcatcaagcccttctacagacccctgggcagcgtgaacagcgacaagcccctgaccaaccccagaccccccagcgtgggcggcccccccgaggacagcggcgccagcgccgccaagggccagaagagccccggcgccctggagacccccagcgccgccggcagccagggcaacaccgccagccagggcaaggagggcccctacagcgagcccagcaagagaggccccctgagcaagctgtgggccgaggacggcgagttcaccagcgccagagccgtgctgaccgtggtgaaggacgacgaccacggcatcctggaccagttcagcagaagcgtgaacgtgagcctgacccaggaggagctggacagcggcctggacgagctgagcgtgagaagccaggacaccaccgtgctggagaccctgagcaacgacttcagcatggacaacatcagcgacagcggcgccagcaacgagaccaccaacgccctgcaggagaacagcctggccgacttcagcctgccccagaccccccagaccgacaaccccagcgagggcagaggcgagggcgtgagcaagagcttcagcgaccacggcttctacagccccagcagcaccctgggcgacagccccctggtggacgaccccctggagtaccaggccggcctgctggtgcagaacgccatccagcaggccatcgccgagcaggtggacaaggccgtgagcaagaccagcagagacggcgccgagcagcagggccccgaggccaccgtggaggaggccgaggccgccgccttcggcagcgagaagccccagagcatgttcgagcccccccaggtgagcagccccgtgcaggagaagagagacgtgctgcccaagatcctgcccgccgaggacagagccctgagagagagaggccccccccagcccctgcccgccgtgcagcccagcggccccatcaacatggaggagaccagacccgagggcagctacttcagcaagtacagcgaggccgccgagctgagaagcaccgccagcctgctggccacccaggagagcgacgtgatggtgggccccttcaagctgagaagcagaaagcagagaaccctgagcatgatcgaggaggagatcagagccgcccaggagagagaggaggagctgaagagacagagacaggtgctgcagagcacccagagccccagaaccaagaacgcccccagcctgcccagcagaacctgctacaagaccgcccccggcaagatcgagaaggtgaagcccccccccagccccaccaccgagggccccagcctgcagcccgacctggcccccgaggaggccgccggcacccagagacccaagaacctgatgcagaccctgatggaggactacgagacccacaagagcaagagaagagagagaatggacgacagcagcgtgctggaggccaccagagtgaacagaagaaagagcgccctggccctgagatgggaggccggcatctacgccaaccaggaggaggaggacaacgagtag

SEQ ID NO: 71292 - DNA, 2847 bp, Artificial Sequence
  Description of Artificial Sequence: Synthetic coding sequence
atgagatggccccagcccggcgccgccgccagactgccccccgagagccccggcccccccgagagccccggcccccccgagagagaggccgccgccgccagaagatggaccggcgccgagccccaggactgcgcccccggcagcggcagacccgagaagcccccccagctgagcgaggacgacatctggctgaagagcgagggcgacaactacagcgccaccctgctggagcccgccgccagcagcctgagccccgaccacaagaacatggagatcgaggtgagcgtggccgagtgcaagagcgtgcccggcatcaccagcaccccccaccccatggaccaccccagcgccttctacagccccccccacaacggcctgctgaccgaccaccacgagagcctggacaacgacgtggccagagagatcagatacctggacgaggtgctggaggccaactgctgcgacagcgccgtggacggcacctacaacggcaccagcagccccgagcccggcgccgtggtgctggtgggcggcctgagcccccccgtgcacgaggccacccagcccgagcccaccgagagaaccgccagcagacaggcccccccccacatcgagctgagcaacagcagccccgaccccatggccgaggccgagagaaccaacggccacagccccagccagcccagagacgccctgggcgacagcctgcaggtgcccgtgagccccagcagcaccaccagcagcagatgcagcagcagagacggcgagttcaccctgaccaccctgaagaaggaggccaagttcgagctgagagccttccacgaggacaagaagcccagcaagctgttcgaggacgacgagcacgagaaggagcagtactgcatcagaaaggtgagacccagcgaggagatgctggagctggagaaggagagaagagagctgatcagaagccaggccgtgaagaagaaccccggcatcgccgccaagtggtggaaccccccccaggagaagaccatcgaggagcagctggacgaggagcacctggagagccacaagaagtacaaggagagaaaggagagaagagcccagcaggagcagctgctgctgcagaagcagctgcagcagcagcagcagcagccccccagccagctgtgcaccgcccccgccagcagccacgagagagccagcatgatcgacaaggccaaggaggacatcgtgaccgagcagatcgacttcagcgccgccagaaagcagttccagctgatggagaacagcagacaggccgtggccaagggccagagcacccccagactgttcagcatcaagcccttctacagacccctgggcagcgtgaacagcgacaagcccctgaccaaccccagaccccccagcgtgggcggcccccccgaggacagcggcgccagcgccgccaagggccagaagagccccggcgccctggagacccccagcgccgccggcagccagggcaacaccgccagccagggcaaggagggcccctacagcgagcccagcaagagaggccccctgagcaagctgtgggccgaggacggcgagttcaccagcgccagagccgtgctgaccgtggtgaaggacgacgaccacggcatcctggaccagttcagcagaagcgtgaacgtgagcctgacccaggaggagctggacagcggcctggacgagctgagcgtgagaagccaggacaccaccgtgctggagaccctgagcaacgacttcagcatggacaacatcagcgacagcggcgccagcaacgagaccaccaacgccctgcaggagaacagcctggccgacttcagcctgccccagaccccccagaccgacaaccccagcgagggcagaggcgagggcgtgagcaagagcttcagcgaccacggcttctacagccccagcagcaccctgggcgacagccccctggtggacgaccccctggagtaccaggccggcctgctggtgcagaacgccatccagcaggccatcgccgagcaggtggacaaggccgtgagcaagaccagcagagacggcgccgagcagcagggccccgaggccaccgtggaggaggccgaggccgccgccttcggcagcgagaagccccagagcatgttcgagcccccccaggtgagcagccccgtgcaggagaagagagacgtgctgcccaagatcctgcccgccgaggacagagccctgagagagagaggccccccccagcccctgcccgccgtgcagcccagcggccccatcaacatggaggagaccagacccgagggcagctacttcagcaagtacagcgaggccgccgagctgagaagcaccgccagcctgctggccacccaggagagcgacgtgatggtgggccccttcaagctgagaagcagaaagcagagaaccctgagcatgatcgaggaggagatcagagccgcccaggagagagaggaggagctgaagagacagagacaggtgctgcagagcacccagagccccagaaccaagaacgcccccagcctgcccagcagaacctgctacaagaccgcccccggcaagatcgagaaggtgaagcccccccccagccccaccaccgagggccccagcctgcagcccgacctggcccccgaggaggccgccggcacccagagacccaagaacctgatgcagaccctgatggaggactacgagacccacaagagcaagagaagagagagaatggacgacagcagcgtgctggaggccaccagagtgaacagaagaaagagcgccctggccctgagatgggaggccggcatctacgccaaccaggaggaggaggacaacgagtag

SEQ ID NO: 71293 - DNA, 3273 bp, Artificial Sequence
  Description of Artificial Sequence: Synthetic coding sequence
atggccgaggccgagctgcacaaggagagactgcaggccatcgccgagaagagaaagagacagaccgagatcgagggcaagagacagcagctggacgagcagatcctgctgctgcagcacagcaagagcaaggtgctgagagagaagtggctgctgcagggcatccccgccggcaccgccgaggaggaggaggccagaagaagacagagcgaggaggacgagttcagagtgaagcagctggaggacaacatccagagactggagcaggagatccagaccctggagagcgaggagagccagatcagcgccaaggagcagatcatcctggagaagctgaaggagaccgagaagagcttcaaggacttccagaagggcttcagcagcaccgacggcgacgccgtgaactacatcagcagccagctgcccgacctgcccatcctgtgcagcagaaccgccgagcccagccccggccaggacggcaccagcagagccgccggcgtgggctgggagaacgtgctgctgaaggagggcgagagcgccagcaacgccaccgagaccagcggccccgacatgaccatcaagaagcccccccagctgagcgaggacgacatctggctgaagagcgagggcgacaactacagcgccaccctgctggagcccgccgccagcagcctgagccccgaccacaagaacatggagatcgaggtgagcgtggccgagtgcaagagcgtgcccggcatcaccagcaccccccaccccatggaccaccccagcgccttctacagccccccccacaacggcctgctgaccgaccaccacgagagcctggacaacgacgtggccagagagatcagatacctggacgaggtgctggaggccaactgctgcgacagcgccgtggacggcacctacaacggcaccagcagccccgagcccggcgccgtggtgctggtgggcggcctgagcccccccgtgcacgaggccacccagcccgagcccaccgagagaaccgccagcagacaggcccccccccacatcgagctgagcaacagcagccccgaccccatggccgaggccgagagaaccaacggccacagccccagccagcccagagacgccctgggcgacagcctgcaggtgcccgtgagccccagcagcaccaccagcagcagatgcagcagcagagacggcgagttcaccctgaccaccctgaagaaggaggccaagttcgagctgagagccttccacgaggacaagaagcccagcaagctgttcgaggacgacgagcacgagaaggagcagtactgcatcagaaaggtgagacccagcgaggagatgctggagctggagaaggagagaagagagctgatcagaagccaggccgtgaagaagaaccccggcatcgccgccaagtggtggaaccccccccaggagaagaccatcgaggagcagctggacgaggagcacctggagagccacaagaagtacaaggagagaaaggagagaagagcccagcaggagcagctgctgctgcagaagcagctgcagcagcagcagcagcagccccccagccagctgtgcaccgcccccgccagcagccacgagagagccagcatgatcgacaaggccaaggaggacatcgtgaccgagcagatcgacttcagcgccgccagaaagcagttccagctgatggagaacagcagacaggccgtggccaagggccagagcacccccagactgttcagcatcaagcccttctacagacccctgggcagcgtgaacagcgacaagcccctgaccaaccccagaccccccagcgtgggcggcccccccgaggacagcggcgccagcgccgccaagggccagaagagccccggcgccctggagacccccagcgccgccggcagccagggcaacaccgccagccagggcaaggagggcccctacagcgagcccagcaagagaggccccctgagcaagctgtgggccgaggacggcgagttcaccagcgccagagccgtgctgaccgtggtgaaggacgacgaccacggcatcctggaccagttcagcagaagcgtgaacgtgagcctgacccaggaggagctggacagcggcctggacgagctgagcgtgagaagccaggacaccaccgtgctggagaccctgagcaacgacttcagcatggacaacatcagcgacagcggcgccagcaacgagaccaccaacgccctgcaggagaacagcctggccgacttcagcctgccccagaccccccagaccgacaaccccagcgagggcagaggcgagggcgtgagcaagagcttcagcgaccacggcttctacagccccagcagcaccctgggcgacagccccctggtggacgaccccctggagtaccaggccggcctgctggtgcagaacgccatccagcaggccatcgccgagcaggtggacaaggccgtgagcaagaccagcagagacggcgccgagcagcagggccccgaggccaccgtggaggaggccgaggccgccgccttcggcagcgagaagccccagagcatgttcgagcccccccaggtgagcagccccgtgcaggagaagagagacgtgctgcccaagatcctgcccgccgaggacagagccctgagagagagaggccccccccagcccctgcccgccgtgcagcccagcggccccatcaacatggaggagaccagacccgagggcagctacttcagcaagtacagcgaggccgccgagctgagaagcaccgccagcctgctggccacccaggagagcgacgtgatggtgggccccttcaagctgagaagcagaaagcagagaaccctgagcatgatcgaggaggagatcagagccgcccaggagagagaggaggagctgaagagacagagacaggtgctgcagagcacccagagccccagaaccaagaacgcccccagcctgcccagcagaacctgctacaagaccgcccccggcaagatcgagaaggtgaagcccccccccagccccaccaccgagggccccagcctgcagcccgacctggcccccgaggaggccgccggcacccagagacccaagaacctgatgcagaccctgatggaggactacgagacccacaagagcaagagaagagagagaatggacgacagcagcgtgctggaggccaccagagtgaacagaagaaagagcgccctggccctgagatgggaggccggcatctacgccaaccaggaggaggaggacaacgagtag

SEQ ID NO: 71294 - DNA, 3312 bp, Artificial Sequence
  Description of Artificial Sequence: Synthetic coding sequence
atggccgaggccgagctgcacaaggagagactgcaggccatcgccgagaagagaaagagacagaccgagatcgagggcaagagacagcagctggacgagcagatcctgctgctgcagcacagcaagagcaaggtgctgagagagaagtggctgctgcagggcatccccgccggcaccgccgaggaggaggaggccagaagaagacagagcgaggaggacgagttcagagtgaagcagctggaggacaacatccagagactggagcaggagatccagaccctggagagcgaggagagccagatcagcgccaaggagcagatcatcctggagaagctgaaggagaccgagaagagcttcaaggacttccagaagggcttcagcagcaccgacggcgacgccgtgaactacatcagcagccagctgcccgacctgcccatcctgtgcagcagaaccgccgagcccagccccggccaggacggcaccagcagagccgccggcgtgggctgggagaacgtgctgctgaaggagggcgagagcgccagcaacgccaccgagaccagcggccccgacatgaccatcaagaagcccccccagctgagcgaggacgacatctggctgaagagcgagggcgacaactacagcgccaccctgctggagcccgccgccagcagcctgagccccgaccacaagaacatggagatcgaggtgagcgtggccgagtgcaagagcgtgcccggcatcaccagcaccccccaccccatggaccaccccagcgccttctacagccccccccacaacggcctgctgaccgaccaccacgagagcctggacaacgacgtggccagagagatcagatacctggacgaggtgctggaggccaactgctgcgacagcgccgtggacggcacctacaacggcaccagcagccccgagcccggcgccgtggtgctggtgggcggcctgagcccccccgtgcacgaggccacccagcccgagcccaccgagagaaccgccagcagacaggcccccccccacatcgagctgagcaacagcagccccgaccccatggccgaggccgagagaaccaacggccacagccccagccagcccagagacgccctgggcgacagcctgcaggtgcccgtgagccccagcagcaccaccagcagcagatgcagcagcagagacggcgagttcaccctgaccaccctgaagaaggaggccaagttcgagctgagagccttccacgaggacaagaagcccagcaagctgttcgaggacgacgagcacgagaaggagcagtactgcatcagaaaggtgagacccagcgaggagatgctggagctggagaaggagagaagagagctgatcagaagccaggccgtgaagaagaaccccggcatcgccgccaagtggtggaaccccccccaggagaagaccatcgaggagcagctggacgaggagcacctggagagccacaagaagtacaaggagagaaaggagagaagagcccagcaggagcagctgctgctgcagaagcagctgcagcagcagcagcagcagccccccagccagctgtgcaccgcccccgccagcagccacgagagagccagcatgatcgacaaggccaaggaggacatcgtgaccgagcagatcgacttcagcgccgccagaaagcagttccagctgatggagaacagcagacaggccgtggccaagggccagagcacccccagactgttcagcatcaagcccttctacagacccctgggcagcgtgaacagcgacaagcccctgaccaaccccagaccccccagcgtgggcggcccccccgaggacagcggcgccagcgccgccaagggccagaagagccccggcgccctggagacccccagcgccgccggcagccagggcaacaccgccagccagggcaaggagggcccctacagcgagcccagcaagagaggccccctgagcaagctgtgggccgaggacggcgagttcaccagcgccagagccgtgctgaccgtggtgaaggacgacgaccacggcatcctggaccagttcagcagaagcgtgaacgtgagcctgacccaggaggagctggacagcggcctggacgagctgagcgtgagaagccaggacaccaccgtgctggagaccctgagcaacgacttcagcatggacaacatcagcgacagcggcgccagcaacgagaccaccaacgccctgcaggagaacagcctggccgacttcagcctgccccagaccccccagaccgacaaccccagcgagggcagaggcgagggcgtgagcaagagcttcagcgaccacggcttctacagccccagcagcaccctgggcgacagccccctggtggacgaccccctggagtaccaggccggcctgctggtgcagaacgccatccagcaggccatcgccgagcaggtggacaaggccgtgagcaagaccagcagagacggcgccgagcagcagggccccgaggccaccgtggaggaggccgaggccgccgccttcggcagcgagaagccccagagcatgttcgagcccccccaggtgagcagccccgtgcaggagaagagagacgtgctgcccaagatcctgcccgccgaggacagagccctgagagagagaggccccccccagcccctgcccgccgtgcagcccagcggccccatcaacatggaggagaccagacccgagggcagctacttcagcaagtacagcgaggccgccgagctgagaagcaccgccagcctgctggccacccaggagagcgacgtgatggtgggccccttcaagctgagaagcagaaagcagagaaccctgagcatgatcgaggaggagatcagagccgcccaggagagagaggaggagctgaagagacagagacaggtgctgcagagcacccagagccccagaaccaagaacgcccccagcctgcccagcagaacctgctacaagaccgcccccggcaagatcgagaaggtgaagcccccccccagccccaccaccgagggccccagcctgcagcccgacctggcccccgaggaggccgccggcacccagagacccaagaacctgatgcagaccctgatggaggactacgagacccacaagagcaagagaagagagagaatggacgacagcagctacaccagcaagctgctgagctgcaaggtgaccagcgaggtgctggaggccaccagagtgaacagaagaaagagcgccctggccctgagatgggaggccggcatctacgccaaccaggaggaggaggacaacgagtag

SEQ ID NO: 71295 - DNA, 2886 bp, Artificial Sequence
  Description of Artificial Sequence: Synthetic coding sequence
atgagatggccccagcccggcgccgccgccagactgccccccgagagccccggcccccccgagagccccggcccccccgagagagaggccgccgccgccagaagatggaccggcgccgagccccaggactgcgcccccggcagcggcagacccgagaagcccccccagctgagcgaggacgacatctggctgaagagcgagggcgacaactacagcgccaccctgctggagcccgccgccagcagcctgagccccgaccacaagaacatggagatcgaggtgagcgtggccgagtgcaagagcgtgcccggcatcaccagcaccccccaccccatggaccaccccagcgccttctacagccccccccacaacggcctgctgaccgaccaccacgagagcctggacaacgacgtggccagagagatcagatacctggacgaggtgctggaggccaactgctgcgacagcgccgtggacggcacctacaacggcaccagcagccccgagcccggcgccgtggtgctggtgggcggcctgagcccccccgtgcacgaggccacccagcccgagcccaccgagagaaccgccagcagacaggcccccccccacatcgagctgagcaacagcagccccgaccccatggccgaggccgagagaaccaacggccacagccccagccagcccagagacgccctgggcgacagcctgcaggtgcccgtgagccccagcagcaccaccagcagcagatgcagcagcagagacggcgagttcaccctgaccaccctgaagaaggaggccaagttcgagctgagagccttccacgaggacaagaagcccagcaagctgttcgaggacgacgagcacgagaaggagcagtactgcatcagaaaggtgagacccagcgaggagatgctggagctggagaaggagagaagagagctgatcagaagccaggccgtgaagaagaaccccggcatcgccgccaagtggtggaaccccccccaggagaagaccatcgaggagcagctggacgaggagcacctggagagccacaagaagtacaaggagagaaaggagagaagagcccagcaggagcagctgctgctgcagaagcagctgcagcagcagcagcagcagccccccagccagctgtgcaccgcccccgccagcagccacgagagagccagcatgatcgacaaggccaaggaggacatcgtgaccgagcagatcgacttcagcgccgccagaaagcagttccagctgatggagaacagcagacaggccgtggccaagggccagagcacccccagactgttcagcatcaagcccttctacagacccctgggcagcgtgaacagcgacaagcccctgaccaaccccagaccccccagcgtgggcggcccccccgaggacagcggcgccagcgccgccaagggccagaagagccccggcgccctggagacccccagcgccgccggcagccagggcaacaccgccagccagggcaaggagggcccctacagcgagcccagcaagagaggccccctgagcaagctgtgggccgaggacggcgagttcaccagcgccagagccgtgctgaccgtggtgaaggacgacgaccacggcatcctggaccagttcagcagaagcgtgaacgtgagcctgacccaggaggagctggacagcggcctggacgagctgagcgtgagaagccaggacaccaccgtgctggagaccctgagcaacgacttcagcatggacaacatcagcgacagcggcgccagcaacgagaccaccaacgccctgcaggagaacagcctggccgacttcagcctgccccagaccccccagaccgacaaccccagcgagggcagaggcgagggcgtgagcaagagcttcagcgaccacggcttctacagccccagcagcaccctgggcgacagccccctggtggacgaccccctggagtaccaggccggcctgctggtgcagaacgccatccagcaggccatcgccgagcaggtggacaaggccgtgagcaagaccagcagagacggcgccgagcagcagggccccgaggccaccgtggaggaggccgaggccgccgccttcggcagcgagaagccccagagcatgttcgagcccccccaggtgagcagccccgtgcaggagaagagagacgtgctgcccaagatcctgcccgccgaggacagagccctgagagagagaggccccccccagcccctgcccgccgtgcagcccagcggccccatcaacatggaggagaccagacccgagggcagctacttcagcaagtacagcgaggccgccgagctgagaagcaccgccagcctgctggccacccaggagagcgacgtgatggtgggccccttcaagctgagaagcagaaagcagagaaccctgagcatgatcgaggaggagatcagagccgcccaggagagagaggaggagctgaagagacagagacaggtgctgcagagcacccagagccccagaaccaagaacgcccccagcctgcccagcagaacctgctacaagaccgcccccggcaagatcgagaaggtgaagcccccccccagccccaccaccgagggccccagcctgcagcccgacctggcccccgaggaggccgccggcacccagagacccaagaacctgatgcagaccctgatggaggactacgagacccacaagagcaagagaagagagagaatggacgacagcagctacaccagcaagctgctgagctgcaaggtgaccagcgaggtgctggaggccaccagagtgaacagaagaaagagcgccctggccctgagatgggaggccggcatctacgccaaccaggaggaggaggacaacgagtag

SEQ ID NO: 71296 - DNA, 2565 bp, Artificial Sequence
  Description of Artificial Sequence: Synthetic coding sequence
atgatggcctacagcgacaccaccatgatgagcgacgacatcgactggctgagaagccacagaggcgtgtgcaaggtggacctgtacaaccccgagggccagcaggaccaggacagaaaggtgatctgcttcgtggacgtgagcaccctgaacgtggaggacaaggactacaaggacgccgccagcagcagcagcgagggcaacctgaacctgggcagcctggaggagaaggagatcatcgtgatcaaggacaccgagaagaaggaccagagcaagaccgagggcagcgtgtgcctgttcaagcaggcccccagcgaccccgtgagcgtgctgaactggctgctgagcgacctgcagaagtacgccctgggcttccagcacgccctgagccccagcaccagcacctgcaagcacaaggtgggcgacaccgagggcgagtaccacagagccagcagcgagaactgctacagcgtgtacgccgaccaggtgaacatcgactacctgatgaacagaccccagaacctgagactggagatgaccgccgccaagaacaccaacaacaaccagagccccagcgccccccccgccaagccccccagcacccagagagccgtgatcagccccgacggcgagtgcagcatcgacgacctgagcttctacgtgaacagactgagcagcctggtgatccagatggcccacaaggagatcaaggagaagctggagggcaagagcaagtgcctgcaccacagcatctgccccagccccggcaacaaggagagaatcagccccagaacccccgccagcaagatcgccagcgagatggcctacgaggccgtggagctgaccgccgccgagatgagaggcaccggcgaggagagcagagagggcggccagaagagcttcctgtacagcgagctgagcaacaagagcaagagcggcgacaagcagatgagccagagagagagcaaggagttcgccgacagcatcagcaagggcctgatggtgtacgccaaccaggtggccagcgacatgatggtgagcctgatgaagaccctgaaggtgcacagcagcggcaagcccatccccgccagcgtggtgctgaagagagtgctgctgagacacaccaaggagatcgtgagcgacctgatcgacagctgcatgaagaacctgcacaacatcaccggcgtgctgatgaccgacagcgacttcgtgagcgccgtgaagagaaacctgttcaaccagtggaagcagaacgccaccgacatcatggaggccatgctgaagagactggtgagcgccctgatcggcgaggagaaggagaccaagagccagagcctgagctacgccagcctgaaggccggcagccacgaccccaagtgcagaaaccagagcctggagttcagcaccatgaaggccgagatgaaggagagagacaagggcaagatgaagagcgacccctgcaagagcctgaccagcgccgagaaggtgggcgagcacatcctgaaggagggcctgaccatctggaaccagaagcagggcaacagctgcaaggtggccaccaaggcctgcagcaacaaggacgagaagggcgagaagatcaacgccagcaccgacagcctggccaaggacctgatcgtgagcgccctgaagctgatccagtaccacctgacccagcagaccaagggcaaggacacctgcgaggaggactgccccggcagcaccatgggctacatggcccagagcacccagtacgagaagtgcggcggcggccagagcgccaaggccctgagcgtgaagcagctggagagccacagagcccccggccccagcacctgccagaaggagaaccagcacctggacagccagaagatggacatgagcaacatcgtgctgatgctgatccagaagctgctgaacgagaaccccttcaagtgcgaggacccctgcgagggcgagaacaagtgcagcgagcccagagccagcaaggccgccagcatgagcaacagaagcgacaaggccgaggagcagtgccaggagcaccaggagctggactgcaccagcggcatgaagcaggccaacggccagttcatcgacaagctggtggagagcgtgatgaagctgtgcctgatcatggccaagtacagcaacgacggcgccgccctggccgagctggaggagcaggccgccagcgccaacaagcccaacttcagaggcaccagatgcatccacagcggcgccatgccccagaactaccaggacagcctgggccacgaggtgatcgtgaacaaccagtgcagcaccaacagcctgcagaagcagctgcaggccgtgctgcagtggatcgccgccagccagttcaacgtgcccatgctgtacttcatgggcgacaaggacggccagctggagaagctgccccaggtgagcgccaaggccgccgagaagggctacagcgtgggcggcctgctgcaggaggtgatgaagttcgccaaggagagacagcccgacgaggccgtgggcaaggtggccagaaagcagctgctggactggctgctggccaacctgtag

SEQ ID NO: 71297 - DNA, 2538 bp, Artificial Sequence
  Description of Artificial Sequence: Synthetic coding sequence
atgagcgacgacatcgactggctgagaagccacagaggcgtgtgcaaggtggacctgtacaaccccgagggccagcaggaccaggacagaaaggtgatctgcttcgtggacgtgagcaccctgaacgtggaggacaaggactacaaggacgccgccagcagcagcagcgagggcaacctgaacctgggcagcctggaggagaaggagatcatcgtgatcaaggacaccgagaagaaggaccagagcaagaccgagggcagcgtgtgcctgttcaagcaggcccccagcgaccccgtgagcgtgctgaactggctgctgagcgacctgcagaagtacgccctgggcttccagcacgccctgagccccagcaccagcacctgcaagcacaaggtgggcgacaccgagggcgagtaccacagagccagcagcgagaactgctacagcgtgtacgccgaccaggtgaacatcgactacctgatgaacagaccccagaacctgagactggagatgaccgccgccaagaacaccaacaacaaccagagccccagcgccccccccgccaagccccccagcacccagagagccgtgatcagccccgacggcgagtgcagcatcgacgacctgagcttctacgtgaacagactgagcagcctggtgatccagatggcccacaaggagatcaaggagaagctggagggcaagagcaagtgcctgcaccacagcatctgccccagccccggcaacaaggagagaatcagccccagaacccccgccagcaagatcgccagcgagatggcctacgaggccgtggagctgaccgccgccgagatgagaggcaccggcgaggagagcagagagggcggccagaagagcttcctgtacagcgagctgagcaacaagagcaagagcggcgacaagcagatgagccagagagagagcaaggagttcgccgacagcatcagcaagggcctgatggtgtacgccaaccaggtggccagcgacatgatggtgagcctgatgaagaccctgaaggtgcacagcagcggcaagcccatccccgccagcgtggtgctgaagagagtgctgctgagacacaccaaggagatcgtgagcgacctgatcgacagctgcatgaagaacctgcacaacatcaccggcgtgctgatgaccgacagcgacttcgtgagcgccgtgaagagaaacctgttcaaccagtggaagcagaacgccaccgacatcatggaggccatgctgaagagactggtgagcgccctgatcggcgaggagaaggagaccaagagccagagcctgagctacgccagcctgaaggccggcagccacgaccccaagtgcagaaaccagagcctggagttcagcaccatgaaggccgagatgaaggagagagacaagggcaagatgaagagcgacccctgcaagagcctgaccagcgccgagaaggtgggcgagcacatcctgaaggagggcctgaccatctggaaccagaagcagggcaacagctgcaaggtggccaccaaggcctgcagcaacaaggacgagaagggcgagaagatcaacgccagcaccgacagcctggccaaggacctgatcgtgagcgccctgaagctgatccagtaccacctgacccagcagaccaagggcaaggacacctgcgaggaggactgccccggcagcaccatgggctacatggcccagagcacccagtacgagaagtgcggcggcggccagagcgccaaggccctgagcgtgaagcagctggagagccacagagcccccggccccagcacctgccagaaggagaaccagcacctggacagccagaagatggacatgagcaacatcgtgctgatgctgatccagaagctgctgaacgagaaccccttcaagtgcgaggacccctgcgagggcgagaacaagtgcagcgagcccagagccagcaaggccgccagcatgagcaacagaagcgacaaggccgaggagcagtgccaggagcaccaggagctggactgcaccagcggcatgaagcaggccaacggccagttcatcgacaagctggtggagagcgtgatgaagctgtgcctgatcatggccaagtacagcaacgacggcgccgccctggccgagctggaggagcaggccgccagcgccaacaagcccaacttcagaggcaccagatgcatccacagcggcgccatgccccagaactaccaggacagcctgggccacgaggtgatcgtgaacaaccagtgcagcaccaacagcctgcagaagcagctgcaggccgtgctgcagtggatcgccgccagccagttcaacgtgcccatgctgtacttcatgggcgacaaggacggccagctggagaagctgccccaggtgagcgccaaggccgccgagaagggctacagcgtgggcggcctgctgcaggaggtgatgaagttcgccaaggagagacagcccgacgaggccgtgggcaaggtggccagaaagcagctgctggactggctgctggccaacctgtag

SEQ ID NO: 71298 - DNA, 1416 bp, Artificial Sequence
  Description of Artificial Sequence: Synthetic coding sequence
atgagcgacgacatcgactggctgagaagccacagaggcgtgtgcaaggtggacctgtacaaccccgagggccagcaggaccaggacagaaaggtgatctgcttcgtggacgtgagcaccctgaacgtggaggacaaggactacaaggacgccgccagcagcagcagcgagggcaacctgaacctgggcagcctggaggagaaggagatcatcgtgatcaaggacaccgagaagaaggaccagagcaagaccgagggcagcgtgtgcctgttcaagcaggcccccagcgaccccgtgagcgtgctgaactggctgctgagcgacctgcagaagtacgccctgggcttccagcacgccctgagccccagcaccagcacctgcaagcacaaggtgggcgacaccgagggcgagtaccacagagccagcagcgagaactgctacagcgtgtacgccgaccaggtgaacatcgactacctgatgaacagaccccagaacctgagactggagatgaccgccgccaagaacaccaacaacaaccagaacacctgcgaggaggactgccccggcagcaccatgggctacatggcccagagcacccagtacgagaagtgcggcggcggccagagcgccaaggccctgagcgtgaagcagctggagagccacagagcccccggccccagcacctgccagaaggagaaccagcacctggacagccagaagatggacatgagcaacatcgtgctgatgctgatccagaagctgctgaacgagaaccccttcaagtgcgaggacccctgcgagggcgagaacaagtgcagcgagcccagagccagcaaggccgccagcatgagcaacagaagcgacaaggccgaggagcagtgccaggagcaccaggagctggactgcaccagcggcatgaagcaggccaacggccagttcatcgacaagctggtggagagcgtgatgaagctgtgcctgatcatggccaagtacagcaacgacggcgccgccctggccgagctggaggagcaggccgccagcgccaacaagcccaacttcagaggcaccagatgcatccacagcggcgccatgccccagaactaccaggacagcctgggccacgaggtgatcgtgaacaaccagtgcagcaccaacagcctgcagaagcagctgcaggccgtgctgcagtggatcgccgccagccagttcaacgtgcccatgctgtacttcatgggcgacaaggacggccagctggagaagctgccccaggtgagcgccaaggccgccgagaagggctacagcgtgggcggcctgctgcaggaggtgatgaagttcgccaaggagagacagcccgacgaggccgtgggcaaggtggccagaaagcagctgctggactggctgctggccaacctgtag

SEQ ID NO: 71299 - DNA, 2538 bp, Artificial Sequence; identical to SEQ ID NO: 71297
  Description of Artificial Sequence: Synthetic coding sequence

SEQ ID NO: 71300 - DNA, 765 bp, Artificial Sequence
  Description of Artificial Sequence: Synthetic coding sequence
atgagcgacgacatcgactggctgagaagccacagaggcgtgtgcaaggtggacctgtacaaccccgagggccagcaggaccaggacagaaaggtgatctgcttcgtggacgtgagcaccctgaacgtggaggacaaggactacaaggacgccgccagcagcagcagcgagggcaacctgaacctgggcagcctggaggagaaggagatcatcgtgatcaaggacaccgagaagaaggaccagagcaagaccgagggcagcgtgtgcctgttcaagcaggcccccagcgaccccgtgagcgtgctgaactggctgctgagcgacctgcagaagtacgccctgggcttccagcacgccctgagccccagcaccagcacctgcaagcacaaggtgggcgacaccgagggcgagtaccacagagccagcagcgagaactgctacagcgtgtacgccgaccaggtgaacatcgactacctgatgaacagaccccagaacctgagactggagatgaccgccgccaagaacaccaacaacaaccagagccccagcgccccccccgccaagccccccagcacccagagagccgtgatcagccccgacggcgagtgcagcatcgacgacctgagcttctacgtgaacagactgagcagcctggtgatccagatggcccacaaggagatcaaggagaagctggagggcaagagcaagtgcctgcaccacagcatctgccccagccccggcaacaaggagagaatcagcccctag

SEQ ID NO: 71301 - DNA, 642 bp, Artificial Sequence
  Description of Artificial Sequence: Synthetic coding sequence
atgagcgacgacatcgactggctgagaagccacagaggcgtgtgcaaggtggacctgtacaaccccgagggccagcaggaccaggacagaaaggtgatctgcttcgtggacgtgagcaccctgaacgtggaggacaaggactacaaggacgccgccagcagcagcagcgagggcaacctgaacctgggcagcctggaggagaaggagatcatcgtgatcaaggacaccgagaagaaggaccagagcaagaccgagggcagcgtgtgcctgttcaagcaggcccccagcgaccccgtgagcgtgctgaactggctgctgagcgacctgcagaagtacgccctgggcttccagcacgccctgagccccagcaccagcacctgcaagcacaaggtgggcgacaccgagggcgagtaccacagagccagcagcgagaactgctacagcgtgtacgccgaccaggtgaacatcgactacctgatgaacagaccccagaacctgagactggagatgaccgccgccaagaacaccaacaacaaccagaacacctgcgaggaggactgccccggcagcaccatgggctacatggcccagagcacccagtacgagaagtgcggcggcggccagagcgccaaggccctgtag

SEQ ID NO: 71302 - DNA, 552 bp, Artificial Sequence
  Description of Artificial Sequence: Synthetic coding sequence
atggacaactgcctggccgccgccgccctgaacggcgtggacagaagaagcctgcagagaagcgccagactggccctggaggtgctggagagagccaagagaagagccgtggactggcacgccctggagagacccaagggctgcatgggcgtgctggccagagaggccccccacctggagaagcagcccgccgccggcccccagagagtgctgcccggcgagaagtactacagcagcgtgcccgaggagggcggcgccacccacgtgtacagataccacagaggcgagagcaagctgcacatgtgcctggacatcggcaacggccagagaaaggacagaaagaagaccagcctgggccccggcggcagctaccagatcagcgagcacgcccccgaggccagccagcccgccgagaacatcagcaaggacctgtacatcgaggtgtaccccggcacctacagcgtgaccgtgggcagcaacgacctgaccaagaagacccacgtggtggccgtggacagcggccagagcgtggacctggtgttccccgtgtag

SEQ ID NO: 71303 - DNA, 552 bp, Artificial Sequence
  Description of Artificial Sequence: Synthetic coding sequence
atggacaactgcctggccgccgccgccctgaacggcgtggacagaagaagcctgcagagaagcgccagactggccctggaggtgctggagagagccaagagaagagccgtggactggcacgccctggagagacccaagggctgcatgggcgtgctggccagagaggccccccacctggagaagcagcccgccgccggcccccagagagtgctgcccggcgagagagaggagagaccccccaccctgagcgccagcttcagaaccatggccgagttcatggactacaccagcagccagtgcggcaagtactacagcagcgtgcccgaggagggcggcgccacccacgtgtacagataccacagaggcgagagcaagctgcacatgtgcctggacatcggcaacggccaggccgagaacatcagcaaggacctgtacatcgaggtgtaccccggcacctacagcgtgaccgtgggcagcaacgacctgaccaagaagacccacgtggtggccgtggacagcggccagagcgtggacctggtgttccccgtgtag

SEQ ID NO: 71304 - DNA, 633 bp, Artificial Sequence
  Description of Artificial Sequence: Synthetic coding sequence
atggacaactgcctggccgccgccgccctgaacggcgtggacagaagaagcctgcagagaagcgccagactggccctggaggtgctggagagagccaagagaagagccgtggactggcacgccctggagagacccaagggctgcatgggcgtgctggccagagaggccccccacctggagaagcagcccgccgccggcccccagagagtgctgcccggcgagagagaggagagaccccccaccctgagcgccagcttcagaaccatggccgagttcatggactacaccagcagccagtgcggcaagtactacagcagcgtgcccgaggagggcggcgccacccacgtgtacagataccacagaggcgagagcaagctgcacatgtgcctggacatcggcaacggccagagaaaggacagaaagaagaccagcctgggccccggcggcagctaccagatcagcgagcacgcccccgaggccagccagcccgccgagaacatcagcaaggacctgtacatcgaggtgtaccccggcacctacagcgtgaccgtgggcagcaacgacctgaccaagaagacccacgtggtggccgtggacagcggccagagcgtggacctggtgttccccgtgtag

SEQ ID NO: 71305 - DNA, 552 bp, Artificial Sequence; identical to SEQ ID NO: 71302
  Description of Artificial Sequence: Synthetic coding sequence

SEQ ID NO: 71306 - DNA, 633 bp, Artificial Sequence; identical to SEQ ID NO: 71304
  Description of Artificial Sequence: Synthetic coding sequence

SEQ ID NO: 71307 - DNA, 1479 bp, Artificial Sequence
  Description of Artificial Sequence: Synthetic coding sequence
atgggcttccagagaagattcttccaccaggaccagagccccgtgggcggcctgaccgccgaggacatcgagaaggccagacaggccaaggccagacccgagaacaagcagcacaagcagaccctgagcgagcacgccagagagagaaaggtgcccgtgaccagaatcggcagactggccaacttcggcggcctggccgtgggcctgggcttcggcgccctggccgaggtggccaagaagagcctgagaagcgaggaccccagcggcaagaaggccgtgctgggcagcagccccttcctgagcgaggccaacgccgagagaatcgtgagaaccctgtgcaaggtgagaggcgccgccctgaagctgggccagatgctgagcatccaggacgacgccttcatcaacccccacctggccaagatcttcgagagagtgagacagagcgccgacttcatgcccctgaagcagatgatgaagaccctgaacaacgacctgggccccaactggagagacaagctggagtacttcgaggagagacccttcgccgccgccagcatcggccaggtgcacctggccagaatgaagggcggcagagaggtggccatgaagatccagtaccccggcgtggcccagagcatcaacagcgacgtgaacaacctgatggccgtgctgaacatgagcaacatgctgcccgagggcctgttccccgagcacctgatcgacgtgctgagaagagagctggccctggagtgcgactaccagagagaggccgcctgcgccagaaagttcagagacctgctgaagggccaccccttcttctacgtgcccgagatcgtggacgagctgtgcagcccccacgtgctgaccaccgagctggtgagcggcttccccctggaccaggccgagggcctgagccaggagatcagaaacgagatctgctacaacatcctggtgctgtgcctgagagagctgttcgagttccacttcatgcagaccgaccccaactggagcaacttcttctacgacccccagcagcacaaggtggccctgctggacttcggcgccaccagagagtacgacagaagcttcaccgacctgtacatccagatcatcagagccgccgccgacagagacagagagaccgtgagagccaagagcatcgagatgaagttcctgaccggctacgaggtgaaggtgatggaggacgcccacctggacgccatcctgatcctgggcgaggccttcgccagcgacgagcccttcgacttcggcacccagagcaccaccgagaagatccacaacctgatccccgtgatgctgagacacagactggtgcccccccccgaggagacctacagcctgcacagaaagatgggcggcagcttcctgatctgcagcaagctgaaggccagattcccctgcaaggccatgttcgaggaggcctacagcaactactgcaagagacaggcccagcagtag

SEQ ID NO: 71308 - DNA, 1719 bp, Artificial Sequence
  Description of Artificial Sequence: Synthetic coding sequence
atggccgccatcctgggcgacaccatcatggtggccaagggcctggtgaagctgacccaggccgccgtggagacccacctgcagcacctgggcatcggcggcgagctgatcatgggccccgcccccgcctacgtggccagcggccccttcagagaggccggcttccccggccaggccagcagccccctgggcagagccaacggcagactgttcgccaaccccagagacagcttcagcgccatgggcttccagagaagattcttccaccaggaccagagccccgtgggcggcctgaccgccgaggacatcgagaaggccagacaggccaaggccagacccgagaacaagcagcacaagcagaccctgagcgagcacgccagagagagaaaggtgcccgtgaccagaatcggcagactggccaacttcggcggcctggccgtgggcctgggcttcggcgccctggccgaggtggccaagaagagcctgagaagcgaggaccccagcggcaagaaggccgtgctgggcagcagccccttcctgagcgaggccaacgccgagagaatcgtgagaaccctgtgcaaggtgagaggcgccgccctgaagctgggccagatgctgagcatccaggacgacgccttcatcaacccccacctggccaagatcttcgagagagtgagacagagcgccgacttcatgcccctgaagcagatgatgaagaccctgaacaacgacctgggccccaactggagagacaagctggagtacttcgaggagagacccttcgccgccgccagcatcggccaggtgcacctggccagaatgaagggcggcagagaggtggccatgaagatccagtaccccggcgtggcccagagcatcaacagcgacgtgaacaacctgatggccgtgctgaacatgagcaacatgctgcccgagggcctgttccccgagcacctgatcgacgtgctgagaagagagctggccctggagtgcgactaccagagagaggccgcctgcgccagaaagttcagagacctgctgaagggccaccccttcttctacgtgcccgagatcgtggacgagctgtgcagcccccacgtgctgaccaccgagctggtgagcggcttccccctggaccaggccgagggcctgagccaggagatcagaaacgagatctgctacaacatcctggtgctgtgcctgagagagctgttcgagttccacttcatgcagaccgaccccaactggagcaacttcttctacgacccccagcagcacaaggtggccctgctggacttcggcgccaccagagagtacgacagaagcttcaccgacctgtacatccagatcatcagagccgccgccgacagagacagagagaccgtgagagccaagagcatcgagatgaagttcctgaccggctacgaggtgaaggtgatggaggacgcccacctggacgccatcctgatcctgggcgaggccttcgccagcgacgagcccttcgacttcggcacccagagcaccaccgagaagatccacaacctgatccccgtgatgctgagacacagactggtgcccccccccgaggagacctacagcctgcacagaaagatgggcggcagcttcctgatctgcagcaagctgaaggccagattcccctgcaaggccatgttcgaggaggcctacagcaactactgcaagagacaggcccagcagtag

SEQ ID NO: 71309 - DNA, 1944 bp, Artificial Sequence
  Description of Artificial Sequence: Synthetic coding sequence
atggccgccatcctgggcgacaccatcatggtggccaagggcctggtgaagctgacccaggccgccgtggagacccacctgcagcacctgggcatcggcggcgagctgatcatggccgccagagccctgcagagcaccgccgtggagcagatcggcatgttcctgggcaaggtgcagggccaggacaagcacgaggagtacttcgccgagaacttcggcggccccgagggcgagttccacttcagcgtgccccacgccgccggcgccagcaccgacttcagcagcgccagcgcccccgaccagagcgccccccccagcctgggccacgcccacagcgagggccccgcccccgcctacgtggccagcggccccttcagagaggccggcttccccggccaggccagcagccccctgggcagagccaacggcagactgttcgccaaccccagagacagcttcagcgccatgggcttccagagaagattcttccaccaggaccagagccccgtgggcggcctgaccgccgaggacatcgagaaggccagacaggccaaggccagacccgagaacaagcagcacaagcagaccctgagcgagcacgccagagagagaaaggtgcccgtgaccagaatcggcagactggccaacttcggcggcctggccgtgggcctgggcttcggcgccctggccgaggtggccaagaagagcctgagaagcgaggaccccagcggcaagaaggccgtgctgggcagcagccccttcctgagcgaggccaacgccgagagaatcgtgagaaccctgtgcaaggtgagaggcgccgccctgaagctgggccagatgctgagcatccaggacgacgccttcatcaacccccacctggccaagatcttcgagagagtgagacagagcgccgacttcatgcccctgaagcagatgatgaagaccctgaacaacgacctgggccccaactggagagacaagctggagtacttcgaggagagacccttcgccgccgccagcatcggccaggtgcacctggccagaatgaagggcggcagagaggtggccatgaagatccagtaccccggcgtggcccagagcatcaacagcgacgtgaacaacctgatggccgtgctgaacatgagcaacatgctgcccgagggcctgttccccgagcacctgatcgacgtgctgagaagagagctggccctggagtgcgactaccagagagaggccgcctgcgccagaaagttcagagacctgctgaagggccaccccttcttctacgtgcccgagatcgtggacgagctgtgcagcccccacgtgctgaccaccgagctggtgagcggcttccccctggaccaggccgagggcctgagccaggagatcagaaacgagatctgctacaacatcctggtgctgtgcctgagagagctgttcgagttccacttcatgcagaccgaccccaactggagcaacttcttctacgacccccagcagcacaaggtggccctgctggacttcggcgccaccagagagtacgacagaagcttcaccgacctgtacatccagatcatcagagccgccgccgacagagacagagagaccgtgagagccaagagcatcgagatgaagttcctgaccggctacgaggtgaaggtgatggaggacgcccacctggacgccatcctgatcctgggcgaggccttcgccagcgacgagcccttcgacttcggcacccagagcaccaccgagaagatccacaacctgatccccgtgatgctgagacacagactggtgcccccccccgaggagacctacagcctgcacagaaagatgggcggcagcttcctgatctgcagcaagctgaaggccagattcccctgcaaggccatgttcgaggaggcctacagcaactactgcaagagacaggcccagcagtag

SEQ ID NO: 71310 - DNA, 1788 bp, Artificial Sequence
  Description of Artificial Sequence: Synthetic coding sequence
atgttcctgggcaaggtgcagggccaggacaagcacgaggagtacttcgccgagaacttcggcggccccgagggcgagttccacttcagcgtgccccacgccgccggcgccagcaccgacttcagcagcgccagcgcccccgaccagagcgccccccccagcctgggccacgcccacagcgagggccccgcccccgcctacgtggccagcggccccttcagagaggccggcttccccggccaggccagcagccccctgggcagagccaacggcagactgttcgccaaccccagagacagcttcagcgccatgggcttccagagaagattcttccaccaggaccagagccccgtgggcggcctgaccgccgaggacatcgagaaggccagacaggccaaggccagacccgagaacaagcagcacaagcagaccctgagcgagcacgccagagagagaaaggtgcccgtgaccagaatcggcagactggccaacttcggcggcctggccgtgggcctgggcttcggcgccctggccgaggtggccaagaagagcctgagaagcgaggaccccagcggcaagaaggccgtgctgggcagcagccccttcctgagcgaggccaacgccgagagaatcgtgagaaccctgtgcaaggtgagaggcgccgccctgaagctgggccagatgctgagcatccaggacgacgccttcatcaacccccacctggccaagatcttcgagagagtgagacagagcgccgacttcatgcccctgaagcagatgatgaagaccctgaacaacgacctgggccccaactggagagacaagctggagtacttcgaggagagacccttcgccgccgccagcatcggccaggtgcacctggccagaatgaagggcggcagagaggtggccatgaagatccagtaccccggcgtggcccagagcatcaacagcgacgtgaacaacctgatggccgtgctgaacatgagcaacatgctgcccgagggcctgttccccgagcacctgatcgacgtgctgagaagagagctggccctggagtgcgactaccagagagaggccgcctgcgccagaaagttcagagacctgctgaagggccaccccttcttctacgtgcccgagatcgtggacgagctgtgcagcccccacgtgctgaccaccgagctggtgagcggcttccccctggaccaggccgagggcctgagccaggagatcagaaacgagatctgctacaacatcctggtgctgtgcctgagagagctgttcgagttccacttcatgcagaccgaccccaactggagcaacttcttctacgacccccagcagcacaaggtggccctgctggacttcggcgccaccagagagtacgacagaagcttcaccgacctgtacatccagatcatcagagccgccgccgacagagacagagagaccgtgagagccaagagcatcgagatgaagttcctgaccggctacgaggtgaaggtgatggaggacgcccacctggacgccatcctgatcctgggcgaggccttcgccagcgacgagcccttcgacttcggcacccagagcaccaccgagaagatccacaacctgatccccgtgatgctgagacacagactggtgcccccccccgaggagacctacagcctgcacagaaagatgggcggcagcttcctgatctgcagcaagctgaaggccagattcccctgcaaggccatgttcgaggaggcctacagcaactactgcaagagacaggcccagcagtag

SEQ ID NO: 71311 - DNA, 1944 bp, Artificial Sequence; identical to SEQ ID NO: 71309
  Description of Artificial Sequence: Synthetic coding sequence

SEQ ID NO: 71312 - DNA, 1797 bp, Artificial Sequence
  Description of Artificial Sequence: Synthetic coding sequence
atggccgccagagccctgcagagcaccgccgtggagcagatcggcatgttcctgggcaaggtgcagggccaggacaagcacgaggagtacttcgccgagaacttcggcggccccgagggcgagttccacttcagcagcgccagcgcccccgaccagagcgccccccccagcctgggccacgcccacagcgagggccccgcccccgcctacgtggccagcggccccttcagagaggccggcttccccggccaggccagcagccccctgggcagagccaacggcagactgttcgccaaccccagagacagcttcagcgccatgggcttccagagaagattcttccaccaggaccagagccccgtgggcggcctgaccgccgaggacatcgagaaggccagacaggccaaggccagacccgagaacaagcagcacaagcagaccctgagcgagcacgccagagagagaaaggtgcccgtgaccagaatcggcagactggccaacttcggcggcctggccgtgggcctgggcttcggcgccctggccgaggtggccaagaagagcctgagaagcgaggaccccagcggcaagaaggccgtgctgggcagcagccccttcctgagcgaggccaacgccgagagaatcgtgagaaccctgtgcaaggtgagaggcgccgccctgaagctgggccagatgctgagcatccaggacgacgccttcatcaacccccacctggccaagatcttcgagagagtgagacagagcgccgacttcatgcccctgaagcagatgatgaagaccctgaacaacgacctgggccccaactggagagacaagctggagtacttcgaggagagacccttcgccgccgccagcatcggccaggtgcacctggccagaatgaagggcggcagagaggtggccatgaagatccagtaccccggcgtggcccagagcatcaacagcgacgtgaacaacctgatggccgtgctgaacatgagcaacatgctgcccgagggcctgttccccgagcacctgatcgacgtgctgagaagagagctggccctggagtgcgactaccagagagaggccgcctgcgccagaaagttcagagacctgctgaagggccaccccttcttctacgtgcccgagatcgtggacgagctgtgcagcccccacgtgctgaccaccgagctggtgagcggcttccccctggaccaggccgagggcctgagccaggagatcagaaacgagatctgctacaacatcctggtgctgtgcctgagagagctgttcgagttccacttcatgcagaccgaccccaactggagcaacttcttctacgacccccagcagcacaaggtggccctgctggacttcggcgccaccagagagtacgacagaagcttcaccgacctgtacatccagatcatcagagccgccgccgacagagacagagagaccgtgagagccaagagcatcgagatgaagttcctgaccggctacgaggtgaaggtgatggaggacgcccacctggacgccatcctgatcctgggcgaggccttcgccagcgacgagcccttcgacttcggcacccagagcaccaccgagaagatccacaacctgatccccgtgatgctgagacacagactggtgcccccccccgaggagacctacagcctgcacagaaagatgggcggcagcttcctgatctgcagcaagctgaaggccagattcccctgcaaggccatgttcgaggaggcctacagcaactactgcaagagacaggcccagcagtag

SEQ ID NO: 71313 - DNA, 966 bp, Artificial Sequence
  Description of Artificial Sequence: Synthetic coding sequence
atgctgagcatccaggacgacgccttcatcaacccccacctggccaagatcttcgagagagtgagacagagcgccgacttcatgcccctgaagcagatgatgtaccccggcgtggcccagagcatcaacagcgacgtgaacaacctgatggccgtgctgaacatgagcaacatgctgcccgagggcctgttccccgagcacctgatcgacgtgctgagaagagagctggccctggagtgcgactaccagagagaggccgcctgcgccagaaagttcagagacctgctgaagggccaccccttcttctacgtgcccgagatcgtggacgagctgtgcagcccccacgtgctgaccaccgagctggtgagcggcttccccctggaccaggccgagggcctgagccaggagatcagaaacgagatctgctacaacatcctggtgctgtgcctgagagagctgttcgagttccacttcatgcagaccgaccccaactggagcaacttcttctacgacccccagcagcacaaggtggccctgctggacttcggcgccaccagagagtacgacagaagcttcaccgacctgtacatccagatcatcagagccgccgccgacagagacagagagaccgtgagagccaagagcatcgagatgaagttcctgaccggctacgaggtgaaggtgatggaggacgcccacctggacgccatcctgatcctgggcgaggccttcgccagcgacgagcccttcgacttcggcacccagagcaccaccgagaagatccacaacctgatccccgtgatgctgagacacagactggtgcccccccccgaggagacctacagcctgcacagaaagatgggcggcagcttcctgatctgcagcaagctgaaggccagattcccctgcaaggccatgttcgaggaggcctacagcaactactgcaagagacaggcccagcagtag

SEQ ID NO: 71314 - DNA, 1107 bp, Artificial Sequence
  Description of Artificial Sequence: Synthetic coding sequence
atgctgagcatccaggacgacgccttcatcaacccccacctggccaagatcttcgagagagtgagacagagcgccgacttcatgcccctgaagcagatgatgaagaccctgaacaacgacctgggccccaactggagagacaagctggagtacttcgaggagagacccttcgccgccgccagcatcggccaggtgcacctggccagaatgaagggcggcagagaggtggccatgaagatccagtaccccggcgtggcccagagcatcaacagcgacgtgaacaacctgatggccgtgctgaacatgagcaacatgctgcccgagggcctgttccccgagcacctgatcgacgtgctgagaagagagctggccctggagtgcgactaccagagagaggccgcctgcgccagaaagttcagagacctgctgaagggccaccccttcttctacgtgcccgagatcgtggacgagctgtgcagcccccacgtgctgaccaccgagctggtgagcggcttccccctggaccaggccgagggcctgagccaggagatcagaaacgagatctgctacaacatcctggtgctgtgcctgagagagctgttcgagttccacttcatgcagaccgaccccaactggagcaacttcttctacgacccccagcagcacaaggtggccctgctggacttcggcgccaccagagagtacgacagaagcttcaccgacctgtacatccagatcatcagagccgccgccgacagagacagagagaccgtgagagccaagagcatcgagatgaagttcctgaccggctacgaggtgaaggtgatggaggacgcccacctggacgccatcctgatcctgggcgaggccttcgccagcgacgagcccttcgacttcggcacccagagcaccaccgagaagatccacaacctgatccccgtgatgctgagacacagactggtgcccccccccgaggagacctacagcctgcacagaaagatgggcggcagcttcctgatctgcagcaagctgaaggccagattcccctgcaaggccatgttcgaggaggcctacagcaactactgcaagagacaggcccagcagtag

SEQ ID NO: 71315 - DNA, 3591 bp, Artificial Sequence
  Description of Artificial Sequence: Synthetic coding sequence
atgcccaccgccgagagcgaggccaaggtgaagaccaaggtgagattcgaggagctgctgaagacccacagcgacctgatgagagagaagaagaagctgaagaagaagctggtgagaagcgaggagaacatcagccccgacaccatcagaagcaacctgcactacatgaaggagaccaccagcgacgaccccgacaccatcagaagcaacctgccccacatcaaggagaccaccagcgacgacgtgagcgccgccaacaccaacaacctgaagaagagcaccagagtgaccaagaacaagctgagaaacacccagctggccaccgagaaccccaacggcgacgccagcgtggaggaggacaagcagggcaagcccaacaagaaggtgatcaagaccgtgccccagctgaccacccaggacctgaagcccgagacccccgagaacaaggtggacagcacccaccagaagacccacaccaagccccagcccggcgtggaccaccagaagagcgagaaggccaacgagggcagagaggagaccgacctggaggaggacgaggagctgatgcaggcctaccagtgccacgtgaccgaggagatggccaaggagatcaagagaaagatcagaaagaagctgaaggagcagctgacctacttccccagcgacaccctgttccacgacgacaagctgagcagcgagaagagaaagaagaagaaggaggtgcccgtgttcagcaaggccgagaccagcaccctgaccatcagcggcgacaccgtggagggcgagcagaagaaggagagcagcgtgagaagcgtgagcagcgacagccaccaggacgacgagatcagcagcatggagcagagcaccgaggacagcatgcaggacgacaccaagcccaagcccaagaagaccaagaagaagaccaaggccgtggccgacaacaacgaggacgtggacggcgacggcgtgcacgagatcaccagcagagacagccccgtgtaccccaagtgcctgctggacgacgacctggtgctgggcgtgtacatccacagaaccgacagactgaagagcgacttcatgatcagccaccccatggtgaagatccacgtggtggacgagcacaccggccagtacgtgaagaaggacgacagcggcagacccgtgagcagctactacgagaaggagaacgtggactacatcctgcccatcatgacccagccctacgacttcaagcagctgaagagcagactgcccgagtgggaggagcagatcgtgttcaacgagaacttcccctacctgctgagaggcagcgacgagagccccaaggtgatcctgttcttcgagatcctggacttcctgagcgtggacgagatcaagaacaacagcgaggtgcagaaccaggagtgcggcttcagaaagatcgcctgggccttcctgaagctgctgggcgccaacggcaacgccaacatcaacagcaagctgagactgcagctgtactacccccccaccaagcccagaagccccctgagcgtggtggaggccttcgagtggtggagcaagtgccccagaaaccactaccccagcaccctgtacgtgaccgtgagaggcctgaaggtgcccgactgcatcaagcccagctacagaagcatgatggccctgcaggaggagaagggcaagcccgtgcactgcgagagacaccacgagagcagcagcgtggacaccgagcccggcctggaggagagcaaggaggtgatcaagtggaagagactgcccggccaggcctgcagaatccccaacaagcacctgttcagcctgaacgccggcgagagaggctgcttctgcctggacttcagccacaacggcagaatcctggccgccgcctgcgccagcagagacggctaccccatcatcctgtacgagatccccagcggcagattcatgagagagctgtgcggccacctgaacatcatctacgacctgagctggagcaaggacgaccactacatcctgaccagcagcagcgacggcaccgccagaatctggaagaacgagatcaacaacaccaacaccttcagagtgctgccccaccccagcttcgtgtacaccgccaagttccaccccgccgtgagagagctggtggtgaccggctgctacgacagcatgatcagaatctggaaggtggagatgagagaggacagcgccatcctggtgagacagttcgacgtgcacaagagcttcatcaacagcctgtgcttcgacaccgagggccaccacatgtacagcggcgactgcaccggcgtgatcgtggtgtggaacacctacgtgaagatcaacgacctggagcacagcgtgcaccactggaccatcaacaaggagatcaaggagaccgagttcaagggcatccccatcagctacctggagatccaccccaacggcaagagactgctgatccacaccaaggacagcaccctgagaatcatggacctgagaatcctggtggccagaaagttcgtgggcgccgccaactacagagagaagatccacagcaccctgaccccctgcggcaccttcctgttcgccggcagcgaggacggcatcgtgtacgtgtggaaccccgagaccggcgagcaggtggccatgtacagcgacctgcccttcaagagccccatcagagacatcagctaccaccccttcgagaacatggtggccttctgcgccttcggccagaacgagcccatcctgctgtacatctacgacttccacgtggcccagcaggaggccgagatgttcaagagatacaacggcaccttccccctgcccggcatccaccagagccaggacgccctgtgcacctgccccaagctgccccaccagggcagcttccagatcgacgagttcgtgcacaccgagagcagcagcaccaagatgcagctggtgaagcagagactggagaccgtgaccgaggtgatcagaagctgcgccgccaaggtgaacaagaacctgagcttcaccagcccccccgccgtgagcagccagcagagcaagctgaagcagagcaacatgctgaccgcccaggagatcctgcaccagttcggcttcacccagaccggcatcatcagcatcgagagaaagccctgcaaccaccaggtggacaccgcccccaccgtggtggccctgtacgactacaccgccaacagaagcgacgagctgaccatccacagaggcgacatcatcagagtgttcttcaaggacaacgaggactggtggtacggcagcatcggcaagggccaggagggctacttccccgccaaccacgtggccagcgagaccctgtaccaggagctgccccccgagatcaaggagagaagcccccccctgagccccgaggagaagaccaagatcgagaagagccccgccccccagaagcagagcatcaacaagaacaagagccaggacttcagactgggcagcgagagcatgacccacagcgagatgagaaaggagcagagccacgaggaccagggccacatcatggacaccagaatgagaaagaacaagcaggccggcagaaaggtgaccctgatcgagtag

SEQ ID NO: 71316 - DNA, 3162 bp, Artificial Sequence
  Description of Artificial Sequence: Synthetic coding sequence
atgcccaccgccgagagcgaggccaaggtgaagaccaaggtgagattcgaggagctgctgaagacccacagcgacctgatgagagagaagaagaagctgaagaagaagctggtgagaagcgaggagaacatcagccccgacaccatcagaagcaacctgcactacatgaaggagaccaccagcgacgaccccgacaccatcagaagcaacctgccccacatcaaggagaccaccagcgacgacgtgagcgccgccaacaccaacaacctgaagaagagcaccagagtgaccaagaacaagctgagaaacacccagctggccaccgagaaccccaacggcgacgccagcgtggaggaggacaagcagggcaagcccaacaagaaggtgatcaagaccgtgccccagctgaccacccaggacctgaagcccgagacccccgagaacaaggtggacagcacccaccagaagacccacaccaagccccagcccggcgtggaccaccagaagagcgagaaggccaacgagggcagagaggagaccgacctggaggaggacgaggagctgatgcaggcctaccagtgccacgtgaccgaggagatggccaaggagatcaagagaaagatcagaaagaagctgaaggagcagctgacctacttccccagcgacaccctgttccacgacgacaagctgagcagcgagaagagaaagaagaagaaggaggtgcccgtgttcagcaaggccgagaccagcaccctgaccatcagcggcgacaccgtggagggcgagcagaagaaggagagcagcgtgagaagcgtgagcagcgacagccaccaggacgacgagatcagcagcatggagcagagcaccgaggacagcatgcaggacgacaccaagcccaagcccaagaagaccaagaagaagaccaaggccgtggccgacaacaacgaggacgtggacggcgacggcgtgcacgagatcaccagcagagacagccccgtgtaccccaagtgcctgctggacgacgacctggtgctgggcgtgtacatccacagaaccgacagactgaagagcgacttcatgatcagccaccccatggtgaagatccacgtggtggacgagcacaccggccagtacgtgaagaaggacgacagcggcagacccgtgagcagctactacgagaaggagaacgtggactacatcctgcccatcatgacccagccctacgacttcaagcagctgaagagcagactgcccgagtgggaggagcagatcgtgttcaacgagaacttcccctacctgctgagaggcagcgacgagagccccaaggtgatcctgttcttcgagatcctggacttcctgagcgtggacgagatcaagaacaacagcgaggtgcagaaccaggagtgcggcttcagaaagatcgcctgggccttcctgaagctgctgggcgccaacggcaacgccaacatcaacagcaagctgagactgcagctgtactacccccccaccaagcccagaagccccctgagcgtggtggaggccttcgagtggtggagcaagtgccccagaaaccactaccccagcaccctgtacgtgaccgtgagaggcctgaaggtgcccgactgcatcaagcccagctacagaagcatgatggccctgcaggaggagaagggcaagcccgtgcactgcgagagacaccacgagagcagcagcgtggacaccgagcccggcctggaggagagcaaggaggtgatcaagtggaagagactgcccggccaggcctgcagaatccccaacaagcacctgttcagcctgaacgccggcgagagaggctgcttctgcctggacttcagccacaacggcagaatcctggccgccgcctgcgccagcagagacggctaccccatcatcctgtacgagatccccagcggcagattcatgagagagctgtgcggccacctgaacatcatctacgacctgagctggagcaaggacgaccactacatcctgaccagcagcagcgacggcaccgccagaatctggaagaacgagatcaacaacaccaacaccttcagagtgctgccccaccccagcttcgtgtacaccgccaagttccaccccgccgtgagagagctggtggtgaccggctgctacgacagcatgatcagaatctggaaggtggagatgagagaggacagcgccatcctggtgagacagttcgacgtgcacaagagcttcatcaacagcctgtgcttcgacaccgagggccaccacatgtacagcggcgactgcaccggcgtgatcgtggtgtggaacacctacgtgaagatcaacgacctggagcacagcgtgcaccactggaccatcaacaaggagatcaaggagaccgagttcaagggcatccccatcagctacctggagatccaccccaacggcaagagactgctgatccacaccaaggacagcaccctgagaatcatggacctgagaatcctggtggccagaaagttcgtgggcgccgccaactacagagagaagatccacagcaccctgaccccctgcggcaccttcctgttcgccggcagcgaggacggcatcgtgtacgtgtggaaccccgagaccggcgagcaggtggccatgtacagcgacctgcccttcaagagccccatcagagacatcagctaccaccccttcgagaacatggtggccttctgcgccttcggccagaacgagcccatcctgctgtacatctacgacttccacgtggcccagcaggaggccgagatgttcaagagatacaacggcaccttccccctgcccggcatccaccagagccaggacgccctgtgcacctgccccaagctgccccaccagggcagcttccagatcgacgagttcgtgcacaccgagagcagcagcaccaagatgcagctggtgaagcagagactggagaccgtgaccgaggtgatcagaagctgcgccgccaaggtgaacaagaacctgagcttcaccagcccccccgccgtgagcagccagcagagcaagctgaagcagagcaacatgctgaccgcccaggagatcctgcaccagttcggcttcacccagaccgacagccacttcgccgagttcaacacctgcatcctgtggtggaagaagcactag

SEQ ID NO: 71317 - DNA, 165 bp, Artificial Sequence
  Description of Artificial Sequence: Synthetic coding sequence
atgcccaccgccgagagcgaggccaaggtgaagaccaaggtgagattcgaggagctgctgaagacccacagcgacctgatgagagagaagaagaagctgaagaagaagctggtgagaagcgaggagaacatcagcaaccaggagaagagcatggccgtgtggtag

SEQ ID NO: 71318 - DNA, 3591 bp, Artificial Sequence; identical to SEQ ID NO: 71315
  Description of Artificial Sequence: Synthetic coding sequence

SEQ ID NO: 71319 - DNA, 3162 bp, Artificial Sequence
  Description of Artificial Sequence: Synthetic coding sequence
atgcccaccaccgagagcgaggccaaggtgaagaccaaggtgagattcgaggagctgctgaagacccacagcgacctgatgagagagaagaagaagctgaagaagaagctggtgagaagcgaggagaacatcagccccgacaccatcagaagcaacctgcactacatgaaggagaccaccagcgacgaccccgacaccatcagaagcaacctgccccacatcaaggagaccaccagcgacgacgtgagcgccgccaacaccaacaacctgaagaagagcaccagagtgaccaagaacaagctgagaaacacccagctggccaccgagaaccccaacggcgacgccagcgtggaggaggacaagcagggcaagcccaacaagaaggtgatcaagaccgtgccccagctgaccacccaggacctgaagcccgagacccccgagaacaaggtggacagcacccaccagaagacccacaccaagccccagcccggcgtggaccaccagaagagcgagaaggccaacgagggcagagaggagaccgacctggaggaggacgaggagctgatgcaggcctaccagtgccacgtgaccgaggagatggccaaggagatcaagagaaagatcagaaagaagctgaaggagcagctgacctacttccccagcgacaccctgttccacgacgacaagctgagcagcgagaagagaaagaagaagaaggaggtgcccgtgttcagcaaggccgagaccagcaccctgaccatcagcggcgacaccgtggagggcgagcagaagaaggagagcagcgtgagaagcgtgagcagcgacagccaccaggacgacgagatcagcagcatggagcagagcaccgaggacagcatgcaggacgacaccaagcccaagcccaagaagaccaagaagaagaccaaggccgtggccgacaacaacgaggacgtggacggcgacggcgtgcacgagatcaccagcagagacagccccgtgtaccccaagtgcctgctggacgacgacctggtgctgggcgtgtacatccacagaaccgacagactgaagagcgacttcatgatcagccaccccatggtgaagatccacgtggtggacgagcacaccggccagtacgtgaagaaggacgacagcggcagacccgtgagcagctactacgagaaggagaacgtggactacatcctgcccatcatgacccagccctacgacttcaagcagctgaagagcagactgcccgagtgggaggagcagatcgtgttcaacgagaacttcccctacctgctgagaggcagcgacgagagccccaaggtgatcctgttcttcgagatcctggacttcctgagcgtggacgagatcaagaacaacagcgaggtgcagaaccaggagtgcggcttcagaaagatcgcctgggccttcctgaagctgctgggcgccaacggcaacgccaacatcaacagcaagctgagactgcagctgtactacccccccaccaagcccagaagccccctgagcgtggtggaggccttcgagtggtggagcaagtgccccagaaaccactaccccagcaccctgtacgtgaccgtgagaggcctgaaggtgcccgactgcatcaagcccagctacagaagcatgatggccctgcaggaggagaagggcaagcccgtgcactgcgagagacaccacgagagcagcagcgtggacaccgagcccggcctggaggagagcaaggaggtgatcaagtggaagagactgcccggccaggcctgcagaatccccaacaagcacctgttcagcctgaacgccggcgagagaggctgcttctgcctggacttcagccacaacggcagaatcctggccgccgcctgcgccagcagagacggctaccccatcatcctgtacgagatccccagcggcagattcatgagagagctgtgcggccacctgaacatcatctacgacctgagctggagcaaggacgaccactacatcctgaccagcagcagcgacggcaccgccagaatctggaagaacgagatcaacaacaccaacaccttcagagtgctgccccaccccagcttcgtgtacaccgccaagttccaccccgccgtgagagagctggtggtgaccggctgctacgacagcatgatcagaatctggaaggtggagatgagagaggacagcgccatcctggtgagacagttcgacgtgcacaagagcttcatcaacagcctgtgcttcgacaccgagggccaccacatgtacagcggcgactgcaccggcgtgatcgtggtgtggaacacctacgtgaagatcaacgacctggagcacagcgtgcaccactggaccatcaacaaggagatcaaggagaccgagttcaagggcatccccatcagctacctggagatccaccccaacggcaagagactgctgatccacaccaaggacagcaccctgagaatcatggacctgagaatcctggtggccagaaagttcgtgggcgccgccaactacagagagaagatccacagcaccctgaccccctgcggcaccttcctgttcgccggcagcgaggacggcatcgtgtacgtgtggaaccccgagaccggcgagcaggtggccatgtacagcgacctgcccttcaagagccccatcagagacatcagctaccaccccttcgagaacatggtggccttctgcgccttcggccagaacgagcccatcctgctgtacatctacgacttccacgtggcccagcaggaggccgagatgttcaagagatacaacggcaccttccccctgcccggcatccaccagagccaggacgccctgtgcacctgccccaagctgccccaccagggcagcttccagatcgacgagttcgtgcacaccgagagcagcagcaccaagatgcagctggtgaagcagagactggagaccgtgaccgaggtgatcagaagctgcgccgccaaggtgaacaagaacctgagcttcaccagcccccccgccgtgagcagccagcagagcaagctgaagcagagcaacatgctgaccgcccaggagatcctgcaccagttcggcttcacccagaccgacagccacttcgccgagttcaacacctgcatcctgtggtggaagaagcactag

SEQ ID NO: 71320 - DNA, 1497 bp, Artificial Sequence
  Description of Artificial Sequence: Synthetic coding sequence
atgagagagctgtgcggccacctgaacatcatctacgacctgagctggagcaaggacgaccactacatcctgaccagcagcagcgacggcaccgccagaatctggaagaacgagatcaacaacaccaacaccttcagagtgctgccccaccccagcttcgtgtacaccgccaagttccaccccgccgtgagagagctggtggtgaccggctgctacgacagcatgatcagaatctggaaggtggagatgagagaggacagcgccatcctggtgagacagttcgacgtgcacaagagcttcatcaacagcctgtgcttcgacaccgagggccaccacatgtacagcggcgactgcaccggcgtgatcgtggtgtggaacacctacgtgaagatcaacgacctggagcacagcgtgcaccactggaccatcaacaaggagatcaaggagaccgagttcaagggcatccccatcagctacctggagatccaccccaacggcaagagactgctgatccacaccaaggacagcaccctgagaatcatggacctgagaatcctggtggccagaaagttcgtgggcgccgccaactacagagagaagatccacagcaccctgaccccctgcggcaccttcctgttcgccggcagcgaggacggcatcgtgtacgtgtggaaccccgagaccggcgagcaggtggccatgtacagcgacctgcccttcaagagccccatcagagacatcagctaccaccccttcgagaacatggtggccttctgcgccttcggccagaacgagcccatcctgctgtacatctacgacttccacgtggcccagcaggaggccgagatgttcaagagatacaacggcaccttccccctgcccggcatccaccagagccaggacgccctgtgcacctgccccaagctgccccaccagggcagcttccagatcgacgagttcgtgcacaccgagagcagcagcaccaagatgcagctggtgaagcagagactggagaccgtgaccgaggtgatcagaagctgcgccgccaaggtgaacaagaacctgagcttcaccagcccccccgccgtgagcagccagcagagcaagctgaagcagagcaacatgctgaccgcccaggagatcctgcaccagttcggcttcacccagaccggcatcatcagcatcgagagaaagccctgcaaccaccaggtggacaccgcccccaccgtggtggccctgtacgactacaccgccaacagaagcgacgagctgaccatccacagaggcgacatcatcagagtgttcttcaaggacaacgaggactggtggtacggcagcatcggcaagggccaggagggctacttccccgccaaccacgtggccagcgagaccctgtaccaggagctgccccccgagatcaaggagagaagcccccccctgagccccgaggagaagaccaagatcgagaagagccccgccccccagaaggtgaagtag

SEQ ID NO: 71321 - DNA, 3591 bp, Artificial Sequence; identical to SEQ ID NO: 71315
  Description of Artificial Sequence: Synthetic coding sequence

SEQ ID NO: 71322 - DNA, 1218 bp, Artificial Sequence
  Description of Artificial Sequence: Synthetic coding sequence
atgctgagcagcttcctgagcccccagaacggcacctgggccgacaccttcagcctgctgctggccctggccgtggccctgtacctgggctactactgggcctgcgtgctgcagagacccagactggtggccggcccccagttcctggccttcctggagccccactgcagcatcaccaccgagaccttctaccccaccctgtggtgcttcgagggcagactgcagagcatcttccaggtgctgctgcagagccagcccctggtgctgtaccagagcgacatcctgcagacccccgacggcggccagctgctgctggactgggccaagcagcccgacagcagccaggaccccgaccccaccacccagcccatcgtgctgctgctgcccggcatcaccggcagcagccaggacacctacgtgctgcacctggtgaaccaggccctgagagacggctaccaggccgtggtgttcaacaacagaggctgcagaggcgaggagctgagaacccacagagccttctgcgccagcaacaccgaggacctggagaccgtggtgaaccacatcaagcacagatacccccaggcccccctgctggccgtgggcatcagcttcggcggcatcctggtgctgaaccacctggcccaggccagacaggccgccggcctggtggccgccctgaccctgagcgcctgctgggacagcttcgagaccaccagaagcctggagacccccctgaacagcctgctgttcaaccagcccctgaccgccggcctgtgccagctggtggagagaaacagaaaggtgatcgagaaggtggtggacatcgacttcgtgctgcaggccagaaccatcagacagttcgacgagagatacaccagcgtggccttcggctaccaggactgcgtgacctactacaaggccgccagccccagaaccaagatcgacgccatcagaatccccgtgctgtacctgagcgccgccgacgaccccttcagccccgtgtgcgccctgcccatccaggccgcccagcacagcccctacgtggccctgctgatcaccgccagaggcggccacatcggcttcctggagggcctgctgccctggcagcactggtacatgagcagactgctgcaccagtacgccaaggccatcttccaggaccccgagggcctgcccgacctgagagccctgctgcccagcgaggacagaaacagctag

SEQ ID NO: 71323 - DNA, 1197 bp, Artificial Sequence
  Description of Artificial Sequence: Synthetic coding sequence
atgagaaagagaaccgagcccgtggccctggagcacgagagatgcgccgccgccggcagcagcagcagcggcagcgccgccgccgccctggacgccgactgcagactgaagcagaacctgagactgaccggccccgccgccgccgagcccagatgcgccgccgacgccggcatgaagagagccctgggcagaagaaagggcgtgtggctgagactgagaaagatcctgttctgcgtgctgggcctgtacatcgccatccccttcctgatcaagctgtgccccggcatccaggccaagctgatcttcctgaacttcgtgagagtgccctacttcatcgacctgaagaagccccaggaccagggcctgaaccacacctgcaactactacctgcagcccgaggaggacgtgaccatcggcgtgtggcacaccgtgcccgccgtgtggtggaagaacgcccagggcaaggaccagatgtggtacgaggacgccctggccagcagccaccccatcatcctgtacctgcacggcaacgccggcaccagaggcggcgaccacagagtggagctgtacaaggtgctgagcagcctgggctaccacgtggtgaccttcgactacagaggctggggcgacagcgtgggcacccccagcgagagaggcatgacctacgacgccctgcacgtgttcgactggatcaaggccagaagcggcgacaaccccgtgtacatctggggccacagcctgggcaccggcgtggccaccaacctggtgagaagactgtgcgagagagagaccccccccgacgccctgatcctggagagccccttcaccaacatcagagaggaggccaagagccaccccttcagcgtgatctacagatacttccccggcttcgactggttcttcctggaccccatcaccagcagcggcatcaagttcgccaacgacgagaacgtgaagcacatcagctgccccctgctgatcctgcacgccgaggacgaccccgtggtgcccttccagctgggcagaaagctgtacagcatcgccgcccccgccagaagcttcagagacttcaaggtgcagttcgtgcccttccacagcgacctgggctacagacacaagtacatctacaagagccccgagctgcccagaatcctgagagagttcctgggcaagagcgagcccgagcaccagcactag

SEQ ID NO: 71324 - DNA, 1215 bp, Artificial Sequence
  Description of Artificial Sequence: Synthetic coding sequence
atgagaaagagaaccgagcccgtggccctggagcacgagagatgcgccgccgccggcagcagcagcagcggcagcgccgccgccgccctggacgccgactgcagactgaagcagaacctgagactgaccggccccgccgccgccgagcccagatgcgccgccgacgccggcatgaagagagccctgggcagaagaaagggcgtgtggctgagactgagaaagatcctgttctgcgtgctgggcctgtacatcgccatccccttcctgatcaagctgtgccccggcatccaggccaagctgatcttcctgaacttcgtgagagtgccctacttcatcgacctgaagaagccccaggaccagggcctgaaccacacctgcaactactacctgcagcccgaggaggacgtgaccatcggcgtgtggcacaccgtgcccgccgtgtggtggaagaacgcccagggcaaggaccagatgtggtacgaggacgccctggccagcagccaccccatcatcctgtacctgcacggcaacgccggcaccagaggcggcgaccacagagtggagctgtacaaggtgctgagcagcctgggctaccacgtggtgaccttcgactacagaggctggggcgacagcgtgggcacccccagcgagagaggcatgacctacgacgccctgcacgtgttcgactggatcaaggccagaagcggcgacaaccccgtgtacatctggggccacagcctgggcaccggcgtggccaccaacctggtgagaagactgtgcgagagagagaccccccccgacgccctgatcctggagagccccttcaccaacatcagagaggaggccaagagccaccccttcagcgtgatctacagatacttccccggcttcgactggttcttcctggaccccatcaccagcagcggcatcaagttcgccaacgacgagaacgtgaagcacatcagctgccccctgctgatcctgcacgccgaggacgaccccgtggtgcccttccagctgggcagaaagctgtacagcatcgccgcccccgccagaagcttcagagacttcaaggtgcagttcgtgcccttccacagcgacctgggctacagacacaagtacatctacaagagccccgagctgcccagaatcctgagaccccagcagggccccggcagcagccccgaccccagcatgtggagcgagctggtgtag

SEQ ID NO: 71325 - DNA, 564 bp, Artificial Sequence
  Description of Artificial Sequence: Synthetic coding sequence
atgagcggcggcggccacggcggcgtgtgcttcctgtgctgcatcctgctgcagggcagaaagggcgtgtggctgagactgagaaagatcctgttctgcgtgctgggcctgtacatcgccatccccttcctgatcaagctgtgccccggcatccaggccaagctgatcttcctgaacttcgtgagagtgccctacttcatcgacctgaagaagccccaggaccagggcctgaaccacacctgcaactactacctgcagcccgaggaggacgtgaccatcggcgtgtggcacaccgtgcccgccgtgtggtggaagaacgcccagggcaaggaccagatgtggtacgaggacgccctggccagcagccaccccatcatcctgtacctgcacggcaacgccggcaccagaggcggcgaccacagagtggagctgtacaaggtgctgagcagcctgggctaccacgtggtgaccttcgactacagaggctggggcgacagcgtgggcacccccagcgagagaggcatgacctacgacgccctgcacgtgttcgactggatcaagtag

SEQ ID NO: 71326 - DNA, 1083 bp, Artificial Sequence
  Description of Artificial Sequence: Synthetic coding sequence
atgagaaagagaaccgagcccgtggccctggagcccagatgcgccgccgacgccggcatgaagagagccctgggcagaagaaagggcgtgtggctgagactgagaaagatcctgttctgcgtgctgggcctgtacatcgccatccccttcctgatcaagctgtgccccggcatccaggccaagctgatcttcctgaacttcgtgagagtgccctacttcatcgacctgaagaagccccaggaccagggcctgaaccacacctgcaactactacctgcagcccgaggaggacgtgaccatcggcgtgtggcacaccgtgcccgccgtgtggtggaagaacgcccagggcaaggaccagatgtggtacgaggacgccctggccagcagccaccccatcatcctgtacctgcacggcaacgccggcaccagaggcggcgaccacagagtggagctgtacaaggtgctgagcagcctgggctaccacgtggtgaccttcgactacagaggctggggcgacagcgtgggcacccccagcgagagaggcatgacctacgacgccctgcacgtgttcgactggatcaaggccagaagcggcgacaaccccgtgtacatctggggccacagcctgggcaccggcgtggccaccaacctggtgagaagactgtgcgagagagagaccccccccgacgccctgatcctggagagccccttcaccaacatcagagaggaggccaagagccaccccttcagcgtgatctacagatacttccccggcttcgactggttcttcctggaccccatcaccagcagcggcatcaagttcgccaacgacgagaacgtgaagcacatcagctgccccctgctgatcctgcacgccgaggacgaccccgtggtgcccttccagctgggcagaaagctgtacagcatcgccgcccccgccagaagcttcagagacttcaaggtgcagttcgtgcccttccacagcgacctgggctacagacacaagtacatctacaagagccccgagctgcccagaatcctgagagagttcctgggcaagagcgagcccgagcaccagcactag

SEQ ID NO: 71327 - DNA, 1020 bp, Artificial Sequence
  Description of Artificial Sequence: Synthetic coding sequence
atgctgtaccccggcagcgtgtacctgctgcagaaggccctgatgcccgtgctgctgcagggccaggccagactggtggaggagtgcaacggcagaagagccaagctgctggcctgcgacggcaacgagatcgacaccatgttcgtggacagaagaggcaccgccgagccccagggccagaagctggtgatctgctgcgagggcaacgccggcttctacgaggtgggctgcgtgagcacccccctggaggccggctacagcgtgctgggctggaaccaccccggcttcgccggcagcaccggcgtgcccttcccccagaacgaggccaacgccatggacgtggtggtgcagttcgccatccacagactgggcttccagccccaggacatcatcatctacgcctggagcatcggcggcttcaccgccacctgggccgccatgagctaccccgacgtgagcgccatgatcctggacgccagcttcgacgacctggtgcccctggccctgaaggtgatgcccgacagctggagaggcctggtgaccagaaccgtgagacagcacctgaacctgaacaacgccgagcagctgtgcagataccagggccccgtgctgctgatcagaagaaccaaggacgagatcatcaccaccaccgtgcccgaggacatcatgagcaacagaggcaacgacctgctgctgaagctgctgcagcacagataccccagagtgatggccgaggagggcctgagagtggtgagacagtggctggaggccagcagccagctggaggaggccagcatctacagcagatgggaggtggaggaggactggtgcctgagcgtgctgagaagctaccaggccgagcacggccccgacttcccctggagcgtgggcgaggacatgagcgccgacggcagaagacagctggccctgttcctggccagaaagcacctgcacaacttcgaggccacccactgcacccccctgcccgcccagaacttccagatgccctggcacctgtag

SEQ ID NO: 71328 - DNA, 1677 bp, Artificial Sequence
  Description of Artificial Sequence: Synthetic coding sequence
atggccaagctgctgagctgcgtgctgggccccagactgtacaagatctacagagagagagacagcgagagagcccccgccagcgtgcccgagacccccaccgccgtgaccgccccccacagcagcagctgggacacctactaccagcccagagccctggagaagcacgccgacagcatcctggccctggccagcgtgttctggagcatcagctactacagcagccccttcgccttcttctacctgtacagaaagggctacctgagcctgagcaaggtggtgcccttcagccactacgccggcaccctgctgctgctgctggccggcgtggcctgcctgagaggcatcggcagatggaccaacccccagtacagacagttcatcaccatcctggaggccacccacagaaaccagagcagcgagaacaagagacagctggccaactacaacttcgacttcagaagctggcccgtggacttccactgggaggagcccagcagcagaaaggagagcagaggcggccccagcagaagaggcgtggccctgctgagacccgagcccctgcacagaggcaccgccgacaccctgctgaacagagtgaagaagctgccctgccagatcaccagctacctggtggcccacaccctgggcagaagaatgctgtaccccggcagcgtgtacctgctgcagaaggccctgatgcccgtgctgctgcagggccaggccagactggtggaggagtgcaacggcagaagagccaagctgctggcctgcgacggcaacgagatcgacaccatgttcgtggacagaagaggcaccgccgagccccagggccagaagctggtgatctgctgcgagggcaacgccggcttctacgaggtgggctgcgtgagcacccccctggaggccggctacagcgtgctgggctggaaccaccccggcttcgccggcagcaccggcgtgcccttcccccagaacgaggccaacgccatggacgtggtggtgcagttcgccatccacagactgggcttccagccccaggacatcatcatctacgcctggagcatcggcggcttcaccgccacctgggccgccatgagctaccccgacgtgagcgccatgatcctggacgccagcttcgacgacctggtgcccctggccctgaaggtgatgcccgacagctggagaggcctggtgaccagaaccgtgagacagcacctgaacctgaacaacgccgagcagctgtgcagataccagggccccgtgctgctgatcagaagaaccaaggacgagatcatcaccaccaccgtgcccgaggacatcatgagcaacagaggcaacgacctgctgctgaagctgctgcagcacagataccccagagtgatggccgaggagggcctgagagtggtgagacagtggctggaggccagcagccagctggaggaggccagcatctacagcagatgggaggtggaggaggactggtgcctgagcgtgctgagaagctaccaggccgagcacggccccgacttcccctggagcgtgggcgaggacatgagcgccgacggcagaagacagctggccctgttcctggccagaaagcacctgcacaacttcgaggccacccactgcacccccctgcccgcccagaacttccagatgccctggcacctgtag

SEQ ID NO: 71329 - DNA, 1806 bp, Artificial Sequence
  Description of Artificial Sequence: Synthetic coding sequence
atgagccagctggccagaagaagaagcagatacggcctgaccagcagagcccacaacaccagcgaggccggcagagccggccccgccggcggccccgccgccggcagagccgccgccagagccggcgccatggccaagctgctgagctgcgtgctgggccccagactgtacaagatctacagagagagagacagcgagagagcccccgccagcgtgcccgagacccccaccgccgtgaccgccccccacagcagcagctgggacacctactaccagcccagagccctggagaagcacgccgacagcatcctggccctggccagcgtgttctggagcatcagctactacagcagccccttcgccttcttctacctgtacagaaagggctacctgagcctgagcaaggtggtgcccttcagccactacgccggcaccctgctgctgctgctggccggcgtggcctgcctgagaggcatcggcagatggaccaacccccagtacagacagttcatcaccatcctggaggccacccacagaaaccagagcagcgagaacaagagacagctggccaactacaacttcgacttcagaagctggcccgtggacttccactgggaggagcccagcagcagaaaggagagcagaggcggccccagcagaagaggcgtggccctgctgagacccgagcccctgcacagaggcaccgccgacaccctgctgaacagagtgaagaagctgccctgccagatcaccagctacctggtggcccacaccctgggcagaagaatgctgtaccccggcagcgtgtacctgctgcagaaggccctgatgcccgtgctgctgcagggccaggccagactggtggaggagtgcaacggcagaagagccaagctgctggcctgcgacggcaacgagatcgacaccatgttcgtggacagaagaggcaccgccgagccccagggccagaagctggtgatctgctgcgagggcaacgccggcttctacgaggtgggctgcgtgagcacccccctggaggccggctacagcgtgctgggctggaaccaccccggcttcgccggcagcaccggcgtgcccttcccccagaacgaggccaacgccatggacgtggtggtgcagttcgccatccacagactgggcttccagccccaggacatcatcatctacgcctggagcatcggcggcttcaccgccacctgggccgccatgagctaccccgacgtgagcgccatgatcctggacgccagcttcgacgacctggtgcccctggccctgaaggtgatgcccgacagctggagaggcctggtgaccagaaccgtgagacagcacctgaacctgaacaacgccgagcagctgtgcagataccagggccccgtgctgctgatcagaagaaccaaggacgagatcatcaccaccaccgtgcccgaggacatcatgagcaacagaggcaacgacctgctgctgaagctgctgcagcacagataccccagagtgatggccgaggagggcctgagagtggtgagacagtggctggaggccagcagccagctggaggaggccagcatctacagcagatgggaggtggaggaggactggtgcctgagcgtgctgagaagctaccaggccgagcacggccccgacttcccctggagcgtgggcgaggacatgagcgccgacggcagaagacagctggccctgttcctggccagaaagcacctgcacaacttcgaggccacccactgcacccccctgcccgcccagaacttccagatgccctggcacctgtag

SEQ ID NO: 71330 - DNA, 795 bp, Artificial Sequence
  Description of Artificial Sequence: Synthetic coding sequence
atgcccccccccgccctgttcctgagcagcctgtaccccagactggagttccagaacgacttctacagaagctgcatcagaagaagcagcccccagcccccccccaacctggcctggagacccgagagcctgtacagcggcgagctggccggcggcggctacctgagcctgagcaaggtggtgcccttcagccactacgccggcaccctgctgctgctgctggccggcgtggcctgcctgagaggcatcggcagatggaccaacccccagtacagacagttcatcaccatcctggaggccacccacagaaaccagagcagcgagaacaagagacagctggccaactacaacttcgacttcagaagctggcccgtggacttccactgggaggagcccagcagcagaaaggagagcagaggcggccccagcagaagaggcgtggccctgctgagacccgagcccctgcacagaggcaccgccgacaccctgctgaacagagtgaagaagctgccctgccagatcaccagctacctggtggcccacaccctgggcagaagaatgctgtaccccggcagcgtgtacctgctgcagaaggccctgatgcccgtgctgctgcagggccaggccagactggtggaggagtgcaacggcagaagagccaagctgctggcctgcgacggcaacgagatcgacaccatgttcgtggacagaagaggcaccgccgagccccagggccagaagctggtgatctgctgcgagggcaacgccggcttctacgaggtgggctgcgtgtag

SEQ ID NO: 71331 - DNA, 795 bp, Artificial Sequence; identical to SEQ ID NO: 71330
  Description of Artificial Sequence: Synthetic coding sequence

SEQ ID NO: 71332 - DNA, 795 bp, Artificial Sequence; identical to SEQ ID NO: 71330
  Description of Artificial Sequence: Synthetic coding sequence

SEQ ID NO: 71333 - DNA, 1806 bp, Artificial Sequence; identical to SEQ ID NO: 71329
  Description of Artificial Sequence: Synthetic coding sequence

SEQ ID NO: 71334 - DNA, 795 bp, Artificial Sequence; identical to SEQ ID NO: 71330
  Description of Artificial Sequence: Synthetic coding sequence

SEQ ID NO: 71335 - DNA, 1806 bp, Artificial Sequence; identical to SEQ ID NO: 71329
  Description of Artificial Sequence: Synthetic coding sequence

SEQ ID NO: 71336 - DNA, 795 bp, Artificial Sequence; identical to SEQ ID NO: 71330
  Description of Artificial Sequence: Synthetic coding sequence

SEQ ID NO: 71337 - DNA, 1806 bp, Artificial Sequence; identical to SEQ ID NO: 71329
  Description of Artificial Sequence: Synthetic coding sequence

SEQ ID NO: 71338 - DNA, 795 bp, Artificial Sequence; identical to SEQ ID NO: 71330
  Description of Artificial Sequence: Synthetic coding sequence

SEQ ID NO: 71339 - DNA, 1677 bp, Artificial Sequence; identical to SEQ ID NO: 71328
  Description of Artificial Sequence: Synthetic coding sequence

SEQ ID NO: 71340 - DNA, 1806 bp, Artificial Sequence; identical to SEQ ID NO: 71329
  Description of Artificial Sequence: Synthetic coding sequence

SEQ ID NO: 71341 - DNA, 438 bp, Artificial Sequence
  Description of Artificial Sequence: Synthetic coding sequence
atgctgggccactgctgctacttctggcaggtgtggcccgccagcgaggccctggccgccggccccacccccagcaccggcagcagcagccccagctggaagcagcacatcggcaccagcctgcagaagaccagaggcagcctgcccaccaccaccctgaccagcggcgccggccagagcaccagcaccggcaagaaccccgccgccggcagaagcctggagggcgccctgcccgccggcgtgtggccctgcttcgcccagagcccctgcaccggcggccagcagacccccagcagcaccggcctgagaagctgcctggtgagaagccccggcggcaagcagcagagaggcgaggcccactggggcggcggcgccatcagcggcgtgctgtgggagtgggccctgcactgcaagatcgccgtgacccactgggcctag

SEQ ID NO: 71342 - DNA, 1677 bp, Artificial Sequence; identical to SEQ ID NO: 71328
  Description of Artificial Sequence: Synthetic coding sequence

SEQ ID NO: 71343 - DNA, 1677 bp, Artificial Sequence; identical to SEQ ID NO: 71328
  Description of Artificial Sequence: Synthetic coding sequence

SEQ ID NO: 71344 - DNA, 1677 bp, Artificial Sequence; identical to SEQ ID NO: 71328
  Description of Artificial Sequence: Synthetic coding sequence

SEQ ID NO: 71345 - DNA, 438 bp, Artificial Sequence; identical to SEQ ID NO: 71341
  Description of Artificial Sequence: Synthetic coding sequence

SEQ ID NO: 71346 - DNA, 438 bp, Artificial Sequence; identical to SEQ ID NO: 71341
  Description of Artificial Sequence: Synthetic coding sequence

SEQ ID NO: 71347 - DNA, 438 bp, Artificial Sequence; identical to SEQ ID NO: 71341
  Description of Artificial Sequence: Synthetic coding sequence

SEQ ID NO: 71348 - DNA, 1578 bp, Artificial Sequence
  Description of Artificial Sequence: Synthetic coding sequence
atgcccccccccgccctgttcctgagcagcctgtaccccagactggagttccagaacgacttctacagaagctgcatcagaagaagcagcccccagcccccccccaacctggcctggagacccgagagcctgtacagcggcgagctggccggcggcggctacctgagcctgagcaaggtggtgcccttcagccactacgccggcaccctgctgctgctgctggccggcgtggcctgcctgagaggcatcggcagatggaccaacccccagtacagacagttcatcaccatcctggaggccacccacagaaaccagagcagcgagaacaagagacagctggccaactacaacttcgacttcagaagctggcccgtggacttccactgggaggagcccagcagcagaaaggagagcagaggcggccccagcagaagaggcgtggccctgctgagacccgagcccctgcacagaggcaccgccgacaccctgctgaacagagtgaagaagctgccctgccagatcaccagctacctggtggcccacaccctgggcagaagaatgctgtaccccggcagcgtgtacctgctgcagaaggccctgatgcccgtgctgctgcagggccaggccagactggtggaggagtgcaacggcagaagagccaagctgctggcctgcgacggcaacgagatcgacaccatgttcgtggacagaagaggcaccgccgagccccagggccagaagctggtgatctgctgcgagggcaacgccggcttctacgaggtgggctgcgtgagcacccccctggaggccggctacagcgtgctgggctggaaccaccccggcttcgccggcagcaccggcgtgcccttcccccagaacgaggccaacgccatggacgtggtggtgcagttcgccatccacagactgggcttccagccccaggacatcatcatctacgcctggagcatcggcggcttcaccgccacctgggccgccatgagctaccccgacgtgagcgccatgatcctggacgccagcttcgacgacctggtgcccctggccctgaaggtgatgcccgacagctggagaggcctggtgaccagaaccgtgagacagcacctgaacctgaacaacgccgagcagctgtgcagataccagggccccgtgctgctgatcagaagaaccaaggacgagatcatcaccaccaccgtgcccgaggacatcatgagcaacagaggcaacgacctgctgctgaagctgctgcagcacagataccccagagtgatggccgaggagggcctgagagtggtgagacagtggctggaggccagcagccagctggaggaggccagcatctacagcagatgggaggtggaggaggactggtgcctgagcgtgctgagaagctaccaggccgagcacggccccgacttcccctggagcgtgggcgaggacatgagcgccgacggcagaagacagctggccctgttcctggccagaaagcacctgcacaacttcgaggccacccactgcacccccctgcccgcccagaacttccagatgccctggcacctgtag

SEQ ID NO: 71349 - DNA, 1677 bp, Artificial Sequence; identical to SEQ ID NO: 71328
  Description of Artificial Sequence: Synthetic coding sequence

SEQ ID NO: 71350 - DNA, 1578 bp, Artificial Sequence; identical to SEQ ID NO: 71348
  Description of Artificial Sequence: Synthetic coding sequence

SEQ ID NO: 71351 - DNA, 1578 bp, Artificial Sequence; identical to SEQ ID NO: 71348
  Description of Artificial Sequence: Synthetic coding sequence

SEQ ID NO: 71352 - DNA, 438 bp, Artificial Sequence; identical to SEQ ID NO: 71341
  Description of Artificial Sequence: Synthetic coding sequence

SEQ ID NO: 71353 - DNA, 1578 bp, Artificial Sequence; identical to SEQ ID NO: 71348
  Description of Artificial Sequence: Synthetic coding sequence

SEQ ID NO: 71354 - DNA, 1677 bp, Artificial Sequence; identical to SEQ ID NO: 71328
  Description of Artificial Sequence: Synthetic coding sequence

SEQ ID NO: 71355 - DNA, 1578 bp, Artificial Sequence; identical to SEQ ID NO: 71348
  Description of Artificial Sequence: Synthetic coding sequence

SEQ ID NO: 71356 - DNA, 438 bp, Artificial Sequence; identical to SEQ ID NO: 71341
  Description of Artificial Sequence: Synthetic coding sequence

SEQ ID NO: 71357 - DNA, 1578 bp, Artificial Sequence; identical to SEQ ID NO: 71348
  Description of Artificial Sequence: Synthetic coding sequence

SEQ ID NO: 71358 - DNA, 438 bp, Artificial Sequence; identical to SEQ ID NO: 71341
  Description of Artificial Sequence: Synthetic coding sequence

SEQ ID NO: 71359 - DNA, 1578 bp, Artificial Sequence; identical to SEQ ID NO: 71348
  Description of Artificial Sequence: Synthetic coding sequence

SEQ ID NO: 71360 - DNA, 1278 bp, Artificial Sequence
  Description of Artificial Sequence: Synthetic coding sequence
atgaacgccatgctggagacccccgagctgcccgccgtgttcgacggcgtgaagctggccgccgtggccgccgtgctgtacgtgatcgtgagatgcctgaacctgaagagccccaccgccccccccgacctgtacttccaggacagcggcctgagcagattcctgctgaagagctgccccctgctgaccaaggagtacatcccccccctgatctggggcaagagcggccacatccagaccgccctgtacggcaagatgggcagagtgagaagcccccacccctacggccacagaaagttcatcaccatgagcgacggcgccaccagcaccttcgacctgttcgagcccctggccgagcactgcgtgggcgacgacatcaccatggtgatctgccccggcatcgccaaccacagcgagaagcagtacatcagaaccttcgtggactacgcccagaagaacggctacagatgcgccgtgctgaaccacctgggcgccctgcccaacatcgagctgaccagccccagaatgttcacctacggctgcacctgggagttcggcgccatggtgaactacatcaagaagacctaccccctgacccagctggtggtggtgggcttcagcctgggcggcaacatcgtgtgcaagtacctgggcgagacccaggccaaccaggagaaggtgctgtgctgcgtgagcgtgtgccagggctacagcgccctgagagcccaggagaccttcatgcagtgggaccagtgcagaagattctacaacttcctgatggccgacaacatgaagaagatcatcctgagccacagacaggccctgttcggcgaccacgtgaagaagccccagagcctggaggacaccgacctgagcagactgtacaccgccaccagcctgatgcagatcgacgacaacgtgatgagaaagttccacggctacaacagcctgaaggagtactacgaggaggagagctgcatgagatacctgcacagaatctacgtgcccctgatgctggtgaacgccgccgacgaccccctggtgcacgagagcctgctgaccatccccaagagcctgagcgagaagagagagaacgtgatgttcgtgctgcccctgcacggcggccacctgggcttcttcgagggcagcgtgctgttccccgagcccctgacctggatggacaagctggtggtggagtacgccaacgccatctgccagtgggagagaaacaagctgcagtgcagcgacaccgagcaggtggaggccgacctggagtag

SEQ ID NO: 71361 - DNA, 1278 bp, Artificial Sequence; identical to SEQ ID NO: 71360
  Description of Artificial Sequence: Synthetic coding sequence

SEQ ID NO: 71362 - DNA, 1230 bp, Artificial Sequence
  Description of Artificial Sequence: Synthetic coding sequence
atgcagagactggccatggacctgagaatgctgagcagagagctgagcctgtacctggagcaccaggtgagagtgggcttcttcggcagcggcgtgggcctgagcctgatcctgggcttcagcgtggcctacgccttctactacctgagcagcatcgccaagaagccccagctggtgaccggcggcgagagcttcagcagattcctgcaggaccactgccccgtggtgaccgagacctactaccccaccgtgtggtgctgggagggcagaggccagaccctgctgagacccttcatcaccagcaagccccccgtgcagtacagaaacgagctgatcaagaccgccgacggcggccagatcagcctggactggttcgacaacgacaacagcacctgctacatggacgccagcaccagacccaccatcctgctgctgcccggcctgaccggcaccagcaaggagagctacatcctgcacatgatccacctgagcgaggagctgggctacagatgcgtggtgttcaacaacagaggcgtggccggcgagaacctgctgacccccagaacctactgctgcgccaacaccgaggacctggagaccgtgatccaccacgtgcacagcctgtaccccagcgcccccttcctggccgccggcgtgagcatgggcggcatgctgctgctgaactacctgggcaagatcggcagcaagacccccctgatggccgccgccaccttcagcgtgggctggaacaccttcgcctgcagcgagagcctggagaagcccctgaactggctgctgttcaactactacctgaccacctgcctgcagagcagcgtgaacaagcacagacacatgttcgtgaagcaggtggacatggaccacgtgatgaaggccaagagcatcagagagttcgacaagagattcaccagcgtgatgttcggctaccagaccatcgacgactactacaccgacgccagccccagccccagactgaagagcgtgggcatccccgtgctgtgcctgaacagcgtggacgacgtgttcagccccagccacgccatccccatcgagaccgccaagcagaaccccaacgtggccctggtgctgaccagctacggcggccacatcggcttcctggagggcatctggcccagacagagcacctacatggacagagtgttcaagcagttcgtgcaggccatggtggagcacggccacgagctgagctag

SEQ ID NO: 71363 - DNA, 1050 bp, Artificial Sequence
  Description of Artificial Sequence: Synthetic coding sequence
atggccgccgaggaggaggaggtggacagcgccgacaccggcgagagaagcggctggctgaccggctggctgcccacctggtgccccaccagcatcagccacctgaaggaggccgaggagaagatgctgaagtgcgtgccctgcacctacaagaaggagcccgtgagaatcagcaacggcaacaagatctggaccctgaagttcagccacaacatcagcaacaagacccccctggtgctgctgcacggcttcggcggcggcctgggcctgtgggccctgaacttcggcgacctgtgcaccaacagacccgtgtacgccttcgacctgctgggcttcggcagaagcagcagacccagattcgacagcgacgccgaggaggtggagaaccagttcgtggagagcatcgaggagtggagatgcgccctgggcctggacaagatgatcctgctgggccacaacctgggcggcttcctggccgccgcctacagcctgaagtaccccagcagagtgaaccacctgatcctggtggagccctggggcttccccgagagacccgacctggccgaccaggacagacccatccccgtgtggatcagagccctgggcgccgccctgacccccttcaaccccctggccggcctgagaatcgccggccccttcggcctgagcctggtgcagagactgagacccgacttcaagagaaagtacagcagcatgttcgaggacgacaccgtgaccgagtacatctaccactgcaacgtgcagacccccagcggcgagaccgccttcaagaacatgaccatcccctacggctgggccaagagacccatgctgcagagaatcggcaagatgcaccccgacatccccgtgagcgtgatcttcggcgccagaagctgcatcgacggcaacagcggcaccagcatccagagcctgagaccccacagctacgtgaagaccatcgccatcctgggcgccggccactacgtgtacgccgaccagcccgaggagttcaaccagaaggtgaaggagatctgcgacaccgtggactag

SEQ ID NO: 71364 - DNA, 1491 bp, Artificial Sequence
  Description of Artificial Sequence: Synthetic coding sequence
atggccgagctgcagatgctgctggaggaggagatccccagcggcaagagagccctgatcgagagctaccagaacctgaccagagtggccgactactgcgagaacaactacatccagagacacggcttcgccgtgctgctgtgcctgctgagcaacagctggccccaggccaccgacaagagaaaggccctggaggagaccaaggcctacaccacccagagcctggccagcgtggcctaccagatcaacgccctggccaacaacgtgctgcagctgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacatggagagacccgtgagatacatcagaaagcccatcgactacaccgtgctggacgacgtgggccacggcgtgaagtggctgaaggccaagcacggcaacaaccagcccgccagaaccggcaccctgagcagaaccaacccccccacccagaagccccccagcccccccatgagcggcagaggcaccctgggcagaaacaccccctacaagaccctggagcccgtgaagccccccaccgtgcccaacgactacatgaccagccccgccagactgggcagccagcacagccccggcagaaccgccagcctgaaccagagacccagaacccacagcggcagcagcggcggcagcggcagcagagagaacagcggcagcagcagcatcggcatccccatcgccgtgcccacccccagcccccccaccatcggccccgagaacatcagcgtgcccccccccagcggcgccccccccgccccccccctggcccccctgctgcccgtgagcaccgtgatcgccgcccccggcagcgcccccggcagccagtacggcaccatgaccagacagatcagcagacacaacagcaccaccagcagcaccagcagcggcggctacagaagaacccccagcgtgaccgcccagttcagcgcccagccccacgtgaacggcggccccctgtacagccagaacagcatcgccgacagccccacccccccccccccccccccccccgacgacatccccatgttcgacgacagcccccccccccccccccccccccccgtggactacgaggacgaggaggccgccgtggtgcagtacaacgacccctacgccgacggcgaccccgcctgggcccccaagaactacatcgagaaggtggtggccatctacgactacaccaaggacaaggacgacgagctgagcttcatggagggcgccatcatctacgtgatcaagaagaacgacgacggctggtacgagggcgtgtgcaacagagtgaccggcctgttccccggcaactacgtggagagcatcatgcactacaccgactag

SEQ ID NO: 71365 - DNA, 1530 bp, Artificial Sequence
  Description of Artificial Sequence: Synthetic coding sequence
atggccgagctgcagatgctgctggaggaggagatccccagcggcaagagagccctgatcgagagctaccagaacctgaccagagtggccgactactgcgagaacaactacatccaggccaccgacaagagaaaggccctggaggagaccaaggcctacaccacccagagcctggccagcgtggcctaccagatcaacgccctggccaacaacgtgctgcagctgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacatggagagacccgtgagatacatcagaaagcccatcgactacaccgtgctggacgacgtgggccacggcgtgaagaagtggcacaagatcatccacggcaacaaccagcccgccagaaccggcaccctgagcagaaccaacccccccacccagaagccccccagcccccccatgagcggcagaggcaccctgggcagaaacaccccctacaagaccctggagcccgtgaagccccccaccgtgcccaacgactacatgaccagccccgccagactgggcagccagcacagccccggcagaaccgccagcctgaaccagagacccagaacccacagcggcagcagcggcggcagcggcagcagagagaacagcggcagcagcagcatcggcatccccatcgccgtgcccacccccagcccccccaccatcggccccgagaacatcagcgtgcccccccccagcggcgccccccccgccccccccctggcccccctgctgcccgtgagcaccgtgatcgccgcccccggcagcgcccccggcagccagtacggcaccatgaccagacagatcagcagacacaacagcaccaccagcagcaccagcagcggcggctacagaagaacccccagcgtgaccgcccagttcagcgcccagccccacgtgaacggcggccccctgtacagccagaacagcatcagcatcgcccccccccccccccccatgccccagctgaccccccagatccccctgaccggcttcgtggccagagtgcaggagaacatcgccgacagccccacccccccccccccccccccccccgacgacatccccatgttcgacgacagcccccccccccccccccccccccccgtggactacgaggacgaggaggccgccgtggtgcagtacaacgacccctacgccgacggcgaccccgcctgggcccccaagaactacatcgagaaggtggtggccatctacgactacaccaaggacaaggacgacgagctgagcttcatggagggcgccatcatctacgtgatcaagaagaacgacgacggctggtacgagggcgtgtgcaacagagtgaccggcctgttccccggcaactacgtggagagcatcatgcactacaccgactag

SEQ ID NO: 71366 - DNA, 1443 bp, Artificial Sequence
  Description of Artificial Sequence: Synthetic coding sequence
atggccgagctgcagatgctgctggaggaggagatccccagcggcaagagagccctgatcgagagctaccagaacctgaccagagtggccgactactgcgagaacaactacatccaggccaccgacaagagaaaggccctggaggagaccaaggcctacaccacccagagcctggccagcgtggcctaccagatcaacgccctggccaacaacgtgctgcagctgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacatggagagacccgtgagatacatcagaaagcccatcgactacaccgtgctggacgacgtgggccacggcgtgaagtggctgaaggccaagcacggcaacaaccagcccgccagaaccggcaccctgagcagaaccaacccccccacccagaagccccccagcccccccatgagcggcagaggcaccctgggcagaaacaccccctacaagaccctggagcccgtgaagccccccaccgtgcccaacgactacatgaccagccccgccagactgggcagccagcacagccccggcagaaccgccagcctgaaccagagacccagaacccacagcggcagcagcggcggcagcggcagcagagagaacagcggcagcagcagcatcggcatccccatcgccgtgcccacccccagcccccccaccatcggccccgcccccggcagcgcccccggcagccagtacggcaccatgaccagacagatcagcagacacaacagcaccaccagcagcaccagcagcggcggctacagaagaacccccagcgtgaccgcccagttcagcgcccagccccacgtgaacggcggccccctgtacagccagaacagcatcagcatcgcccccccccccccccccatgccccagctgaccccccagatccccctgaccggcttcgtggccagagtgcaggagaacatcgccgacagccccacccccccccccccccccccccccgacgacatccccatgttcgacgacagcccccccccccccccccccccccccgtggactacgaggacgaggaggccgccgtggtgcagtacaacgacccctacgccgacggcgaccccgcctgggcccccaagaactacatcgagaaggtggtggccatctacgactacaccaaggacaaggacgacgagctgagcttcatggagggcgccatcatctacgtgatcaagaagaacgacgacggctggtacgagggcgtgtgcaacagagtgaccggcctgttccccggcaactacgtggagagcatcatgcactacaccgactag

SEQ ID NO: 71367 - DNA, 1449 bp, Artificial Sequence
  Description of Artificial Sequence: Synthetic coding sequence
atggccgagctgcagatgctgctggaggaggagatccccagcggcaagagagccctgatcgagagctaccagaacctgaccagagtggccgactactgcgagaacaactacatccaggccaccgacaagagaaaggccctggaggagaccaaggcctacaccacccagagcctggccagcgtggcctaccagatcaacgccctggccaacaacgtgctgcagctgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacatggagagacccgtgagatacatcagaaagcccatcgactacaccgtgctggacgacgtgggccacggcgtgaagaagtggcacaagatcatccacggcaacaaccagcccgccagaaccggcaccctgagcagaaccaacccccccacccagaagccccccagcccccccatgagcggcagaggcaccctgggcagaaacaccccctacaagaccctggagcccgtgaagccccccaccgtgcccaacgactacatgaccagccccgccagactgggcagccagcacagccccggcagaaccgccagcctgaaccagagacccagaacccacagcggcagcagcggcggcagcggcagcagagagaacagcggcagcagcagcatcggcatccccatcgccgtgcccacccccagcccccccaccatcggccccgccgcccccggcagcgcccccggcagccagtacggcaccatgaccagacagatcagcagacacaacagcaccaccagcagcaccagcagcggcggctacagaagaacccccagcgtgaccgcccagttcagcgcccagccccacgtgaacggcggccccctgtacagccagaacagcatcagcatcgcccccccccccccccccatgccccagctgaccccccagatccccctgaccggcttcgtggccagagtgcaggagaacatcgccgacagccccacccccccccccccccccccccccgacgacatccccatgttcgacgacagcccccccccccccccccccccccccgtggactacgaggacgaggaggccgccgtggtgcagtacaacgacccctacgccgacggcgaccccgcctgggcccccaagaactacatcgagaaggtggtggccatctacgactacaccaaggacaaggacgacgagctgagcttcatggagggcgccatcatctacgtgatcaagaagaacgacgacggctggtacgagggcgtgtgcaacagagtgaccggcctgttccccggcaactacgtggagagcatcatgcactacaccgactag

SEQ ID NO: 71368 - DNA, 1272 bp, Artificial Sequence
  Description of Artificial Sequence: Synthetic coding sequence
atggccgagctgcagatgctgctggaggaggagatccccagcggcaagagagccctgatcgagagctaccagaacctgaccagagtggccgactactgcgagaacaactacatccaggccaccgacaagagaaaggccctggaggagaccaaggcctacaccacccagagcctggccagcgtggcctaccagatcaacgccctggccaacaacgtgctgcagctgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacatggagagacccgtgagatacatcagaaagcccatcgactacaccgtgctggacgacgtgggccacggcgtgaagaagtggcacaagatcatccacggcaacaaccagcccgccagaaccggcaccctgagcagaaccaacccccccacccagaagccccccagcccccccatgagcggcagaggcaccctgggcagaaacaccccctacaagaccctggagcccgtgaagccccccaccgtgcccaacgactacatgaccagccccgccagactgggcagccagcacagccccggcagaaccgccagcctgaaccagagacccagaacccacagcggcagcagcggcggcagcggcagcagagagaacagcggcagcagcagcatcggcatccccatcgccgtgcccacccccagcccccccaccatcggccccgtgagcatcgcccccccccccccccccatgccccagctgaccccccagatccccctgaccggcttcgtggccagagtgcaggagaacatcgccgacagccccacccccccccccccccccccccccgacgacatccccatgttcgacgacagcccccccccccccccccccccccccgtggactacgaggacgaggaggccgccgtggtgcagtacaacgacccctacgccgacggcgaccccgcctgggcccccaagaactacatcgagaaggtggtggccatctacgactacaccaaggacaaggacgacgagctgagcttcatggagggcgccatcatctacgtgatcaagaagaacgacgacggctggtacgagggcgtgtgcaacagagtgaccggcctgttccccggcaactacgtggagagcatcatgcactacaccgactag

SEQ ID NO: 71369 - DNA, 1359 bp, Artificial Sequence
  Description of Artificial Sequence: Synthetic coding sequence
atggccgagctgcagatgctgctggaggaggagatccccagcggcaagagagccctgatcgagagctaccagaacctgaccagagtggccgactactgcgagaacaactacatccaggccaccgacaagagaaaggccctggaggagaccaaggcctacaccacccagagcctggccagcgtggcctaccagatcaacgccctggccaacaacgtgctgcagctgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacatggagagacccgtgagatacatcagaaagcccatcgactacaccgtgctggacgacgtgggccacggcgtgaagtggctgaaggccaagcacggcaacaaccagcccgccagaaccggcaccctgagcagaaccaacccccccacccagaagccccccagcccccccatgagcggcagaggcaccctgggcagaaacaccccctacaagaccctggagcccgtgaagccccccaccgtgcccaacgactacatgaccagccccgccagactgggcagccagcacagccccggcagaaccgccagcctgaaccagagacccagaacccacagcggcagcagcggcggcagcggcagcagagagaacagcggcagcagcagcatcggcatccccatcgccgtgcccacccccagcccccccaccatcggccccgccgcccccggcagcgcccccggcagccagtacggcaccatgaccagacagatcagcagacacaacagcaccaccagcagcaccagcagcggcggctacagaagaacccccagcgtgaccgcccagttcagcgcccagccccacgtgaacggcggccccctgtacagccagaacagcatcgccgacagccccacccccccccccccccccccccccgacgacatccccatgttcgacgacagcccccccccccccccccccccccccgtggactacgaggacgaggaggccgccgtggtgcagtacaacgacccctacgccgacggcgaccccgcctgggcccccaagaactacatcgagaaggtggtggccatctacgactacaccaaggacaaggacgacgagctgagcttcatggagggcgccatcatctacgtgatcaagaagaacgacgacggctggtacgagggcgtgtgcaacagagtgaccggcctgttccccggcaactacgtggagagcatcatgcactacaccgactag

SEQ ID NO: 71370 - DNA, 1431 bp, Artificial Sequence
  Description of Artificial Sequence: Synthetic coding sequence
atggccgagctgcagatgctgctggaggaggagatccccagcggcaagagagccctgatcgagagctaccagaacctgaccagagtggccgactactgcgagaacaactacatccaggccaccgacaagagaaaggccctggaggagaccaaggcctacaccacccagagcctggccagcgtggcctaccagatcaacgccctggccaacaacgtgctgcagctgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacatggagagacccgtgagatacatcagaaagcccatcgactacaccgtgctggacgacgtgggccacggcgtgaagcacggcaacaaccagcccgccagaaccggcaccctgagcagaaccaacccccccacccagaagccccccagcccccccatgagcggcagaggcaccctgggcagaaacaccccctacaagaccctggagcccgtgaagccccccaccgtgcccaacgactacatgaccagccccgccagactgggcagccagcacagccccggcagaaccgccagcctgaaccagagacccagaacccacagcggcagcagcggcggcagcggcagcagagagaacagcggcagcagcagcatcggcatccccatcgccgtgcccacccccagcccccccaccatcggccccgccgcccccggcagcgcccccggcagccagtacggcaccatgaccagacagatcagcagacacaacagcaccaccagcagcaccagcagcggcggctacagaagaacccccagcgtgaccgcccagttcagcgcccagccccacgtgaacggcggccccctgtacagccagaacagcatcagcatcgcccccccccccccccccatgccccagctgaccccccagatccccctgaccggcttcgtggccagagtgcaggagaacatcgccgacagccccacccccccccccccccccccccccgacgacatccccatgttcgacgacagcccccccccccccccccccccccccgtggactacgaggacgaggaggccgccgtggtgcagtacaacgacccctacgccgacggcgaccccgcctgggcccccaagaactacatcgagaaggtggtggccatctacgactacaccaaggacaaggacgacgagctgagcttcatggagggcgccatcatctacgtgatcaagaagaacgacgacggctggtacgagggcgtgtgcaacagagtgaccggcctgttccccggcaactacgtggagagcatcatgcactacaccgactag

SEQ ID NO: 71371 - DNA, 1446 bp, Artificial Sequence
  Description of Artificial Sequence: Synthetic coding sequence
atggccgagctgcagatgctgctggaggaggagatccccagcggcaagagagccctgatcgagagctaccagaacctgaccagagtggccgactactgcgagaacaactacatccaggccaccgacaagagaaaggccctggaggagaccaaggcctacaccacccagagcctggccagcgtggcctaccagatcaacgccctggccaacaacgtgctgcagctgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacatggagagacccgtgagatacatcagaaagcccatcgactacaccgtgctggacgacgtgggccacggcgtgaagtggctgaaggccaagcacggcaacaaccagcccgccagaaccggcaccctgagcagaaccaacccccccacccagaagccccccagcccccccatgagcggcagaggcaccctgggcagaaacaccccctacaagaccctggagcccgtgaagccccccaccgtgcccaacgactacatgaccagccccgccagactgggcagccagcacagccccggcagaaccgccagcctgaaccagagacccagaacccacagcggcagcagcggcggcagcggcagcagagagaacagcggcagcagcagcatcggcatccccatcgccgtgcccacccccagcccccccaccatcggccccgccgcccccggcagcgcccccggcagccagtacggcaccatgaccagacagatcagcagacacaacagcaccaccagcagcaccagcagcggcggctacagaagaacccccagcgtgaccgcccagttcagcgcccagccccacgtgaacggcggccccctgtacagccagaacagcatcagcatcgcccccccccccccccccatgccccagctgaccccccagatccccctgaccggcttcgtggccagagtgcaggagaacatcgccgacagccccacccccccccccccccccccccccgacgacatccccatgttcgacgacagcccccccccccccccccccccccccgtggactacgaggacgaggaggccgccgtggtgcagtacaacgacccctacgccgacggcgaccccgcctgggcccccaagaactacatcgagaaggtggtggccatctacgactacaccaaggacaaggacgacgagctgagcttcatggagggcgccatcatctacgtgatcaagaagaacgacgacggctggtacgagggcgtgtgcaacagagtgaccggcctgttccccggcaactacgtggagagcatcatgcactacaccgactag

SEQ ID NO: 71372 - DNA, 1527 bp, Artificial Sequence
  Description of Artificial Sequence: Synthetic coding sequence
atggccgagctgcagatgctgctggaggaggagatccccagcggcaagagagccctgatcgagagctaccagaacctgaccagagtggccgactactgcgagaacaactacatccaggccaccgacaagagaaaggccctggaggagaccaaggcctacaccacccagagcctggccagcgtggcctaccagatcaacgccctggccaacaacgtgctgcagctgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacatggagagacccgtgagatacatcagaaagcccatcgactacaccgtgctggacgacgtgggccacggcgtgaagtggctgaaggccaagcacggcaacaaccagcccgccagaaccggcaccctgagcagaaccaacccccccacccagaagccccccagcccccccatgagcggcagaggcaccctgggcagaaacaccccctacaagaccctggagcccgtgaagccccccaccgtgcccaacgactacatgaccagccccgccagactgggcagccagcacagccccggcagaaccgccagcctgaaccagagacccagaacccacagcggcagcagcggcggcagcggcagcagagagaacagcggcagcagcagcatcggcatccccatcgccgtgcccacccccagcccccccaccatcggccccgagaacatcagcgtgcccccccccagcggcgccccccccgccccccccctggcccccctgctgcccgtgagcaccgtgatcgccgcccccggcagcgcccccggcagccagtacggcaccatgaccagacagatcagcagacacaacagcaccaccagcagcaccagcagcggcggctacagaagaacccccagcgtgaccgcccagttcagcgcccagccccacgtgaacggcggccccctgtacagccagaacagcatcagcatcgcccccccccccccccccatgccccagctgaccccccagatccccctgaccggcttcgtggccagagtgcaggagaacatcgccgacagccccacccccccccccccccccccccccgacgacatccccatgttcgacgacagcccccccccccccccccccccccccgtggactacgaggacgaggaggccgccgtggtgcagtacaacgacccctacgccgacggcgaccccgcctgggcccccaagaactacatcgagaaggtggtggccatctacgactacaccaaggacaaggacgacgagctgagcttcatggagggcgccatcatctacgtgatcaagaagaacgacgacggctggtacgagggcgtgtgcaacagagtgaccggcctgttccccggcaactacgtggagagcatcatgcactacaccgactag

SEQ ID NO: 71373 - DNA, 1428 bp, Artificial Sequence
  Description of Artificial Sequence: Synthetic coding sequence
atggccgagctgcagatgctgctggaggaggagatccccagcggcaagagagccctgatcgagagctaccagaacctgaccagagtggccgactactgcgagaacaactacatccaggccaccgacaagagaaaggccctggaggagaccaaggcctacaccacccagagcctggccagcgtggcctaccagatcaacgccctggccaacaacgtgctgcagctgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacatggagagacccgtgagatacatcagaaagcccatcgactacaccgtgctggacgacgtgggccacggcgtgaagcacggcaacaaccagcccgccagaaccggcaccctgagcagaaccaacccccccacccagaagccccccagcccccccatgagcggcagaggcaccctgggcagaaacaccccctacaagaccctggagcccgtgaagccccccaccgtgcccaacgactacatgaccagccccgccagactgggcagccagcacagccccggcagaaccgccagcctgaaccagagacccagaacccacagcggcagcagcggcggcagcggcagcagagagaacagcggcagcagcagcatcggcatccccatcgccgtgcccacccccagcccccccaccatcggccccgcccccggcagcgcccccggcagccagtacggcaccatgaccagacagatcagcagacacaacagcaccaccagcagcaccagcagcggcggctacagaagaacccccagcgtgaccgcccagttcagcgcccagccccacgtgaacggcggccccctgtacagccagaacagcatcagcatcgcccccccccccccccccatgccccagctgaccccccagatccccctgaccggcttcgtggccagagtgcaggagaacatcgccgacagccccacccccccccccccccccccccccgacgacatccccatgttcgacgacagcccccccccccccccccccccccccgtggactacgaggacgaggaggccgccgtggtgcagtacaacgacccctacgccgacggcgaccccgcctgggcccccaagaactacatcgagaaggtggtggccatctacgactacaccaaggacaaggacgacgagctgagcttcatggagggcgccatcatctacgtgatcaagaagaacgacgacggctggtacgagggcgtgtgcaacagagtgaccggcctgttccccggcaactacgtggagagcatcatgcactacaccgactag

SEQ ID NO: 71374 - DNA, 1341 bp, Artificial Sequence
  Description of Artificial Sequence: Synthetic coding sequence
atggccgagctgcagatgctgctggaggaggagatccccagcggcaagagagccctgatcgagagctaccagaacctgaccagagtggccgactactgcgagaacaactacatccaggccaccgacaagagaaaggccctggaggagaccaaggcctacaccacccagagcctggccagcgtggcctaccagatcaacgccctggccaacaacgtgctgcagctgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacatggagagacccgtgagatacatcagaaagcccatcgactacaccgtgctggacgacgtgggccacggcgtgaagcacggcaacaaccagcccgccagaaccggcaccctgagcagaaccaacccccccacccagaagccccccagcccccccatgagcggcagaggcaccctgggcagaaacaccccctacaagaccctggagcccgtgaagccccccaccgtgcccaacgactacatgaccagccccgccagactgggcagccagcacagccccggcagaaccgccagcctgaaccagagacccagaacccacagcggcagcagcggcggcagcggcagcagagagaacagcggcagcagcagcatcggcatccccatcgccgtgcccacccccagcccccccaccatcggccccgcccccggcagcgcccccggcagccagtacggcaccatgaccagacagatcagcagacacaacagcaccaccagcagcaccagcagcggcggctacagaagaacccccagcgtgaccgcccagttcagcgcccagccccacgtgaacggcggccccctgtacagccagaacagcatcgccgacagccccacccccccccccccccccccccccgacgacatccccatgttcgacgacagcccccccccccccccccccccccccgtggactacgaggacgaggaggccgccgtggtgcagtacaacgacccctacgccgacggcgaccccgcctgggcccccaagaactacatcgagaaggtggtggccatctacgactacaccaaggacaaggacgacgagctgagcttcatggagggcgccatcatctacgtgatcaagaagaacgacgacggctggtacgagggcgtgtgcaacagagtgaccggcctgttccccggcaactacgtggagagcatcatgcactacaccgactag

SEQ ID NO: 71375 - DNA, 1356 bp, Artificial Sequence
  Description of Artificial Sequence: Synthetic coding sequence
atggccgagctgcagatgctgctggaggaggagatccccagcggcaagagagccctgatcgagagctaccagaacctgaccagagtggccgactactgcgagaacaactacatccaggccaccgacaagagaaaggccctggaggagaccaaggcctacaccacccagagcctggccagcgtggcctaccagatcaacgccctggccaacaacgtgctgcagctgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacatggagagacccgtgagatacatcagaaagcccatcgactacaccgtgctggacgacgtgggccacggcgtgaagtggctgaaggccaagcacggcaacaaccagcccgccagaaccggcaccctgagcagaaccaacccccccacccagaagccccccagcccccccatgagcggcagaggcaccctgggcagaaacaccccctacaagaccctggagcccgtgaagccccccaccgtgcccaacgactacatgaccagccccgccagactgggcagccagcacagccccggcagaaccgccagcctgaaccagagacccagaacccacagcggcagcagcggcggcagcggcagcagagagaacagcggcagcagcagcatcggcatccccatcgccgtgcccacccccagcccccccaccatcggccccgcccccggcagcgcccccggcagccagtacggcaccatgaccagacagatcagcagacacaacagcaccaccagcagcaccagcagcggcggctacagaagaacccccagcgtgaccgcccagttcagcgcccagccccacgtgaacggcggccccctgtacagccagaacagcatcgccgacagccccacccccccccccccccccccccccgacgacatccccatgttcgacgacagcccccccccccccccccccccccccgtggactacgaggacgaggaggccgccgtggtgcagtacaacgacccctacgccgacggcgaccccgcctgggcccccaagaactacatcgagaaggtggtggccatctacgactacaccaaggacaaggacgacgagctgagcttcatggagggcgccatcatctacgtgatcaagaagaacgacgacggctggtacgagggcgtgtgcaacagagtgaccggcctgttccccggcaactacgtggagagcatcatgcactacaccgactag

SEQ ID NO: 71376 - DNA, 990 bp, Artificial Sequence
  Description of Artificial Sequence: Synthetic coding sequence
atggccgagctgcagatgctgctggaggaggagatccccagcggcaagagagccctgatcgagagctaccagaacctgaccagagtggccgactactgcgagaacaactacatccaggccaccgacaagagaaaggccctggaggagaccaaggcctacaccacccagagcctggccagcgtggcctaccagatcaacgccctggccaacaacgtgctgcagctgctggacatccaggccagccagctgagaagaatggagagcagcatcaaccacatcagccagcacggcaacaaccagcccgccagaaccggcaccctgagcagaaccaacccccccacccagaagccccccagcccccccatgagcggcagaggcaccctgggcagaaacaccccctacaagaccctggagcccgtgaagccccccaccgtgcccaacgactacatgaccagccccgccagactgggcagccagcacagccccggcagaaccgccagcctgaaccagagacccagaacccacagcggcagcagcggcggcagcggcagcagagagaacagcggcagcagcagcatcggcatccccatcgccgtgcccacccccagcccccccaccatcggccccgtggccgacagccccacccccccccccccccccccccccgacgacatccccatgttcgacgacagcccccccccccccccccccccccccgtggactacgaggacgaggaggccgccgtggtgcagtacaacgacccctacgccgacggcgaccccgcctgggcccccaagaactacatcgagaaggtggtggccatctacgactacaccaaggacaaggacgacgagctgagcttcatggagggcgccatcatctacgtgatcaagaagaacgacgacggctggtacgagggcgtgtgcaacagagtgaccggcctgttccccggcaactacgtggagagcatcatgcactacaccgactag

SEQ ID NO: 71377 - DNA, 1185 bp, Artificial Sequence
  Description of Artificial Sequence: Synthetic coding sequence
atggccgagctgcagatgctgctggaggaggagatccccagcggcaagagagccctgatcgagagctaccagaacctgaccagagtggccgactactgcgagaacaactacatccaggccaccgacaagagaaaggccctggaggagaccaaggcctacaccacccagagcctggccagcgtggcctaccagatcaacgccctggccaacaacgtgctgcagctgctggacatccaggccagccagctgagaagaatggagagcagcatcaaccacatcagccagaccgtggacatccacaaggagaaggtggccagaagagagatcggcatcctgaccaccaacaagaacaccagcagaacccacaagatcatcgcccccgccaacatggagagacccgtgagatacatcagaaagcccatcgactacaccgtgctggacgacgtgggccacggcgtgaagaagtggcacaagatcatccacggcaacaaccagcccgccagaaccggcaccctgagcagaaccaacccccccacccagaagccccccagcccccccatgagcggcagaggcaccctgggcagaaacaccccctacaagaccctggagcccgtgaagccccccaccgtgcccaacgactacatgaccagccccgccagactgggcagccagcacagccccggcagaaccgccagcctgaaccagagacccagaacccacagcggcagcagcggcggcagcggcagcagagagaacagcggcagcagcagcatcggcatccccatcgccgtgcccacccccagcccccccaccatcggccccgtggccgacagccccacccccccccccccccccccccccgacgacatccccatgttcgacgacagcccccccccccccccccccccccccgtggactacgaggacgaggaggccgccgtggtgcagtacaacgacccctacgccgacggcgaccccgcctgggcccccaagaactacatcgagaaggtggtggccatctacgactacaccaaggacaaggacgacgagctgagcttcatggagggcgccatcatctacgtgatcaagaagaacgacgacggctggtacgagggcgtgtgcaacagagtgaccggcctgttccccggcaactacgtggagagcatcatgcactacaccgactag

SEQ ID NO: 71378 - DNA, 3993 bp, Artificial Sequence
  Description of Artificial Sequence: Synthetic coding sequence
atgcccctgagcccccccgcccagggcgaccccggcgagcccagcccctgcagaccccccaagaagcacaccaccttccacctgtggagaagcaagaagaagcagcagcccgccccccccgactgcggcgtgttcgtgccccaccccctgcccgcccccgccggcgaggccagagccctggacgtggtggacggcaagtacgtggtgagagacagccaggagttccccctgcactgcggcgagagccagttcttccacaccaccagcgaggccctgggcagcctgctgctggagagcggcatcttcaagaagagcagagcccagccccccgaggacaacagaagaaagcccgtgctgggcaagctgggcaccctgttcaccgccggcagaagaagaaacagcagaaacggcctggagagccccaccagaagcaacgccaagcccctgagccccaaggacgtggtggccagccccaagctgcccgagagagagagcgagagaagcagaagccagagcagccagctgaagcagaccgacaccagcgaggagggcagccccagagagaaccccagagaggccgagggcgagctgcccgagagcggcggccccgccgccccccccgacgccgagctgagccccagatggagcagcagcgccgccgccgtggccgtgcagcagtgccacgagaacgacagcccccagctggagcccctggaggccgagggcgagcccttccccgacgccaccaccaccgccaagcagctgcacagcagccccggcaacagcagcagacaggagaacgccgagacccccgccagaagccccggcgaggacgccagccccggcgccggccacgagcaggaggccttcctgggcgtgagaggcgcccccggcagccccacccaggagagacccgccggcggcctgggcgaggcccccaacggcgcccccagcgtgtgcgccgaggagggcagcctgggccccagaaacgccagaagccagccccccaagggcgccagcgacctgcccggcgagccccccgccgagggcgccgcccacaccgccagcagcgcccaggccgactgcaccgccagacccaagggccacgcccaccccgccaaggtgctgaccctggacatctacctgagcaagaccgagggcgcccaggtggacgagcccgtggtgatcacccccagagccgaggactgcggcgactgggacgacatggagaagagaagcagcggcagaagaagcggcagaagaagaggcagccagaagagcaccgacagccccggcgccgacgccgagctgcccgagagcgccgccagagacgacgccgtgttcgacgacgaggtggcccccaacgccgccagcgacaacgccagcgccgagaagaaggtgaagagccccagagccgccctggacggcggcgtggccagcgccgccagccccgagagcaagcccagccccggcaccaagggccagctgagaggcgagagcgacagaagcaagcagcccccccccgccagcagccccaccaagagaaagggcagaagcagagccctggaggccgtgcccgccccccccgccagcggccccagagcccccgccaaggagagcccccccaagagagtgcccgaccccagccccgtgaccaagggcaccgccgccgagagcggcgaggaggccgccagagccatccccagagagctgcccgtgaagagcagcagcctgctgcccgagatcaagcccgagcacaagagaggccccctgcccaaccacttcaacggcagagccgagggcggcagaagcagagagctgggcagagccgccggcgcccccggcgccagcgacgccgacggcctgaagcccagaaaccacttcggcgtgggcagaagcaccgtgaccaccaaggtgaccctgcccgccaagcccaagcacgtggagctgaacctgaagacccccaagaacctggacagcctgggcaacgagcacaaccccttcagccagcccgtgcacaagggcaacaccgccaccaagatcagcctgttcgagaacaagagaaccaacagcagccccagacacaccgacatcagaggccagagaaacacccccgccagcagcaagaccttcgtgggcagagccaagctgaacctggccaagaaggccaaggagatggagcagcccgagaagaaggtgatgcccaacagcccccagaacggcgtgctggtgaaggagaccgccatcgagaccaaggtgaccgtgagcgaggaggagatcctgcccgccaccagaggcatgaacggcgacagcagcgagaaccaggccctgggcccccagcccaaccaggacgacaaggccgacgtgcagaccgacgccggctgcctgagcgagcccgtggccagcgccctgatccccgtgaaggaccacaagctgctggagaaggaggacagcgaggccgccgacagcaagagcctggtgctggagaacgtgaccgacaccgcccaggacatccccaccaccgtggacaccaaggacctgccccccaccgccatgcccaagccccagcacaccttcagcgacagccagagccccgccgagagcagccccggccccagcctgagcctgagcgcccccgcccccggcgacgtgcccaaggacacctgcgtgcagagccccatcagcagcttcccctgcaccgacctgaaggtgagcgagaaccacaagggctgcgtgctgcccgtgagcagacagaacaacgagaagatgcccctgctggagctgggcggcgagaccaccccccccctgagcaccgagagaagccccgaggccgtgggcagcgagtgccccagcagagtgctggtgcaggtgagaagcttcgtgctgcccgtggagagcacccaggacgtgagcagccaggtgatccccgagagcagcgaggtgagagaggtgcagctgcccacctgccacagcaacgagcccgaggtggtgagcgtggccagctgcgcccccccccaggaggaggtgctgggcaacgagcacagccactgcaccgccgagctggccgccaagagcggcccccaggtgatcccccccgccagcgagaagaccctgcccatccaggcccagagccagggcagcagaacccccctgatggccgagagcagccccaccaacagccccagcagcggcaaccacctggccaccccccagagacccgaccagaccgtgaccaacggccaggacagccccgccagcctgctgaacatcagcgccggcagcgacgacagcgtgttcgacagcagcagcgacatggagaagttcaccgagatcatcaagcagatggacagcgccgtgtgcatgcccatgaagagaaagaaggccagaatgcccaacagccccgccccccacttcgccatgccccccatccacgaggaccacctggagaaggtgttcgaccccaaggtgttcaccttcggcctgggcaagaagaaggagagccagcccgagatgagccccgccctgcacctgatgcagaacctggacaccaagagcaagctgagacccaagagagccagcgccgagcagagcgtgctgttcaagagcctgcacaccaacaccaacggcaacagcgagcccctggtgatgcccgagatcaacgacaaggagaacagagacgtgaccaacggcggcatcaagagaagcagactggagaagagcgccctgttcagcagcctgctgagcagcctgccccaggacaagatcttcagccccagcgtgaccagcgtgaacaccatgaccaccgccttcagcaccagccagaacggcagcctgagccagagcagcgtgagccagcccaccaccgagggcgcccccccctgcggcctgaacaaggagcagagcaacctgctgcccgacaacagcctgaaggtgttcaacttcaacagcagcagcaccagccacagcagcctgaagagccccagccacatgtag

SEQ ID NO: 71379 - DNA, 5172 bp, Artificial Sequence
  Description of Artificial Sequence: Synthetic coding sequence
atggagaagagaagcagcggcagaagaagcggcagaagaagaggcagccagaagagcaccgacagccccggcgccgacgccgagctgcccgagagcgccgccagagacgacgccgtgttcgacgacgaggtggcccccaacgccgccagcgacaacgccagcgccgagaagaaggtgaagagccccagagccgccctggacggcggcgtggccagcgccgccagccccgagagcaagcccagccccggcaccaagggccagctgagaggcgagagcgacagaagcaagcagcccccccccgccagcagccccaccaagagaaagggcagaagcagagccctggaggccgtgcccgccccccccgccagcggccccagagcccccgccaaggagagcccccccaagagagtgcccgaccccagccccgtgaccaagggcaccgccgccgagagcggcgaggaggccgccagagccatccccagagagctgcccgtgaagagcagcagcctgctgcccgagatcaagcccgagcacaagagaggccccctgcccaaccacttcaacggcagagccgagggcggcagaagcagagagctgggcagagccgccggcgcccccggcgccagcgacgccgacggcctgaagcccagaaaccacttcggcgtgggcagaagcaccgtgaccaccaaggtgaccctgcccgccaagcccaagcacgtggagctgaacctgaagacccccaagaacctggacagcctgggcaacgagcacaaccccttcagccagcccgtgcacaagggcaacaccgccaccaagatcagcctgttcgagaacaagagaaccaacagcagccccagacacaccgacatcagaggccagagaaacacccccgccagcagcaagaccttcgtgggcagagccaagctgaacctggccaagaaggccaaggagatggagcagcccgagaagaaggtgatgcccaacagcccccagaacggcgtgctggtgaaggagaccgccatcgagaccaaggtgaccgtgagcgaggaggagatcctgcccgccaccagaggcatgaacggcgacagcagcgagaaccaggccctgggcccccagcccaaccaggacgacaaggccgacgtgcagaccgacgccggctgcctgagcgagcccgtggccagcgccctgatccccgtgaaggaccacaagctgctggagaaggaggacagcgaggccgccgacagcaagagcctggtgctggagaacgtgaccgacaccgcccaggacatccccaccaccgtggacaccaaggacctgccccccaccgccatgcccaagccccagcacaccttcagcgacagccagagccccgccgagagcagccccggccccagcctgagcctgagcgcccccgcccccggcgacgtgcccaaggacacctgcgtgcagagccccatcagcagcttcccctgcaccgacctgaaggtgagcgagaaccacaagggctgcgtgctgcccgtgagcagacagaacaacgagaagatgcccctgctggagctgggcggcgagaccaccccccccctgagcaccgagagaagccccgaggccgtgggcagcgagtgccccagcagagtgctggtgcaggtgagaagcttcgtgctgcccgtggagagcacccaggacgtgagcagccaggtgatccccgagagcagcgaggtgagagaggtgcagctgcccacctgccacagcaacgagcccgaggtggtgagcgtggccagctgcgcccccccccaggaggaggtgctgggcaacgagcacagccactgcaccgccgagctggccgccaagagcggcccccaggtgatcccccccgccagcgagaagaccctgcccatccaggcccagagccagggcagcagaacccccctgatggccgagagcagccccaccaacagccccagcagcggcaaccacctggccaccccccagagacccgaccagaccgtgaccaacggccaggacagccccgccagcctgctgaacatcagcgccggcagcgacgacagcgtgttcgacagcagcagcgacatggagaagttcaccgagatcatcaagcagatggacagcgccgtgtgcatgcccatgaagagaaagaaggccagaatgcccaacagccccgccccccacttcgccatgccccccatccacgaggaccacctggagaaggtgttcgaccccaaggtgttcaccttcggcctgggcaagaagaaggagagccagcccgagatgagccccgccctgcacctgatgcagaacctggacaccaagagcaagctgagacccaagagagccagcgccgagcagagcgtgctgttcaagagcctgcacaccaacaccaacggcaacagcgagcccctggtgatgcccgagatcaacgacaaggagaacagagacgtgaccaacggcggcatcaagagaagcagactggagaagagcgccctgttcagcagcctgctgagcagcctgccccaggacaagatcttcagccccagcgtgaccagcgtgaacaccatgaccaccgccttcagcaccagccagaacggcagcctgagccagagcagcgtgagccagcccaccaccgagggcgcccccccctgcggcctgaacaaggagcagagcaacctgctgcccgacaacagcctgaaggtgttcaacttcaacagcagcagcaccagccacagcagcctgaagagccccagccacatggagaagtacccccagaaggagaagaccaaggaggacctggacagcagaagcaacctgcacctgcccgagaccaagttcagcgagctgagcaagctgaagaacgacgacatggagaaggccaaccacatcgagagcgtgatcaagagcaacctgcccaactgcgccaacagcgacaccgacttcatgggcctgttcaagagcagcagatacgaccccagcatcagcttcagcggcatgagcctgagcgacaccatgaccctgagaggcagcgtgcagaacaagctgaaccccagacccggcaaggtggtgatctacagcgagcccgacgtgagcgagaagtgcatcgaggtgttcagcgacatccaggactgcagcagctggagcctgagccccgtgatcctgatcaaggtggtgagaggctgctggatcctgtacgagcagcccaacttcgagggccacagcatccccctggaggagggcgagctggagctgagcggcctgtggggcatcgaggacatcctggagagacacgaggaggccgagagcgacaagcccgtggtgatcggcagcatcagacacgtggtgcaggactacagagtgagccacatcgacctgttcaccgagcccgagggcctgggcatcctgagcagctacttcgacgacaccgaggagatgcagggcttcggcgtgatgcagaagacctgcagcatgaaggtgcactggggcacctggctgatctacgaggagcccggcttccagggcgtgcccttcatcctggagcccggcgagtaccccgacctgagcttctgggacaccgaggaggcctacatcggcagcatgagacccctgaagatgggcggcagaaaggtggagttccccaccgaccccaaggtggtggtgtacgagaagcccttcttcgagggcaagtgcgtggagctggagaccggcatgtgcagcttcgtgatggagggcggcgagaccgaggaggccaccggcgacgaccacctgcccttcaccagcgtgggcagcatgaaggtgctgagaggcatctgggtggcctacgagaagcccggcttcaccggccaccagtacctgctggaggagggcgagtacagagactggaaggcctggggcggctacaacggcgagctgcagagcctgagacccatcctgggcgacttcagcaacgcccacatgatcatgtacagcgagaagaacttcggcagcaagggcagcagcatcgacgtgctgggcatcgtggccaacctgaaggagaccggctacggcgtgaagacccagagcatcaacgtgctgagcggcgtgtgggtggcctacgagaaccccgacttcaccggcgagcagtacatcctggacaagggcttctacaccagcttcgaggactggggcggcaagaactgcaagatcagcagcgtgcagcccatctgcctggacagcttcaccggccccagaagaagaaaccagatccacctgttcagcgagccccagttccagggccacagccagagcttcgaggagaccaccagccagatcgacgacagcttcagcaccaagagctgcagagtgagcggcggcagctgggtggtgtacgacggcgagaacttcaccggcaaccagtacgtgctggaggagggccactacccctgcctgagcgccatgggctgcccccccggcgccaccttcaagagcctgagattcatcgacgtggagttcagcgagcccaccatcatcctgttcgagagagaggacttcaagggcaagaagatcgagctgaacgccgagaccgtgaacctgagaagcctgggcttcaacacccagatcagaagcgtgcaggtgatcggcggcatctgggtgacctacgagtacggcagctacagaggcagacagttcctgctgagccccgccgaggtgcccaactggtacgagttcagcggctgcagacagatcggcagcctgagacccttcgtgcagaagagaatctacttcagactgagaaacaaggccaccggcctgttcatgagcaccaacggcaacctggaggacctgaagctgctgagaatccaggtgatggaggacgtgggcgccgacgaccagatctggatctaccaggagggctgcatcaagtgcagaatcgccgaggactgctgcctgaccatcgtgggcagcctggtgaccagcggcagcaagctgggcctggccctggaccagaacgccgacagccagttctggagcctgaagagcgacggcagaatctacagcaagctgaagcccaacctggtgctggacatcaagggcggcacccagtacgaccagaaccacatcatcctgaacaccgtgagcaaggagaagttcacccaggtgtgggaggccatggtgctgtacacctag

SEQ ID NO: 71380 - DNA, 951 bp, Artificial Sequence
  Description of Artificial Sequence: Synthetic coding sequence
atgcagaagcccaagaccgtggcctgggagaacctgggccccgagatgagcgccctgggcaccgccttcagcagagagggcggcagaaaggtggagttccccaccgaccccaaggtggtggtgtacgagaagcccttcttcgagggcaagtgcgtggagctggagaccggcatgtgcagcttcgtgatggagggcggcgagaccgaggaggccaccggcgacgaccacctgcccttcaccagcgtgggcagcatgaaggtgctgagaggcatctgggtggcctacgagaagcccggcttcaccggccaccagtacctgctggaggagggcgagtacagagactggaaggcctggggcggctacaacggcgagctgcagagcctgagacccatcctgggcgacttcagcaacgcccacatgatcatgtacagcgagaagaacttcggcagcaagggcagcagcatcgacgtgctgggcatcgtggccaacctgaaggagaccggctacggcgtgaagacccagagcatcaacgtgctgagcggcgtgtgggtggcctacgagaaccccgacttcaccggcgagcagtacatcctggacaagggcttctacaccagcttcgaggactggggcggcaagaactgcaagatcagcagcgtgcagcccatctgcctggacagcttcaccggccccagaagaagaaaccagatccacctgttcagcgagccccagttccagggccacagccagagcttcgaggagaccaccagccagatcgacgacagcttcagcaccaagagctgcagagtgagcggcggcagctgggtggtgtacgacggcgagaacttcaccggcaaccagtacgtgctggaggagggccactacccctgcctgagcgccatgggctgcccccccggcgccaccttcaagagcctgagattcatcgacgtgtag

SEQ ID NO: 71381 - DNA, 1629 bp, Artificial Sequence
  Description of Artificial Sequence: Synthetic coding sequence
atgcagaagcccaagaccgtggcctgggagaacctgggccccgagatgagcgccctgggcaccgccttcagcagagagggcggcagaaaggtggagttccccaccgaccccaaggtggtggtgtacgagaagcccttcttcgagggcaagtgcgtggagctggagaccggcatgtgcagcttcgtgatggagggcggcgagaccgaggaggccaccggcgacgaccacctgcccttcaccagcgtgggcagcatgaaggtgctgagaggcatctgggtggcctacgagaagcccggcttcaccggccaccagtacctgctggaggagggcgagtacagagactggaaggcctggggcggctacaacggcgagctgcagagcctgagacccatcctgggcgacttcagcaacgcccacatgatcatgtacagcgagaagaacttcggcagcaagggcagcagcatcgacgtgctgggcatcgtggccaacctgaaggagaccggctacggcgtgaagacccagagcatcaacgtgctgagcggcgtgtgggtggcctacgagaaccccgacttcaccggcgagcagtacatcctggacaagggcttctacaccagcttcgaggactggggcggcaagaactgcaagatcagcagcgtgcagcccatctgcctggacagcttcaccggccccagaagaagaaaccagatccacctgttcagcgagccccagttccagggccacagccagagcttcgaggagaccaccagccagatcgacgacagcttcagcaccaagagctgcagagtgagcggcggcagctgggtggtgtacgacggcgagaacttcaccggcaaccagtacgtgctggaggagggccactacccctgcctgagcgccatgggctgcccccccggcgccaccttcaagagcctgagattcatcgacgtggagttcagcgagcccaccatcatcctgttcgagagagaggacttcaagggcaagaagatcgagctgaacgccgagaccgtgaacctgagaagcctgggcttcaacacccagatcagaagcgtgcaggtgatcggcggcatctgggtgacctacgagtacggcagctacagaggcagacagttcctgctgagccccgccgaggtgcccaactggtacgagttcagcggctgcagacagatcggcagcctgagacccttcgtgcagaagagaatctacttcagactgagaaacaaggccaccggcctgttcatgagcaccaacggcaacctggaggacctgaagctgctgagaatccaggtgatggaggacgtgggcgccgacgaccagatctggatctaccaggagggctgcatcaagtgcagaatcgccgaggactgctgcctgaccatcgtgggcagcctggtgaccagcggcagcaagctgggcctggccctggaccagaacgccgacagccagttctggagcctgaagagcgacggcagaatctacagcaagctgaagcccaacctggtgctggacatcaagggcggcacccagtacgaccagaaccacatcatcctgaacaccgtgagcaaggagaagttcacccaggtgtgggaggccatggtgctgtacacctag

SEQ ID NO: 71382 - DNA, 504 bp, Artificial Sequence
  Description of Artificial Sequence: Synthetic coding sequence
atggtggcccagcaggagagcatcagagagggcttccagaagagatgcctgcccgtgatggtgctgaaggccaagaagcccttcaccttcgagacccaggagggcaagcaggagatgttccacgccaccgtggccaccgagaaggagttcttcttcgtgaaggtgttcaacaccctgctgaaggacaagttcatccccaagagaatcatcatcatcgccagatactacagacacagcggcttcctggaggtgaacagcgccagcagagtgctggacgccgagagcgaccagaaggtgaacgtgcccctgaacatcatcagaaaggccggcgagacccccaagatcaacaccctgcagacccagcccctgggcaccatcgtgaacggcctgttcgtggtgcagaaggtgaccgagaagaagaagaacatcctgttcgacctgagcgacaacaccggcaagatggaggtgctgggcgtgagaaacgaggacaccatgaagtgctag

SEQ ID NO: 71383 - DNA, 1032 bp, Artificial Sequence
  Description of Artificial Sequence: Synthetic coding sequence
atggagagcaagtacaaggagatcctgctgctgaccggcctggacaacatcaccgacgaggagctggacagattcaagttcttcctgagcgacgagttcaacatcgccaccggcaagctgcacaccgccaacagaatccaggtggccaccctgatgatccagaacgccggcgccgtgagcgccgtgatgaagaccatcagaatcttccagaagctgaactacatgctgctggccaagagactgcaggaggagaaggagaaggtggacaagcagtacaagagcgtgaccaagcccaagcccctgagccaggccgagatgagccccgccgccagcgccgccatcagaaacgacgtggccaagcagagagccgcccccaaggtgagcccccacgtgaagcccgagcagaagcagatggtggcccagcaggagagcatcagagagggcttccagaagagatgcctgcccgtgatggtgctgaaggccaagaagcccttcaccttcgagacccaggagggcaagcaggagatgttccacgccaccgtggccaccgagaaggagttcttcttcgtgaaggtgttcaacaccctgctgaaggacaagttcatccccaagagaatcatcatcatcgccagatactacagacacagcggcttcctggaggtgaacagcgccagcagagtgctggacgccgagagcgaccagaaggtgaacgtgcccctgaacatcatcagaaaggccggcgagacccccaagatcaacaccctgcagacccagcccctgggcaccatcgtgaacggcctgttcgtggtgcagaaggtgaccgagaagaagaagaacatcctgttcgacctgagcgacaacaccggcaagatggaggtgctgggcgtgagaaacgaggacaccatgaagtgcaaggagggcgacaaggtgagactgaccttcttcaccctgagcaagaacggcgagaagctgcagctgaccagcggcgtgcacagcaccatcaaggtgatcaaggccaagaagaagacctag

SEQ ID NO: 71384 - DNA, 411 bp, Artificial Sequence
  Description of Artificial Sequence: Synthetic coding sequence
atggagagcaagtacaaggagatcctgctgctgaccggcctggacaacatcaccgacgaggagctggacagattcaagttcttcctgagcgacgagttcaacatcgccaccggcaagctgcacaccgccaacagaatccaggtggccaccctgatgatccagaacgccggcgccgtgagcgccgtgatgaagaccatcagaatcttccagaagctgaactacatgctgctggccaagagactgcaggaggagaaggagaaggtggacaagcagtacaagagcgtgaccaagcccaagcccctgagccaggccgagatgagccccgccgccagcgccgccatcagaaacgacgtggccaagcagagagccgcccccaaggtgagcccccacgtgaagcccgagcagaagtag

SEQ ID NO: 71385 - DNA, 1800 bp, Artificial Sequence
  Description of Artificial Sequence: Synthetic coding sequence
atgagcaaggaggagagacccggcagagaggagatcctggagtgccaggtgatgtgggagcccgacagcaagaagaacacccagatggacagattcagagccgccgtgggcgccgcctgcggcctggccctggagagctacgacgacctgtaccactggagcgtggagagctacagcgacttctgggccgagttctggaagttcagcggcatcgtgttcagcagagtgtacgacgaggtggtggacaccagcaagggcatcgccgacgtgcccgagtggttcaagggcagcagactgaactacgccgagaacctgctgagacacaaggagaacgacagagtggccctgtacatcgccagagagggcaaggaggagatcgtgaaggtgaccttcgaggagctgagacaggaggtggccctgttcgccgccgccatgagaaagatgggcgtgaagaagggcgacagagtggtgggctacctgcccaacagcgagcacgccgtggaggccatgctggccgccgccagcatcggcgccatctggagcagcaccagccccgacttcggcgtgaacggcgtgctggacagattcagccagatccagcccaagctgatcttcagcgtggaggccgtggtgtacaacggcaaggagcacaaccacatggagaagctgcagcaggtggtgaagggcctgcccgacctgaagaaggtggtggtgatcccctacgtgagcagcagagagaacatcgacctgagcaagatccccaacagcgtgttcctggacgacttcctggccaccggcaccagcgagcaggccccccagctggagttcgagcagctgcccttcagccaccccctgttcatcatgttcagcagcggcaccaccggcgcccccaagtgcatggtgcacagcgccggcggcaccctgatccagcacctgaaggagcacctgctgcacggcaacatgaccagcagcgacatcctgctgtgctacaccaccgtgggctggatgatgtggaactggatggtgagcctgctggccaccggcgccgccatggtgctgtacgacggcagccccctggtgcccacccccaacgtgctgtgggacctggtggacagaatcggcatcaccgtgctggtgaccggcgccaagtggctgagcgtgctggaggagaaggccatgaagcccgtggagacccacagcctgcagatgctgcacaccatcctgagcaccggcagccccctgaaggcccagagctacgagtacgtgtacagatgcatcaagagcagcatcctgctgggcagcatcagcggcggcaccgacatcatcagctgcttcatgggccacaacttcagcctgcccgtgtacaagggcgagatccaggccagaaacctgggcatggccgtggaggcctggaacgaggagggcaaggccgtgtggggcgagagcggcgagctggtgtgcaccaagcccatcccctgccagcccacccacttctggaacgacgagaacggcaacaagtacagaaaggcctacttcagcaagttccccggcatctgggcccacggcgactactgcagaatcaaccccaagaccggcggcatcgtgatgctgggcagaagcgacggcaccctgaaccccaacggcgtgagattcggcagcagcgagatctacaacatcgtgtacgcccagagacaggagagcggcagctgcagacagaccgaccacagatggaagagcagaggcgccagaagatgcttcctggagcccagagaccccggcagcgtgcccggccacccctag

SEQ ID NO: 71386 - DNA, 2019 bp, Artificial Sequence
  Description of Artificial Sequence: Synthetic coding sequence
atgagcaaggaggagagacccggcagagaggagatcctggagtgccaggtgatgtgggagcccgacagcaagaagaacacccagatggacagattcagagccgccgtgggcgccgcctgcggcctggccctggagagctacgacgacctgtaccactggagcgtggagagctacagcgacttctgggccgagttctggaagttcagcggcatcgtgttcagcagagtgtacgacgaggtggtggacaccagcaagggcatcgccgacgtgcccgagtggttcaagggcagcagactgaactacgccgagaacctgctgagacacaaggagaacgacagagtggccctgtacatcgccagagagggcaaggaggagatcgtgaaggtgaccttcgaggagctgagacaggaggtggccctgttcgccgccgccatgagaaagatgggcgtgaagaagggcgacagagtggtgggctacctgcccaacagcgagcacgccgtggaggccatgctggccgccgccagcatcggcgccatctggagcagcaccagccccgacttcggcgtgaacggcgtgctggacagattcagccagatccagcccaagctgatcttcagcgtggaggccgtggtgtacaacggcaaggagcacaaccacatggagaagctgcagcaggtggtgaagggcctgcccgacctgaagaaggtggtggtgatcccctacgtgagcagcagagagaacatcgacctgagcaagatccccaacagcgtgttcctggacgacttcctggccaccggcaccagcgagcaggccccccagctggagttcgagcagctgcccttcagccaccccctgttcatcatgttcagcagcggcaccaccggcgcccccaagtgcatggtgcacagcgccggcggcaccctgatccagcacctgaaggagcacctgctgcacggcaacatgaccagcagcgacatcctgctgtgctacaccaccgtgggctggatgatgtggaactggatggtgagcctgctggccaccggcgccgccatggtgctgtacgacggcagccccctggtgcccacccccaacgtgctgtgggacctggtggacagaatcggcatcaccgtgctggtgaccggcgccaagtggctgagcgtgctggaggagaaggccatgaagcccgtggagacccacagcctgcagatgctgcacaccatcctgagcaccggcagccccctgaaggcccagagctacgagtacgtgtacagatgcatcaagagcagcatcctgctgggcagcatcagcggcggcaccgacatcatcagctgcttcatgggccacaacttcagcctgcccgtgtacaagggcgagatccaggccagaaacctgggcatggccgtggaggcctggaacgaggagggcaaggccgtgtggggcgagagcggcgagctggtgtgcaccaagcccatcccctgccagcccacccacttctggaacgacgagaacggcaacaagtacagaaaggcctacttcagcaagttccccggcatctgggcccacggcgactactgcagaatcaaccccaagaccggcggcatcgtgatgctgggcagaagcgacggcaccctgaaccccaacggcgtgagattcggcagcagcgagatctacaacatcgtggagagcttcgaggaggtggaggacagcctgtgcgtgccccagtacaacaagtacagagaggagagagtgatcctgttcctgaagatggccagcggccacgccttccagcccgacctggtgaagagaatcagagacgccatcagaatgggcctgagcgccagacacgtgcccagcctgatcctggagaccaagggcatcccctacaccctgaacggcaagaaggtggaggtggccgtgaagcagatcatcgccggcaaggccgtggagcagggcggcgccttcagcaaccccgagaccctggacctgtacagagacatccccgagctgcagggcttctag

SEQ ID NO: 71387 - DNA, 762 bp, Artificial Sequence
  Description of Artificial Sequence: Synthetic coding sequence
atgagaaagatgggcgtgaagaagggcgacagagtggtgggctacctgcccaacagcgagcacgccgtggaggccatgctggccgccgccagcatcggcgccatctggagcagcaccagccccgacttcggcgtgaacggcgtgctggacagattcagccagatccagcccaagctgatcttcagcgtggaggccgtggtgtacaacggcaaggagcacaaccacatggagaagctgcagcaggtggtgaagggcctgcccgacctgaagaaggtggtggtgatcccctacgtgagcagcagagagaacatcgacctgagcaagatccccaacagcgtgttcctggacgacttcctggccaccggcaccagcgagcaggccccccagctggagttcgagcagctgcccttcagccaccccctgttcatcatgttcagcagcggcaccaccggcgcccccaagtgcatggtgcacagcgccggcggcaccctgatccagcacctgaaggagcacctgctgcacggcaacatgaccagcagcgacatcctgctgtgctacaccaccgtgggctggatgatgtggaactggatggtgagcctgctggccaccggcgccgccatggtgctgtacgacggcagccccctggtgcccacccccaacgtgctgtgggacctggtggacagaatcggctacctgggcagctggagactgctgcagaaccagccccaggacagaggccacagacacgcctggcccgagtag

SEQ ID NO: 71388 - DNA, 1845 bp, Artificial Sequence
  Description of Artificial Sequence: Synthetic coding sequence
atgagacccccccagtgcctgctgcacacccccagcctggccagccccctgctgctgctgctgctgtggctgctgggcggcggcgtgggcgccgagggcagagaggacgccgagctgctggtgaccgtgagaggcggcagactgagaggcatcagactgaagacccccggcggccccgtgagcgccttcctgggcatccccttcgccgagccccccatgggccccagaagattcctgccccccgagcccaagcagccctggagcggcgtggtggacgccaccaccttccagagcgtgtgctaccagtacgtggacaccctgtaccccggcttcgagggcaccgagatgtggaaccccaacagagagctgagcgaggactgcctgtacctgaacgtgtggaccccctaccccagacccaccagccccacccccgtgctggtgtggatctacggcggcggcttctacagcggcgccagcagcctggacgtgtacgacggcagattcctggtgcaggccgagagaaccgtgctggtgagcatgaactacagagtgggcgccttcggcttcctggccctgcccggcagcagagaggcccccggcaacgtgggcctgctggaccagagactggccctgcagtgggtgcaggagaacgtggccgccttcggcggcgaccccaccagcgtgaccctgttcggcgagagcgccggcgccgccagcgtgggcatgcacctgctgagcccccccagcagaggcctgttccacagagccgtgctgcagagcggcgcccccaacggcccctgggccaccgtgggcatgggcgaggccagaagaagagccacccagctggcccacctggtgggctgcccccccggcggcaccggcggcaacgacaccgagctggtggcctgcctgagaaccagacccgcccaggtgctggtgaaccacgagtggcacgtgctgccccaggagagcgtgttcagattcagcttcgtgcccgtggtggacggcgacttcctgagcgacacccccgaggccctgatcaacgccggcgacttccacggcctgcaggtgctggtgggcgtggtgaaggacgagggcagctacttcctggtgtacggcgcccccggcttcagcaaggacaacgagagcctgatcagcagagccgagttcctggccggcgtgagagtgggcgtgccccaggtgagcgacctggccgccgaggccgtggtgctgcactacaccgactggctgcaccccgaggaccccgccagactgagagaggccctgagcgacgtggtgggcgaccacaacgtggtgtgccccgtggcccagctggccggcagactggccgcccagggcgccagagtgtacgcctacgtgttcgagcacagagccagcaccctgagctggcccctgtggatgggcgtgccccacggctacgagatcgagttcatcttcggcatccccctggaccccagcagaaactacaccgccgaggagaagatcttcgcccagagactgatgagatactgggccaacttcgccagaaccggcgaccccaacgagcccagagaccccaaggccccccagtggcccccctacaccgccggcgcccagcagtacgtgagcctggacctgagacccctggaggtgagaagaggcctgagagcccaggcctgcgccttctggaacagattcctgcccaagctgctgagcgccaccgacaccctggacgaggccgagagacagtggaaggccgagttccacagatggagcagctacatggtgcactggaagaaccagttcgaccactacagcaagcaggacagatgcagcgacctgtag

SEQ ID NO: 71389 - DNA, 1854 bp, Artificial Sequence
  Description of Artificial Sequence: Synthetic coding sequence
atgagacccccccagtgcctgctgcacacccccagcctggccagccccctgctgctgctgctgctgtggctgctgggcggcggcgtgggcgccgagggcagagaggacgccgagctgctggtgaccgtgagaggcggcagactgagaggcatcagactgaagacccccggcggccccgtgagcgccttcctgggcatccccttcgccgagccccccatgggccccagaagattcctgccccccgagcccaagcagccctggagcggcgtggtggacgccaccaccttccagagcgtgtgctaccagtacgtggacaccctgtaccccggcttcgagggcaccgagatgtggaaccccaacagagagctgagcgaggactgcctgtacctgaacgtgtggaccccctaccccagacccaccagccccacccccgtgctggtgtggatctacggcggcggcttctacagcggcgccagcagcctggacgtgtacgacggcagattcctggtgcaggccgagagaaccgtgctggtgagcatgaactacagagtgggcgccttcggcttcctggccctgcccggcagcagagaggcccccggcaacgtgggcctgctggaccagagactggccctgcagtgggtgcaggagaacgtggccgccttcggcggcgaccccaccagcgtgaccctgttcggcgagagcgccggcgccgccagcgtgggcatgcacctgctgagcccccccagcagaggcctgttccacagagccgtgctgcagagcggcgcccccaacggcccctgggccaccgtgggcatgggcgaggccagaagaagagccacccagctggcccacctggtgggctgcccccccggcggcaccggcggcaacgacaccgagctggtggcctgcctgagaaccagacccgcccaggtgctggtgaaccacgagtggcacgtgctgccccaggagagcgtgttcagattcagcttcgtgcccgtggtggacggcgacttcctgagcgacacccccgaggccctgatcaacgccggcgacttccacggcctgcaggtgctggtgggcgtggtgaaggacgagggcagctacttcctggtgtacggcgcccccggcttcagcaaggacaacgagagcctgatcagcagagccgagttcctggccggcgtgagagtgggcgtgccccaggtgagcgacctggccgccgaggccgtggtgctgcactacaccgactggctgcaccccgaggaccccgccagactgagagaggccctgagcgacgtggtgggcgaccacaacgtggtgtgccccgtggcccagctggccggcagactggccgcccagggcgccagagtgtacgcctacgtgttcgagcacagagccagcaccctgagctggcccctgtggatgggcgtgccccacggctacgagatcgagttcatcttcggcatccccctggaccccagcagaaactacaccgccgaggagaagatcttcgcccagagactgatgagatactgggccaacttcgccagaaccggcgaccccaacgagcccagagaccccaaggccccccagtggcccccctacaccgccggcgcccagcagtacgtgagcctggacctgagacccctggaggtgagaagaggcctgagagcccaggcctgcgccttctggaacagattcctgcccaagctgctgagcgccaccgccagcgaggcccccagcacctgccccggcttcacccacggcgaggccgcccccagacccggcctgcccctgcccctgctgctgctgcaccagctgctgctgctgttcctgagccacctgagaagactgtag

SEQ ID NO: 71390 - DNA, 1854 bp, Artificial Sequence; identical to SEQ ID NO: 71389
  Description of Artificial Sequence: Synthetic coding sequence

SEQ ID NO: 71391 - DNA, 1845 bp, Artificial Sequence; identical to SEQ ID NO: 71388
  Description of Artificial Sequence: Synthetic coding sequence

SEQ ID NO: 71392 - DNA, 1581 bp, Artificial Sequence
  Description of Artificial Sequence: Synthetic coding sequence
atgagacccccccagtgcctgctgcacacccccagcctggccagccccctgctgctgctgctgctgtggctgctgggcggcggcgtgggcgccgagggcagagaggacgccgagctgctggtgaccgtgagaggcggcagactgagaggcatcagactgaagacccccggcggccccgtgagcgccttcctgggcatccccttcgccgagccccccatgggccccagaagattcctgccccccgagcccaagcagccctggagcggcgtggtggacgccaccaccttccagagcgtgtgctaccagtacgtggacaccctgtaccccggcttcgagggcaccgagatgtggaaccccaacagagagctgagcgaggactgcctgtacctgaacgtgtggaccccctaccccagacccaccagccccacccccgtgctggtgtggatctacggcggcggcttctacagcggcgccagcagcctggacgtgtacgacggcagattcctggtgcaggccgagagaaccgtgctggtgagcatgaactacagagtgggcgccttcggcttcctggccctgcccggcagcagagaggcccccggcaacgtgggcctgctggaccagagactggccctgcagtgggtgcaggagaacgtggccgccttcggcggcgaccccaccagcgtgaccctgttcggcgagagcgccggcgccgccagcgtgggcatgcacctgctgagcccccccagcagaggcctgttccacagagccgtgctgcagagcggcgcccccaacggcccctgggccaccgtgggcatgggcgaggccagaagaagagccacccagctggcccacctggtgggctgcccccccggcggcaccggcggcaacgacaccgagctggtggcctgcctgagaaccagacccgcccaggtgctggtgaaccacgagtggcacgtgctgccccaggagagcgtgttcagattcagcttcgtgcccgtggtggacggcgacttcctgagcgacacccccgaggccctgatcaacgccggcgacttccacggcctgcagctggccggcagactggccgcccagggcgccagagtgtacgcctacgtgttcgagcacagagccagcaccctgagctggcccctgtggatgggcgtgccccacggctacgagatcgagttcatcttcggcatccccctggaccccagcagaaactacaccgccgaggagaagatcttcgcccagagactgatgagatactgggccaacttcgccagaaccggcgaccccaacgagcccagagaccccaaggccccccagtggcccccctacaccgccggcgcccagcagtacgtgagcctggacctgagacccctggaggtgagaagaggcctgagagcccaggcctgcgccttctggaacagattcctgcccaagctgctgagcgccaccgacaccctggacgaggccgagagacagtggaaggccgagttccacagatggagcagctacatggtgcactggaagaaccagttcgaccactacagcaagcaggacagatgcagcgacctgtag

SEQ ID NO: 71393 - DNA, 1806 bp, Artificial Sequence
  Description of Artificial Sequence: Synthetic coding sequence
atgagacccccccagtgcctgctgcacacccccagcctggccagccccctgctgctgctgctgctgtggctgctgggcggcggcgtgggcgccgagggcagagaggacgccgagctgctggtgaccgtgagaggcggcagactgagaggcatcagactgaagacccccggcggccccgtgagcgccttcctgggcatccccttcgccgagccccccatgggccccagaagattcctgccccccgagcccaagcagccctggagcggcgtggtggacgccaccaccttccagagcgtgtgctaccagtacgtggacaccctgtaccccggcttcgagggcaccgagatgtggaaccccaacagagagctgagcgaggactgcctgtacctgaacgtgtggaccccctaccccagacccaccagccccacccccgtgctggtgtggatctacggcggcggcttctacagcggcgccagcagcctggacgtgtacgacggcagattcctggtgcaggccgagagaaccgtgctggtgagcatgaactacagagtgggcgccttcggcttcctggccctgcccggcagcagagaggcccccggcaacgtgggcctgctggaccagagactggccctgcagtgggtgcaggagaacgtggccgccttcggcggcgaccccaccagcgtgaccctgttcggcgagagcgccggcgccgccagcgtgggcatgcacctgctgagcccccccagcagaggcctgttccacagagccgtgctgcagagcggcgcccccaacggcccctgggccaccgtgggcatgggcgaggccagaagaagagccacccagctggcccacctggtgggctgcccccccggcggcaccggcggcaacgacaccgagctggtggcctgcctgagaaccagacccgcccaggtgctggtgaaccacgagtggcacgtgctgccccaggagagcgtgttcagattcagcttcgtgcccgtggtggacggcgacttcctgagcgacacccccgaggccctgatcaacgccggcgacttccacggcctgcaggtgctggtgggcgtggtgaaggacgagggcagctacttcctggtgtacggcgcccccggcttcagcaaggacaacgagagcctgatcagcagagccgagttcctggccggcgtgagagtgggcgtgccccaggtgagcgacctggccgccgaggccgtggtgctgcactacaccgactggctgcaccccgaggaccccgccagactgagagaggccctgagcgacgtggtgggcgaccacaacgtggtgtgccccgtggcccagctggccggcagactggccgcccagggcgccagagtgtacgcctacgtgttcgagcacagagccagcaccctgagctggcccctgtggatgggcgtgccccacggctacgagatcgagttcatcttcggcatccccctggaccccagcagaaactacaccgccgaggagaagatcttcgcccagagactgatgagatactgggccaacttcgccagaaccggcgaccccaacgagcccagagaccccaaggccccccagtggcccccctacaccgccggcgcccagcagtacgtgagcctggacctgagacccctggaggtgagaagaggcctgagagcccaggcctgcgccttctggaacagattcctgcccaagctgctgagcgccaccggcatgcagggccccgccggcagcggcagaagaggcgtgggcgccagatgcaaccccagcctgctgcccctggccagcgagtag

SEQ ID NO: 71394 - DNA, 1845 bp, Artificial Sequence; identical to SEQ ID NO: 71388
  Description of Artificial Sequence: Synthetic coding sequence

SEQ ID NO: 71395 - DNA, 480 bp, Artificial Sequence
  Description of Artificial Sequence: Synthetic coding sequence
atgagacccccccagtgcctgctgcacacccccagcctggccagccccctgctgctgctgctgctgtggctgctgggcggcggcgtgggcgccgagggcagagaggacgccgagctgctggtgaccgtgagaggcggcagactgagaggcatcagactgaagacccccggcggccccgtgagcgccttcctgggcatccccttcgccgagccccccatgggccccagaagattcctgccccccgagcccaagcagccctggagcggcgtggtggacgccaccaccttccagagcgtgtgctaccagtacgtggacaccctgtaccccggcttcgagggcaccgagatgtggaaccccaacagagagctgagcgaggactgcctgtacctgaacgtgtggaccccctaccccagacccaccagccccacccccgtgctggtgtggatctacggcggcggcttctacagcggcgccagctag

SEQ ID NO: 71396 - DNA, 87 bp, Artificial Sequence
  Description of Artificial Sequence: Synthetic coding sequence
atgagacccccccagtgcctgctgcacacccccagcctggccagccccctgctgctgctgctgctgtggctgctgggcggcggctag

SEQ ID NO: 71397 - DNA, 282 bp, Artificial Sequence
  Description of Artificial Sequence: Synthetic coding sequence
atgctgggcctggtgatgagctgccccgacagaaccctggtgaccaaggtgagaagccaccccagcggcaaccagcacagacccaccagaggcggcagcagaagcttccactgcagaagaggcgtgcccagacccgccgccctgagagtgctgcccagatgccccgccttcagcgacgccgcctgccccgccgccatgagacccccccagtgcctgctgcacacccccagcctggccagccccctgctgctgctgctgctgtggctgctgggcggcggctag

SEQ ID NO: 71398 - DNA, 1284 bp, Artificial Sequence
  Description of Artificial Sequence: Synthetic coding sequence
atggccgtgctggccgccctgctgagaagcggcgccagaagcagaagccccctgctgagaagactggtgcaggagatcagatacgtggagagaagctacgtgagcaagcccaccctgaaggaggtggtgatcgtgagcgccaccagaacccccatcggcagcttcctgggcagcctgagcctgctgcccgccaccaagctgggcagcatcgccatccagggcgccatcgagaaggccggcatccccaaggaggaggtgaaggaggcctacatgggcaacgtgctgcagggcggcgagggccaggcccccaccagacaggccgtgctgggcgccggcctgcccatcagcaccccctgcaccaccatcaacaaggtgtgcgccagcggcatgaaggccatcatgatggccagccagagcctgatgtgcggccaccaggacgtgatggtggccggcggcatggagagcatgagcaacgtgccctacgtgatgaacagaggcagcaccccctacggcggcgtgaagctggaggacctgatcgtgaaggacggcctgaccgacgtgtacaacaagatccacatgggcagctgcgccgagaacaccgccaagaagctgaacatcgccagaaacgagcaggacgcctacgccatcaacagctacaccagaagcaaggccgcctgggaggccggcaagttcggcaacgaggtgatccccgtgaccgtgaccgtgaagggccagcccgacgtggtggtgaaggaggacgaggagtacaagagagtggacttcagcaaggtgcccaagctgaagaccgtgttccagaaggagaacggcaccgtgaccgccgccaacgccagcaccctgaacgacggcgccgccgccctggtgctgatgaccgccgacgccgccaagagactgaacgtgacccccctggccagaatcgtggccttcgccgacgccgccgtggagcccatcgacttccccatcgcccccgtgtacgccgccagcatggtgctgaaggacgtgggcctgaagaaggaggacatcgccatgtgggaggtgaacgaggccttcagcctggtggtgctggccaacatcaagatgctggagatcgacccccagaaggtgaacatcaacggcggcgccgtgagcctgggccaccccatcggcatgagcggcgccagaatcgtgggccacctgacccacgccctgaagcagggcgagtacggcctggccagcatctgcaacggcggcggcggcgccagcgccatgctgatccagaagctgtag

SEQ ID NO: 71399 - DNA, 1194 bp, Artificial Sequence
  Description of Artificial Sequence: Synthetic coding sequence
atgaacgccggcagcgaccccgtggtgatcgtgagcgccgccagaaccatcatcggcagcttcaacggcgccctggccgccgtgcccgtgcaggacctgggcagcaccgtgatcaaggaggtgctgaagagagccaccgtggcccccgaggacgtgagcgaggtgatcttcggccacgtgctggccgccggctgcggccagaaccccgtgagacaggccagcgtgggcgccggcatcccctacagcgtgcccgcctggagctgccagatgatctgcggcagcggcctgaaggccgtgtgcctggccgtgcagagcatcggcatcggcgacagcagcatcgtggtggccggcggcatggagaacatgagcaaggccccccacctggcctacctgagaaccggcgtgaagatcggcgagatgcccctgaccgacagcatcctgtgcgacggcctgaccgacgccttccacaactgccacatgggcatcaccgccgagaacgtggccaagaagtggcaggtgagcagagaggaccaggacaaggtggccgtgctgagccagaacagaaccgagaacgcccagaaggccggccacttcgacaaggagatcgtgcccgtgctggtgagcaccagaaagggcctgatcgaggtgaagaccgacgagttccccagacacggcagcaacatcgaggccatgagcaagctgaagccctacttcctgaccgacggcaccggcaccgtgacccccgccaacgccagcggcatcaacgacggcgccgccgccgtggtgctgatgaagaagagcgaggccgacaagagaggcctgacccccctggccagaatcgtgagctggagccaggtgggcgtggagcccagcatcatgggcatcggccccatccccgccatcaagcaggccgtgaccaaggccggctggagcctggaggacgtggacatcttcgagatcaacgaggccttcgccgccgtgagcgccgccatcgtgaaggagctgggcctgaaccccgagaaggtgaacatcgagggcggcgccatcgccctgggccaccccctgggcgccagcggctgcagaatcctggtgaccctgctgcacaccctggagagaatgggcagaagcagaggcgtggccgccctgtgcatcggcggcggcatgggcatcgccatgtgcgtgcagagagagtag

SEQ ID NO: 71400 - DNA, 1281 bp, Artificial Sequence
  Description of Artificial Sequence: Synthetic coding sequence
atgggcagccaccccgtgctgagaatctggggcaacagaagagccaccgccgccagcctgggcagaagcggcggcagactgagcagccccagactgctgagagtggtggcccccaccctgaccttcgcccagaccagcagatgcagcttcaacggcgccctggccgccgtgcccgtgcaggacctgggcagcaccgtgatcaaggaggtgctgaagagagccaccgtggcccccgaggacgtgagcgaggtgatcttcggccacgtgctggccgccggctgcggccagaaccccgtgagacaggccagcgtgggcgccggcatcccctacagcgtgcccgcctggagctgccagatgatctgcggcagcggcctgaaggccgtgtgcctggccgtgcagagcatcggcatcggcgacagcagcatcgtggtggccggcggcatggagaacatgagcaaggccccccacctggcctacctgagaaccggcgtgaagatcggcgagatgcccctgaccgacagcatcctgtgcgacggcctgaccgacgccttccacaactgccacatgggcatcaccgccgagaacgtggccaagaagtggcaggtgagcagagaggaccaggacaaggtggccgtgctgagccagaacagaaccgagaacgcccagaaggccggccacttcgacaaggagatcgtgcccgtgctggtgagcaccagaaagggcctgatcgaggtgaagaccgacgagttccccagacacggcagcaacatcgaggccatgagcaagctgaagccctacttcctgaccgacggcaccggcaccgtgacccccgccaacgccagcggcatcaacgacggcgccgccgccgtggtgctgatgaagaagagcgaggccgacaagagaggcctgacccccctggccagaatcgtgagctggagccaggtgggcgtggagcccagcatcatgggcatcggccccatccccgccatcaagcaggccgtgaccaaggccggctggagcctggaggacgtggacatcttcgagatcaacgaggccttcgccgccgtgagcgccgccatcgtgaaggagctgggcctgaaccccgagaaggtgaacatcgagggcggcgccatcgccctgggccaccccctgggcgccagcggctgcagaatcctggtgaccctgctgcacaccctggagagaatgggcagaagcagaggcgtggccgccctgtgcatcggcggcggcatgggcatcgccatgtgcgtgcagagagagtag

SEQ ID NO: 71401 - DNA, 1275 bp, Artificial Sequence
  Description of Artificial Sequence: Synthetic coding sequence
atgcagagactgcaggtggtgctgggccacctgagaggccccgccgacagcggctggatgccccaggccgccccctgcctgagcggcgccccccaggccagcgccgccgacgtggtggtggtgcacggcagaagaaccgccatctgcagagccggcagaggcggcttcaaggacaccacccccgacgagctgctgagcgccgtgatgaccgccgtgctgaaggacgtgaacctgagacccgagcagctgggcgacatctgcgtgggcaacgtgctgcagcccggcgccggcgccatcatggccagaatcgcccagttcctgagcgacatccccgagaccgtgcccctgagcaccgtgaacagacagtgcagcagcggcctgcaggccgtggccagcatcgccggcggcatcagaaacggcagctacgacatcggcatggcctgcggcgtggagagcatgagcctggccgacagaggcaaccccggcaacatcaccagcagactgatggagaaggagaaggccagagactgcctgatccccatgggcatcaccagcgagaacgtggccgagagattcggcatcagcagagagaagcaggacaccttcgccctggccagccagcagaaggccgccagagcccagagcaagggctgcttccaggccgagatcgtgcccgtgaccaccaccgtgcacgacgacaagggcaccaagagaagcatcaccgtgacccaggacgagggcatcagacccagcaccaccatggagggcctggccaagctgaagcccgccttcaagaaggacggcagcaccaccgccggcaacagcagccaggtgagcgacggcgccgccgccatcctgctggccagaagaagcaaggccgaggagctgggcctgcccatcctgggcgtgctgagaagctacgccgtggtgggcgtgccccccgacatcatgggcatcggccccgcctacgccatccccgtggccctgcagaaggccggcctgaccgtgagcgacgtggacatcttcgagatcaacgaggccttcgccagccaggccgcctactgcgtggagaagctgagactgccccccgagaaggtgaaccccctgggcggcgccgtggccctgggccaccccctgggctgcaccggcgccagacaggtgatcaccctgctgaacgagctgaagagaagaggcaagagagcctacggcgtggtgagcatgtgcatcggcaccggcatgggcgccgccgccgtgttcgagtaccccggcaactag

SEQ ID NO: 71402 - DNA, 1071 bp, Artificial Sequence
  Description of Artificial Sequence: Synthetic coding sequence
atgaccgccgtgctgaaggacgtgaacctgagacccgagcagctgggcgacatctgcgtgggcaacgtgctgcagcccggcgccggcgccatcatggccagaatcgcccagttcctgagcgacatccccgagaccgtgcccctgagcaccgtgaacagacagtgcagcagcggcctgcaggccgtggccagcatcgccggcggcatcagaaacggcagctacgacatcggcatggcctgcggcgtggagagcatgagcctggccgacagaggcaaccccggcaacatcaccagcagactgatggagaaggagaaggccagagactgcctgatccccatgggcatcaccagcgagaacgtggccgagagattcggcatcagcagagagaagcaggacaccttcgccctggccagccagcagaaggccgccagagcccagagcaagggctgcttccaggccgagatcgtgcccgtgaccaccaccgtgcacgacgacaagggcaccaagagaagcatcaccgtgacccaggacgagggcatcagacccagcaccaccatggagggcctggccaagctgaagcccgccttcaagaaggacggcagcaccaccgccggcaacagcagccaggtgagcgacggcgccgccgccatcctgctggccagaagaagcaaggccgaggagctgggcctgcccatcctgggcgtgctgagaagctacgccgtggtgggcgtgccccccgacatcatgggcatcggccccgcctacgccatccccgtggccctgcagaaggccggcctgaccgtgagcgacgtggacatcttcgagatcaacgaggccttcgccagccaggccgcctactgcgtggagaagctgagactgccccccgagaaggtgaaccccctgggcggcgccgtggccctgggccaccccctgggctgcaccggcgccagacaggtgatcaccctgctgaacgagctgaagagaagaggcaagagagcctacggcgtggtgagcatgtgcatcggcaccggcatgggcgccgccgccgtgttcgagtaccccggcaactag

SEQ ID NO: 71403 - DNA, 462 bp, Artificial Sequence
  Description of Artificial Sequence: Synthetic coding sequence
atgcagagactgcaggtggtgctgggccacctgagaggccccgccgacagcggctggatgccccaggccgccccctgcctgagcggcgccccccaggccagcgccgccgacgtggtggtggtgcacggcagaagaaccgccatctgcagagccggcagaggcggcttcaaggacaccacccccgacgagctgctgagcgccgtgatgaccgccgtgctgaaggacgtgaacctgagacccgagcagctgggcgacatctgcgtgggcaacgtgctgcagcccggcgccggcgccatcatggccagaatcgcccagttcctgagcgacatccccgagaccgtgcccctgagcaccgtgaacagacagtgcagcagcggcctgcaggccgtggccagcatcgccggctggagcccctgcccctggctgaccgagggcaccctggagatcctgctgagagcctag

SEQ ID NO: 71404 - DNA, 381 bp, Artificial Sequence
  Description of Artificial Sequence: Synthetic coding sequence
atgagcctggccgacagaggcaaccccggcaacatcaccagcagactgatggagaaggagaaggccagagactgcctgatccccatgggcatcaccagcgagaacgtggccgagagattcggcatcagcagagagaagcaggacaccttcgccctggccagccagcagaaggccgccagagcccagagcaagggctgcttccaggccgagatcgtgcccgtgaccaccaccgtgcacgacgacaagggcaccaagagaagcatcaccgtgacccaggacgagggcatcagacccagcaccaccatggagggcctggccaagctgaagcccgccttcaagaaggacggcagcaccaccgccggcgagaccggccccggctag

SEQ ID NO: 71405 - DNA, 996 bp, Artificial Sequence
  Description of Artificial Sequence: Synthetic coding sequence
atgcagagactgcaggtggtgctgggccacctgagaggccccgccgacagcggctggatgccccaggccgccccctgcctgagcggcgccccccaggccagcgccgccgacgtggtggtggtgcacggcagaagaaccgccatctgcagagccggcagaggcggcttcaaggacaccacccccgacgagctgctgagcgccgtgatgaccgccgtgctgaaggacgtgaacctgagacccgagcagctgggcgacatctgcgtgggcaacgtgctgcagcccggcgccggcgccatcatggccagaatcgcccagttcctgagcgacatccccgagaccgtgcccctgagcaccgtgaacagacagtgcagcagcggcctgcaggccgtggccagcatcgccggcggcatcagaaacggcagctacgacatcggcatggcctgcggcatcaccagcgagaacgtggccgagagattcggcatcagcagagagaagcaggacaccttcgccctggccagccagcagaaggccgccagagcccagagcaagggctgcttccaggccgagatcgtgcccgtgaccaccaccgtgcacgacgacaagggcaccaagagaagcatcaccgtgacccaggacgagggcatcagacccagcaccaccatggagggcctggccaagctgaagcccgccttcaagaaggacggcagcaccaccgccggcctgaccgtgagcgacgtggacatcttcgagatcaacgaggccttcgccagccaggccgcctactgcgtggagaagctgagactgccccccgagaaggtgaaccccctgggcggcgccgtggccctgggccaccccctgggctgcaccggcgccagacaggtgatcaccctgctgaacgagctgaagagaagaggcaagagagcctacggcgtggtgagcatgtgcatcggcaccggcatgggcgccgccgccgtgttcgagtaccccggcaactag

SEQ ID NO: 71406 - DNA, 7377 bp, Artificial Sequence
  Description of Artificial Sequence: Synthetic coding sequence
atggtgctgctgctgtgcctgagctgcctgatcttcagctgcctgaccttcagctggctgaagatctggggcaagatgaccgacagcaagcccatcaccaagagcaagagcgaggccaacctgatccccagccaggagcccttccccgccagcgacaacagcggcgagaccccccagagaaacggcgagggccacaccctgcccaagacccccagccaggccgagcccgccagccacaagggccccaaggacgccggcagaagaagaaacagcctgccccccagccaccagaagccccccagaaaccccctgagcagcagcgacgccgcccccagccccgagctgcaggccaacggcaccggcacccagggcctggaggccaccgacaccaacggcctgagcagcagcgccagaccccagggccagcaggccggcagccccagcaaggaggacaagaagcaggccaacatcaagagacagctgatgaccaacttcatcctgggcagcttcgacgactacagcagcgacgaggacagcgtggccggcagcagcagagagagcaccagaaagggcagcagagccagcctgggcgccctgagcctggaggcctacctgaccaccggcgaggccgagaccagagtgcccaccatgagacccagcatgagcggcctgcacctggtgaagagaggcagagagcacaagaagctggacctgcacagagacttcaccgtggccagccccgccgagttcgtgaccagattcggcggcgacagagtgatcgagaaggtgctgatcgccaacaacggcatcgccgccgtgaagtgcatgagaagcatcagaagatgggcctacgagatgttcagaaacgagagagccatcagattcgtggtgatggtgacccccgaggacctgaaggccaacgccgagtacatcaagatggccgaccactacgtgcccgtgcccggcggccccaacaacaacaactacgccaacgtggagctgatcgtggacatcgccaagagaatccccgtgcaggccgtgtgggccggctggggccacgccagcgagaaccccaagctgcccgagctgctgtgcaagaacggcgtggccttcctgggcccccccagcgaggccatgtgggccctgggcgacaagatcgccagcaccgtggtggcccagaccctgcaggtgcccaccctgccctggagcggcagcggcctgaccgtggagtggaccgaggacgacctgcagcagggcaagagaatcagcgtgcccgaggacgtgtacgacaagggctgcgtgaaggacgtggacgagggcctggaggccgccgagagaatcggcttccccctgatgatcaaggccagcgagggcggcggcggcaagggcatcagaaaggccgagagcgccgaggacttccccatcctgttcagacaggtgcagagcgagatccccggcagccccatcttcctgatgaagctggcccagcacgccagacacctggaggtgcagatcctggccgaccagtacggcaacgccgtgagcctgttcggcagagactgcagcatccagagaagacaccagaagatcgtggaggaggcccccgccaccatcgcccccctggccatcttcgagttcatggagcagtgcgccatcagactggccaagaccgtgggctacgtgagcgccggcaccgtggagtacctgtacagccaggacggcagcttccacttcctggagctgaaccccagactgcaggtggagcacccctgcaccgagatgatcgccgacgtgaacctgcccgccgcccagctgcagatcgccatgggcgtgcccctgcacagactgaaggacatcagactgctgtacggcgagagcccctggggcgtgacccccatcagcttcgagacccccagcaacccccccctggccagaggccacgtgatcgccgccagaatcaccagcgagaaccccgacgagggcttcaagcccagcagcggcaccgtgcaggagctgaacttcagaagcagcaagaacgtgtggggctacttcagcgtggccgccaccggcggcctgcacgagttcgccgacagccagttcggccactgcttcagctggggcgagaacagagaggaggccatcagcaacatggtggtggccctgaaggagctgagcatcagaggcgacttcagaaccaccgtggagtacctgatcaacctgctggagaccgagagcttccagaacaacgacatcgacaccggctggctggactacctgatcgccgagaaggtgcaggccgagaagcccgacatcatgctgggcgtggtgtgcggcgccctgaacgtggccgacgccatgttcagaacctgcatgaccgacttcctgcacagcctggagagaggccaggtgctgcccgccgacagcctgctgaacctggtggacgtggagctgatctacggcggcgtgaagtacatcctgaaggtggccagacagagcctgaccatgttcgtgctgatcatgaacggctgccacatcgagatcgacgcccacagactgaacgacggcggcctgctgctgagctacaacggcaacagctacaccacctacatgaaggaggaggtggacagctacagaatcaccatcggcaacaagacctgcgtgttcgagaaggagaacgaccccaccgtgctgagaagccccagcgccggcaagctgacccagtacaccgtggaggacggcggccacgtggaggccggcagcagctacgccgagatggaggtgatgaagatgatcatgaccctgaacgtgcaggagagaggcagagtgaagtacatcaagagacccggcgccgtgctggaggccggctgcgtggtggccagactggagctggacgaccccagcaaggtgcaccccgccgagcccttcaccggcgagctgcccgcccagcagaccctgcccatcctgggcgagaagctgcaccaggtgttccacagcgtgctggagaacctgaccaacgtgatgagcggcttctgcctgcccgagcccgtgttcagcatcaagctgaaggagtgggtgcagaagctgatgatgaccctgagacaccccagcctgcccctgctggagctgcaggagatcatgaccagcgtggccggcagaatccccgcccccgtggagaagagcgtgagaagagtgatggcccagtacgccagcaacatcaccagcgtgctgtgccagttccccagccagcagatcgccaccatcctggactgccacgccgccaccctgcagagaaaggccgacagagaggtgttcttcatcaacacccagagcatcgtgcagctggtgcagagatacagaagcggcatcagaggctacatgaagaccgtggtgctggacctgctgagaagatacctgagagtggagcaccacttccagcaggcccactacgacaagtgcgtgatcaacctgagagagcagttcaagcccgacatgagccaggtgctggactgcatcttcagccacgcccaggtggccaagaagaaccagctggtgatcatgctgatcgacgagctgtgcggccccgaccccagcctgagcgacgagctgatcagcatcctgaacgagctgacccagctgagcaagagcgagcactgcaaggtggccctgagagccagacagatcctgatcgccagccacctgcccagctacgagctgagacacaaccaggtggagagcatcttcctgagcgccatcgacatgtacggccaccagttctgccccgagaacctgaagaagctgatcctgagcgagaccaccatcttcgacgtgctgcccaccttcttctaccacgccaacaaggtggtgtgcatggccagcctggaggtgtacgtgagaagaggctacatcgcctacgagctgaacagcctgcagcacagacagctgcccgacggcacctgcgtggtggagttccagttcatgctgcccagcagccaccccaacagaatgaccgtgcccatcagcatcaccaaccccgacctgctgagacacagcaccgagctgttcatggacagcggcttcagccccctgtgccagagaatgggcgccatggtggccttcagaagattcgaggacttcaccagaaacttcgacgaggtgatcagctgcttcgccaacgtgcccaaggacacccccctgttcagcgaggccagaaccagcctgtacagcgaggacgactgcaagagcctgagagaggagcccatccacatcctgaacgtgagcatccagtgcgccgaccacctggaggacgaggccctggtgcccatcctgagaaccttcgtgcagagcaagaagaacatcctggtggactacggcctgagaagaatcaccttcctgatcgcccaggagaaggagttccccaagttcttcaccttcagagccagagacgagttcgccgaggacagaatctacagacacctggagcccgccctggccttccagctggagctgaacagaatgagaaacttcgacctgaccgccgtgccctgcgccaaccacaagatgcacctgtacctgggcgccgccaaggtgaaggagggcgtggaggtgaccgaccacagattcttcatcagagccatcatcagacacagcgacctgatcaccaaggaggccagcttcgagtacctgcagaacgagggcgagagactgctgctggaggccatggacgagctggaggtggccttcaacaacaccagcgtgagaaccgactgcaaccacatcttcctgaacttcgtgcccaccgtgatcatggaccccttcaagatcgaggagagcgtgagatacatggtgatgagatacggcagcagactgtggaagctgagagtgctgcaggccgaggtgaagatcaacatcagacagaccaccaccggcagcgccgtgcccatcagactgttcatcaccaacgagagcggctactacctggacatcagcctgtacaaggaggtgaccgacagcagaagcggcaacatcatgttccacagcttcggcaacaagcagggcccccagcacggcatgctgatcaacaccccctacgtgaccaaggacctgctgcaggccaagagattccaggcccagaccctgggcaccacctacatctacgacttccccgagatgttcagacaggccctgttcaagctgtggggcagccccgacaagtaccccaaggacatcctgacctacaccgagctggtgctggacagccagggccagctggtggagatgaacagactgcccggcggcaacgaggtgggcatggtggccttcaagatgagattcaagacccaggagtaccccgagggcagagacgtgatcgtgatcggcaacgacatcaccttcagaatcggcagcttcggccccggcgaggacctgctgtacctgagagccagcgagatggccagagccgagggcatccccaagatctacgtggccgccaacagcggcgccagaatcggcatggccgaggagatcaagcacatgttccacgtggcctgggtggaccccgaggacccccacaagggcttcaagtacctgtacctgaccccccaggactacaccagaatcagcagcctgaacagcgtgcactgcaagcacatcgaggagggcggcgagagcagatacatgatcaccgacatcatcggcaaggacgacggcctgggcgtggagaacctgagaggcagcggcatgatcgccggcgagagcagcctggcctacgaggagatcgtgaccatcagcctggtgacctgcagagccatcggcatcggcgcctacctggtgagactgggccagagagtgatccaggtggagaacagccacatcatcctgaccggcgccagcgccctgaacaaggtgctgggcagagaggtgtacaccagcaacaaccagctgggcggcgtgcagatcatgcactacaacggcgtgagccacatcaccgtgcccgacgacttcgagggcgtgtacaccatcctggagtggctgagctacatgcccaaggacaaccacagccccgtgcccatcatcacccccaccgaccccatcgacagagagatcgagttcctgcccagcagagccccctacgaccccagatggatgctggccggcagaccccaccccaccctgaagggcacctggcagagcggcttcttcgaccacggcagcttcaaggagatcatggccccctgggcccagaccgtggtgaccggcagagccagactgggcggcatccccgtgggcgtgatcgccgtggagaccagaaccgtggaggtggccgtgcccgccgaccccgccaacctggacagcgaggccaagatcatccagcaggccggccaggtgtggttccccgacagcgcctacaagaccgcccaggccgtgaaggacttcaacagagagaagctgcccctgatgatcttcgccaactggagaggcttcagcggcggcatgaaggacatgtacgaccaggtgctgaagttcggcgcctacatcgtggacggcctgagacagtacaagcagcccatcctgatctacatccccccctacgccgagctgagaggcggcagctgggtggtgatcgacgccaccatcaaccccctgtgcatcgagatgtacgccgacaaggagagcagaggcggcgtgctggagcccgagggcaccgtggagatcaagttcagaaagaaggacctgatcaagagcatgagaagaatcgaccccgcctacaagaagctgatggagcagctgggcgagcccgacctgagcgacaaggacagaaaggacctggagggcagactgaaggccagagaggacctgctgctgcccatctaccaccaggtggccgtgcagttcgccgacttccacgacacccccggcagaatgctggagaagggcgtgatcagcgacatcctggagtggaagaccgccagaaccttcctgtactggagactgagaagactgctgctggaggaccaggtgaagcaggagatcctgcaggccagcggcgagctgagccacgtgcacatccagagcatgctgagaagatggttcgtggagaccgagggcgccgtgaaggcctacctgtgggacaacaaccaggtggtggtgcagtggctggagcagcactggcaggccggcgacggccccagaagcaccatcagagagaacatcacctacctgaagcacgacagcgtgctgaagaccatcagaggcctggtggaggagaaccccgaggtggccgtggactgcgtgatctacctgagccagcacatcagccccgccgagagagcccaggtggtgcacctgctgagcaccatggacagccccgccagcacctag

SEQ ID NO: 71407 - DNA, 7377 bp, Artificial Sequence; identical to SEQ ID NO: 71406
  Description of Artificial Sequence: Synthetic coding sequence

SEQ ID NO: 71408 - DNA, 7167 bp, Artificial Sequence
  Description of Artificial Sequence: Synthetic coding sequence
atggtgctgctgctgtgcctgagctgcctgatcttcagctgcctgaccttcagctggctgaagatctggggcaagatgaccgacagcaagcccatcaccaagagcaagagcgaggccaacctgatccccagccaggagcccttccccgccagcgacaacagcggcgagaccccccagagaaacggcgagggccacaccctgcccaagacccccagccaggccgagcccgccagccacaagggccccaaggacgccggcagaagaagaaacagcctgccccccagccaccagaagccccccagaaaccccctgagcagcagcgacgccgcccccagccccgagctgcaggccaacggcaccggcacccagggcctggaggccaccgacaccaacggcctgagcagcagcgccagaccccagggccagcaggccggcagccccagcaaggaggacaagaagcaggccaacatcaagagacagctgatgaccaacttcatcctgggcagcttcgacgactacagcagcgacgaggacagcgtggccggcagcagcagagagagcaccagaaagggcagcagagccagcctgggcgccctgagcctggaggcctacctgaccaccggcgaggccgagaccagagtgcccaccatgagacccagcatgagcggcctgcacctggtgaagagaggcagagagcacaagaagctggacctgcacagagacttcaccgtggccagccccgccgagttcgtgaccagattcggcggcgacagagtgatcgagaaggtgctgatcgccaacaacggcatcgccgccgtgaagtgcatgagaagcatcagaagatgggcctacgagatgttcagaaacgagagagccatcagattcgtggtgatggtgacccccgaggacctgaaggccaacgccgagtacatcaagatggccgaccactacgtgcccgtgcccggcggccccaacaacaacaactacgccaacgtggagctgatcgtggacatcgccaagagaatccccgtgcaggccgtgtgggccggctggggccacgccagcgagaaccccaagctgcccgagctgctgtgcaagaacggcgtggccttcctgggcccccccagcgaggccatgtgggccctgggcgacaagatcgccagcaccgtggtggcccagaccctgcaggtgcccaccctgccctggagcggcagcggcctgaccgtggagtggaccgaggacgacctgcagcagggcaagagaatcagcgtgcccgaggacgtgtacgacaagggctgcgtgaaggacgtggacgagggcctggaggccgccgagagaatcggcttccccctgatgatcaaggccagcgagggcggcggcggcaagggcatcagaaaggccgagagcgccgaggacttccccatcctgttcagacaggtgcagagcgagatccccggcagccccatcttcctgatgaagctggcccagcacgccagacacctggaggtgcagatcctggccgaccagtacggcaacgccgtgagcctgttcggcagagactgcagcatccagagaagacaccagaagatcgtggaggaggcccccgccaccatcgcccccctggccatcttcgagttcatggagcagtgcgccatcagactggccaagaccgtgggctacgtgagcgccggcaccgtggagtacctgtacagccaggacggcagcttccacttcctggagctgaaccccagactgcaggtggagcacccctgcaccgagatgatcgccgacgtgaacctgcccgccgcccagctgcagatcgccatgggcgtgcccctgcacagactgaaggacatcagactgctgtacggcgagagcccctggggcgtgacccccatcagcttcgagacccccagcaacccccccctggccagaggccacgtgatcgccgccagaatcaccagcgagaaccccgacgagggcttcaagcccagcagcggcaccgtgcaggagctgaacttcagaagcagcaagaacgtgtggggctacttcagcgtggccgccaccggcggcctgcacgagttcgccgacagccagttcggccactgcttcagctggggcgagaacagagaggaggccatcagcaacatggtggtggccctgaaggagctgagcatcagaggcgacttcagaaccaccgtggagtacctgatcaacctgctggagaccgagagcttccagaacaacgacatcgacaccggctggctggactacctgatcgccgagaaggtgcaggccgagaagcccgacatcatgctgggcgtggtgtgcggcgccctgaacgtggccgacgccatgttcagaacctgcatgaccgacttcctgcacagcctggagagaggccaggtgctgcccgccgacagcctgctgaacctggtggacgtggagctgatctacggcggcgtgaagtacatcctgaaggtggccagacagagcctgaccatgttcgtgctgatcatgaacggctgccacatcgagatcgacgcccacagactgaacgacggcggcctgctgctgagctacaacggcaacagctacaccacctacatgaaggaggaggtggacagctacagaatcaccatcggcaacaagacctgcgtgttcgagaaggagaacgaccccaccgtgctgagaagccccagcgccggcaagctgacccagtacaccgtggaggacggcggccacgtggaggccggcagcagctacgccgagatggaggtgatgaagatgatcatgaccctgaacgtgcaggagagaggcagagtgaagtacatcaagagacccggcgccgtgctggaggccggctgcgtggtggccagactggagctggacgaccccagcaaggtgcaccccgccgagcccttcaccggcgagctgcccgcccagcagaccctgcccatcctgggcgagaagctgcaccaggtgttccacagcgtgctggagaacctgaccaacgtgatgagcggcttctgcctgcccgagcccgtgttcagcatcaagctgaaggagtgggtgcagaagctgatgatgaccctgagacaccccagcctgcccctgctggagctgcaggagatcatgaccagcgtggccggcagaatccccgcccccgtggagaagagcgtgagaagagtgatggcccagtacgccagcaacatcaccagcgtgctgtgccagttccccagccagcagatcgccaccatcctggactgccacgccgccaccctgcagagaaaggccgacagagaggtgttcttcatcaacacccagagcatcgtgcagctggtgcagagcaaggacgagctgtgcggccccgaccccagcctgagcgacgagctgatcagcatcctgaacgagctgacccagctgagcaagagcgagcactgcaaggtggccctgagagccagacagatcctgatcgccagccacctgcccagctacgagctgagacacaaccaggtggagagcatcttcctgagcgccatcgacatgtacggccaccagttctgccccgagaacctgaagaagctgatcctgagcgagaccaccatcttcgacgtgctgcccaccttcttctaccacgccaacaaggtggtgtgcatggccagcctggaggtgtacgtgagaagaggctacatcgcctacgagctgaacagcctgcagcacagacagctgcccgacggcacctgcgtggtggagttccagttcatgctgcccagcagccaccccaacagaatgaccgtgcccatcagcatcaccaaccccgacctgctgagacacagcaccgagctgttcatggacagcggcttcagccccctgtgccagagaatgggcgccatggtggccttcagaagattcgaggacttcaccagaaacttcgacgaggtgatcagctgcttcgccaacgtgcccaaggacacccccctgttcagcgaggccagaaccagcctgtacagcgaggacgactgcaagagcctgagagaggagcccatccacatcctgaacgtgagcatccagtgcgccgaccacctggaggacgaggccctggtgcccatcctgagaaccttcgtgcagagcaagaagaacatcctggtggactacggcctgagaagaatcaccttcctgatcgcccaggagaaggagttccccaagttcttcaccttcagagccagagacgagttcgccgaggacagaatctacagacacctggagcccgccctggccttccagctggagctgaacagaatgagaaacttcgacctgaccgccgtgccctgcgccaaccacaagatgcacctgtacctgggcgccgccaaggtgaaggagggcgtggaggtgaccgaccacagattcttcatcagagccatcatcagacacagcgacctgatcaccaaggaggccagcttcgagtacctgcagaacgagggcgagagactgctgctggaggccatggacgagctggaggtggccttcaacaacaccagcgtgagaaccgactgcaaccacatcttcctgaacttcgtgcccaccgtgatcatggaccccttcaagatcgaggagagcgtgagatacatggtgatgagatacggcagcagactgtggaagctgagagtgctgcaggccgaggtgaagatcaacatcagacagaccaccaccggcagcgccgtgcccatcagactgttcatcaccaacgagagcggctactacctggacatcagcctgtacaaggaggtgaccgacagcagaagcggcaacatcatgttccacagcttcggcaacaagcagggcccccagcacggcatgctgatcaacaccccctacgtgaccaaggacctgctgcaggccaagagattccaggcccagaccctgggcaccacctacatctacgacttccccgagatgttcagacaggccctgttcaagctgtggggcagccccgacaagtaccccaaggacatcctgacctacaccgagctggtgctggacagccagggccagctggtggagatgaacagactgcccggcggcaacgaggtgggcatggtggccttcaagatgagattcaagacccaggagtaccccgagggcagagacgtgatcgtgatcggcaacgacatcaccttcagaatcggcagcttcggccccggcgaggacctgctgtacctgagagccagcgagatggccagagccgagggcatccccaagatctacgtggccgccaacagcggcgccagaatcggcatggccgaggagatcaagcacatgttccacgtggcctgggtggaccccgaggacccccacaagggcttcaagtacctgtacctgaccccccaggactacaccagaatcagcagcctgaacagcgtgcactgcaagcacatcgaggagggcggcgagagcagatacatgatcaccgacatcatcggcaaggacgacggcctgggcgtggagaacctgagaggcagcggcatgatcgccggcgagagcagcctggcctacgaggagatcgtgaccatcagcctggtgacctgcagagccatcggcatcggcgcctacctggtgagactgggccagagagtgatccaggtggagaacagccacatcatcctgaccggcgccagcgccctgaacaaggtgctgggcagagaggtgtacaccagcaacaaccagctgggcggcgtgcagatcatgcactacaacggcgtgagccacatcaccgtgcccgacgacttcgagggcgtgtacaccatcctggagtggctgagctacatgcccaaggacaaccacagccccgtgcccatcatcacccccaccgaccccatcgacagagagatcgagttcctgcccagcagagccccctacgaccccagatggatgctggccggcagaccccaccccaccctgaagggcacctggcagagcggcttcttcgaccacggcagcttcaaggagatcatggccccctgggcccagaccgtggtgaccggcagagccagactgggcggcatccccgtgggcgtgatcgccgtggagaccagaaccgtggaggtggccgtgcccgccgaccccgccaacctggacagcgaggccaagatcatccagcaggccggccaggtgtggttccccgacagcgcctacaagaccgcccaggccgtgaaggacttcaacagagagaagctgcccctgatgatcttcgccaactggagaggcttcagcggcggcatgaaggacatgtacgaccaggtgctgaagttcggcgcctacatcgtggacggcctgagacagtacaagcagcccatcctgatctacatccccccctacgccgagctgagaggcggcagctgggtggtgatcgacgccaccatcaaccccctgtgcatcgagatgtacgccgacaaggagagcagaggcggcgtgctggagcccgagggcaccgtggagatcaagttcagaaagaaggacctgatcaagagcatgagaagaatcgaccccgcctacaagaagctgatggagcagctgggcgagcccgacctgagcgacaaggacagaaaggacctggagggcagactgaaggccagagaggacctgctgctgcccatctaccaccaggtggccgtgcagttcgccgacttccacgacacccccggcagaatgctggagaagggcgtgatcagcgacatcctggagtggaagaccgccagaaccttcctgtactggagactgagaagactgctgctggaggaccaggtgaagcaggagatcctgcaggccagcggcgagctgagccacgtgcacatccagagcatgctgagaagatggttcgtggagaccgagggcgccgtgaaggcctacctgtgggacaacaaccaggtggtggtgcagtggctggagcagcactggcaggccggcgacggccccagaagcaccatcagagagaacatcacctacctgaagcacgacagcgtgctgaagaccatcagaggcctggtggaggagaaccccgaggtggccgtggactgcgtgatctacctgagccagcacatcagccccgccgagagagcccaggtggtgcacctgctgagcaccatggacagccccgccagcacctag

SEQ ID NO: 71409 - DNA, 5070 bp, Artificial Sequence
  Description of Artificial Sequence: Synthetic coding sequence
ctgcccttcctgctgaagcccccccagaccctgcccagccccgacgccatgttcagaacctgcatgaccgacttcctgcacagcctggagagaggccaggtgctgcccgccgacagcctgctgaacctggtggacgtggagctgatctacggcggcgtgaagtacatcctgaaggtggccagacagagcctgaccatgttcgtgctgatcatgaacggctgccacatcgagatcgacgcccacagactgaacgacggcggcctgctgctgagctacaacggcaacagctacaccacctacatgaaggaggaggtggacagctacagaatcaccatcggcaacaagacctgcgtgttcgagaaggagaacgaccccaccgtgctgagaagccccagcgccggcaagctgacccagtacaccgtggaggacggcggccacgtggaggccggcagcagctacgccgagatggaggtgatgaagatgatcatgaccctgaacgtgcaggagagaggcagagtgaagtacatcaagagacccggcgccgtgctggaggccggctgcgtggtggccagactggagctggacgaccccagcaaggtgcaccccgccgagcccttcaccggcgagctgcccgcccagcagaccctgcccatcctgggcgagaagctgcaccaggtgttccacagcgtgctggagaacctgaccaacgtgatgagcggcttctgcctgcccgagcccgtgttcagcatcaagctgaaggagtgggtgcagaagctgatgatgaccctgagacaccccagcctgcccctgctggagctgcaggagatcatgaccagcgtggccggcagaatccccgcccccgtggagaagagcgtgagaagagtgatggcccagtacgccagcaacatcaccagcgtgctgtgccagttccccagccagcagatcgccaccatcctggactgccacgccgccaccctgcagagaaaggccgacagagaggtgttcttcatcaacacccagagcatcgtgcagctggtgcagagatacagaagcggcatcagaggctacatgaagaccgtggtgctggacctgctgagaagatacctgagagtggagcaccacttccagcaggcccactacgacaagtgcgtgatcaacctgagagagcagttcaagcccgacatgagccaggtgctggactgcatcttcagccacgcccaggtggccaagaagaaccagctggtgatcatgctgatcgacgagctgtgcggccccgaccccagcctgagcgacgagctgatcagcatcctgaacgagctgacccagctgagcaagagcgagcactgcaaggtggccctgagagccagacagatcctgatcgccagccacctgcccagctacgagctgagacacaaccaggtggagagcatcttcctgagcgccatcgacatgtacggccaccagttctgccccgagaacctgaagaagctgatcctgagcgagaccaccatcttcgacgtgctgcccaccttcttctaccacgccaacaaggtggtgtgcatggccagcctggaggtgtacgtgagaagaggctacatcgcctacgagctgaacagcctgcagcacagacagctgcccgacggcacctgcgtggtggagttccagttcatgctgcccagcagccaccccaacagaatgaccgtgcccatcagcatcaccaaccccgacctgctgagacacagcaccgagctgttcatggacagcggcttcagccccctgtgccagagaatgggcgccatggtggccttcagaagattcgaggacttcaccagaaacttcgacgaggtgatcagctgcttcgccaacgtgcccaaggacacccccctgttcagcgaggccagaaccagcctgtacagcgaggacgactgcaagagcctgagagaggagcccatccacatcctgaacgtgagcatccagtgcgccgaccacctggaggacgaggccctggtgcccatcctgagaaccttcgtgcagagcaagaagaacatcctggtggactacggcctgagaagaatcaccttcctgatcgcccaggagaaggagttccccaagttcttcaccttcagagccagagacgagttcgccgaggacagaatctacagacacctggagcccgccctggccttccagctggagctgaacagaatgagaaacttcgacctgaccgccgtgccctgcgccaaccacaagatgcacctgtacctgggcgccgccaaggtgaaggagggcgtggaggtgaccgaccacagattcttcatcagagccatcatcagacacagcgacctgatcaccaaggaggccagcttcgagtacctgcagaacgagggcgagagactgctgctggaggccatggacgagctggaggtggccttcaacaacaccagcgtgagaaccgactgcaaccacatcttcctgaacttcgtgcccaccgtgatcatggaccccttcaagatcgaggagagcgtgagatacatggtgatgagatacggcagcagactgtggaagctgagagtgctgcaggccgaggtgaagatcaacatcagacagaccaccaccggcagcgccgtgcccatcagactgttcatcaccaacgagagcggctactacctggacatcagcctgtacaaggaggtgaccgacagcagaagcggcaacatcatgttccacagcttcggcaacaagcagggcccccagcacggcatgctgatcaacaccccctacgtgaccaaggacctgctgcaggccaagagattccaggcccagaccctgggcaccacctacatctacgacttccccgagatgttcagacaggccctgttcaagctgtggggcagccccgacaagtaccccaaggacatcctgacctacaccgagctggtgctggacagccagggccagctggtggagatgaacagactgcccggcggcaacgaggtgggcatggtggccttcaagatgagattcaagacccaggagtaccccgagggcagagacgtgatcgtgatcggcaacgacatcaccttcagaatcggcagcttcggccccggcgaggacctgctgtacctgagagccagcgagatggccagagccgagggcatccccaagatctacgtggccgccaacagcggcgccagaatcggcatggccgaggagatcaagcacatgttccacgtggcctgggtggaccccgaggacccccacaagggcttcaagtacctgtacctgaccccccaggactacaccagaatcagcagcctgaacagcgtgcactgcaagcacatcgaggagggcggcgagagcagatacatgatcaccgacatcatcggcaaggacgacggcctgggcgtggagaacctgagaggcagcggcatgatcgccggcgagagcagcctggcctacgaggagatcgtgaccatcagcctggtgacctgcagagccatcggcatcggcgcctacctggtgagactgggccagagagtgatccaggtggagaacagccacatcatcctgaccggcgccagcgccctgaacaaggtgctgggcagagaggtgtacaccagcaacaaccagctgggcggcgtgcagatcatgcactacaacggcgtgagccacatcaccgtgcccgacgacttcgagggcgtgtacaccatcctggagtggctgagctacatgcccaaggacaaccacagccccgtgcccatcatcacccccaccgaccccatcgacagagagatcgagttcctgcccagcagagccccctacgaccccagatggatgctggccggcagaccccaccccaccctgaagggcacctggcagagcggcttcttcgaccacggcagcttcaaggagatcatggccccctgggcccagaccgtggtgaccggcagagccagactgggcggcatccccgtgggcgtgatcgccgtggagaccagaaccgtggaggtggccgtgcccgccgaccccgccaacctggacagcgaggccaagatcatccagcaggccggccaggtgtggttccccgacagcgcctacaagaccgcccaggccgtgaaggacttcaacagagagaagctgcccctgatgatcttcgccaactggagaggcttcagcggcggcatgaaggacatgtacgaccaggtgctgaagttcggcgcctacatcgtggacggcctgagacagtacaagcagcccatcctgatctacatccccccctacgccgagctgagaggcggcagctgggtggtgatcgacgccaccatcaaccccctgtgcatcgagatgtacgccgacaaggagagcagaggcggcgtgctggagcccgagggcaccgtggagatcaagttcagaaagaaggacctgatcaagagcatgagaagaatcgaccccgcctacaagaagctgatggagcagctgggcgagcccgacctgagcgacaaggacagaaaggacctggagggcagactgaaggccagagaggacctgctgctgcccatctaccaccaggtggccgtgcagttcgccgacttccacgacacccccggcagaatgctggagaagggcgtgatcagcgacatcctggagtggaagaccgccagaaccttcctgtactggagactgagaagactgctgctggaggaccaggtgaagcaggagatcctgcaggccagcggcgagctgagccacgtgcacatccagagcatgctgagaagatggttcgtggagaccgagggcgccgtgaaggcctacctgtgggacaacaaccaggtggtggtgcagtggctggagcagcactggcaggccggcgacggccccagaagcaccatcagagagaacatcacctacctgaagcacgacagcgtgctgaagaccatcagaggcctggtggaggagaaccccgaggtggccgtggactgcgtgatctacctgagccagcacatcagccccgccgagagagcccaggtggtgcacctgctgagcaccatggacagccccgccagcacctag

SEQ ID NO: 71410 - DNA, 432 bp, Artificial Sequence
  Description of Artificial Sequence: Synthetic coding sequence
atgaccgacagcaagcccatcaccaagagcaagagcgaggccaacctgatccccagccaggagcccttccccgccagcgacaacagcggcgagaccccccagagaaacggcgagggccacaccctgcccaagacccccagccaggccgagcccgccagccacaagggccccaaggacgccggcagaagaagaaacagcctgccccccagccaccagaagccccccagaaaccccctgagcagcagcgacgccgcccccagccccgagctgcaggccaacggcaccggcacccagggcctggaggccaccgacaccaacggcctgagcagcagcgccagaccccagggccagcaggccggcagccccagcaaggaggacaagaagcaggccaacatcaagagacagctgatgaccaacttcatcctgggctag

SEQ ID NO: 71411 - DNA, 2577 bp, Artificial Sequence
  Description of Artificial Sequence: Synthetic coding sequence
atgaccgtgcccatcagcatcaccaaccccgacctgctgagacacagcaccgagctgttcatggacagcggcttcagccccctgtgccagagaatgggcgccatggtggccttcagaagattcgaggacttcaccagaaacttcgacgaggtgatcagctgcttcgccaacgtgcccaaggacacccccctgttcagcgaggccagaaccagcctgtacagcgaggacgactgcaagagcctgagagaggagcccatccacatcctgaacgtgagcatccagtgcgccgaccacctggaggacgaggccctggtgcccatcctgagaaccttcgtgcagagcaagaagaacatcctggtggactacggcctgagaagaatcaccttcctgatcgcccaggagaaggagttccccaagttcttcaccttcagagccagagacgagttcgccgaggacagaatctacagacacctggagcccgccctggccttccagctggagctgaacagaatgagaaacttcgacctgaccgccgtgccctgcgccaaccacaagatgcacctgtacctgggcgccgccaaggtgaaggagggcgtggaggtgaccgaccacagattcttcatcagagccatcatcagacacagcgacctgatcaccaaggaggccagcttcgagtacctgcagaacgagggcgagagactgctgctggaggccatggacgagctggaggtggccttcaacaacaccagcgtgagaaccgactgcaaccacatcttcctgaacttcgtgcccaccgtgatcatggaccccttcaagatcgaggagagcgtgagatacatggtgatgagatacggcagcagactgtggaagctgagagtgctgcaggccgaggtgaagatcaacatcagacagaccaccaccggcagcgccgtgcccatcagactgttcatcaccaacgagagcggctactacctggacatcagcctgtacaaggaggtgaccgacagcagaagcggcaacatcatgttccacagcttcggcaacaagcagggcccccagcacggcatgctgatcaacaccccctacgtgaccaaggacctgctgcaggccaagagattccaggcccagaccctgggcaccacctacatctacgacttccccgagatgttcagacaggccctgttcaagctgtggggcagccccgacaagtaccccaaggacatcctgacctacaccgagctggtgctggacagccagggccagctggtggagatgaacagactgcccggcggcaacgaggtgggcatggtggccttcaagatgagattcaagacccaggagtaccccgagggcagagacgtgatcgtgatcggcaacgacatcaccttcagaatcggcagcttcggccccggcgaggacctgctgtacctgagagccagcgagatggccagagccgagggcatccccaagatctacgtggccgccaacagcggcgccagaatcggcatggccgaggagatcaagcacatgttccacgtggcctgggtggaccccgaggacccccacaagggcttcaagtacctgtacctgaccccccaggactacaccagaatcagcagcctgaacagcgtgcactgcaagcacatcgaggagggcggcgagagcagatacatgatcaccgacatcatcggcaaggacgacggcctgggcgtggagaacctgagaggcagcggcatgatcgccggcgagagcagcctggcctacgaggagatcgtgaccatcagcctggtgacctgcagagccatcggcatcggcgcctacctggtgagactgggccagagagtgatccaggtggagaacagccacatcatcctgaccggcgccagcgccctgaacaaggtgctgggcagagaggtgtacaccagcaacaaccagctgggcggcgtgcagatcatgcactacaacggcgtgagccacatcaccgtgcccgacgacttcgagggcgtgtacaccatcctggagtggctgagctacatgcccaaggacaaccacagccccgtgcccatcatcacccccaccgaccccatcgacagagagatcgagttcctgcccagcagagccccctacgaccccagatggatgctggccggcagaccccaccccaccctgaagggcacctggcagagcggcttcttcgaccacggcagcttcaaggagatcatggccccctgggcccagaccgtggtgaccggcagagccagactgggcggcatccccgtgggcgtgatcgccgtggagaccagaaccgtggaggtggccgtgcccgccgaccccgccaacctggacagcgaggccaagatcatccagcaggccggccaggtgtggttccccgacagcgcctacaagaccgcccaggccgtgaaggacttcaacagagagaagctgcccctgatgatcttcgccaactggagaggcttcagcggcggcatgaagggctgcctgggcacctggagagacgtgagctggtggaagatcagagccatgctgcccatgcacatcggcgagggcagcgtgtag

SEQ ID NO: 71412 - DNA, 1038 bp, Artificial Sequence
  Description of Artificial Sequence: Synthetic coding sequence
atgggcagcagcgaggaccaggcctacagactgctgaacgactacgccaacggcttcatggtgagccaggtgctgttcgccgcctgcgagctgggcgtgttcgacctgctggccgaggcccccggccccctggacgtggccgccgtggccgccggcgtgagagccagcgcccacggcaccgagctgctgctggacatctgcgtgagcctgaagctgctgaaggtggagaccagaggcggcaaggccttctacagaaacaccgagctgagcagcgactacctgaccaccgtgagccccaccagccagtgcagcatgctgaagtacatgggcagaaccagctacagatgctggggccacctggccgacgccgtgagagagggcagaaaccagtacctggagaccttcggcgtgcccgccgaggagctgttcaccgccatctacagaagcgagggcgagagactgcagttcatgcaggccctgcaggaggtgtggagcgtgaacggcagaagcgtgctgaccgccttcgacctgagcgtgttccccctgatgtgcgacctgggcggcggcgccggcgccctggccaaggagtgcatgagcctgtaccccggctgcaagatcaccgtgttcgacatccccgaggtggtgtggaccgccaagcagcacttcagcttccaggaggaggagcagatcgacttccaggagggcgacttcttcaaggaccccctgcccgaggccgacctgtacatcctggccagagtgctgcacgactgggccgacggcaagtgcagccacctgctggagagaatctaccacacctgcaagcccggcggcggcatcctggtgatcgagagcctgctggacgaggacagaagaggccccctgctgacccagctgtacagcctgaacatgctggtgcagaccgagggccaggagagaacccccacccactaccacatgctgctgagcagcgccggcttcagagacttccagttcaagaagaccggcgccatctacgacgccatcctggccagaaagtag

SEQ ID NO: 71413 - DNA, 897 bp, Artificial Sequence
  Description of Artificial Sequence: Synthetic coding sequence
atgggcagcagcgaggaccaggcctacagactgctgaacgactacgccaacggcttcatggtgagccaggtgctgttcgccgcctgcgagctgggcgtgttcgacctgctggccgaggcccccggccccctggacgtggccgccgtggccgccggcgtgagagccagcgcccacggcaccgagctgctgctggacatctgcgtgagcctgaagctgctgaaggtggagaccagaggcggcaaggccttctacagaaacaccgagctgagcagcgactacctgaccaccgtgagccccaccagccagtgcagcatgctgaagtacatgggcagaaccagctacagatgctggggccacctggccgacgccgtgagagagggcagaaaccagtacctggagaccttcggcgtgcccgccgaggagctgttcaccgccatctacagaagcgagggcgagagactgcagttcatgcaggccctgcaggaggtgtggagcgtgaacggcagaagcgtgctgaccgccttcgacctgagcgtgttccccctgatgtgcgacctgggcggcgacttcttcaaggaccccctgcccgaggccgacctgtacatcctggccagagtgctgcacgactgggccgacggcaagtgcagccacctgctggagagaatctaccacacctgcaagcccggcggcggcatcctggtgatcgagagcctgctggacgaggacagaagaggccccctgctgacccagctgtacagcctgaacatgctggtgcagaccgagggccaggagagaacccccacccactaccacatgctgctgagcagcgccggcttcagagacttccagttcaagaagaccggcgccatctacgacgccatcctggccagaaagtag

SEQ ID NO: 71414 - DNA, 1122 bp, Artificial Sequence
  Description of Artificial Sequence: Synthetic coding sequence
atgggcagcagcgaggaccaggcctacagactgctgaacgactacgccaacggcttcatggtgagccaggtgctgttcgccgcctgcgagctgggcgtgttcgacctgctggccgaggcccccggccccctggacgtggccgccgtggccgccggcgtgagagccagcgcccacggcaccgagctgctgctggacatctgcgtgagcctgaagctgctgaaggtggagaccagaggcggcaaggccttctacagaaacaccgagctgagcagcgactacctgaccaccgtgagccccaccagccagtgcagcatgctgaagtacatgggcagaaccagctacagatgctggggccacctggccgacgccgtgagagagggcagaaaccagtacctggagaccttcggcgtgcccgccgaggagctgttcaccgccatctacagaagcgagggcgagagactgcagttcatgcaggccctgcaggaggtgtggagcgtgaacggcagaagcgtgctgaccgccttcgacctgagcgtgttccccctgatgtgcgacctgggcggcacctggatcaagctggagaccatcatcctgagcaagctgagccagggccagaagaccaagcacagagtgttcagcctgatcggcggcgccggcgccctggccaaggagtgcatgagcctgtaccccggctgcaagatcaccgtgttcgacatccccgaggtggtgtggaccgccaagcagcacttcagcttccaggaggaggagcagatcgacttccaggagggcgacttcttcaaggaccccctgcccgaggccgacctgtacatcctggccagagtgctgcacgactgggccgacggcaagtgcagccacctgctggagagaatctaccacacctgcaagcccggcggcggcatcctggtgatcgagagcctgctggacgaggacagaagaggccccctgctgacccagctgtacagcctgaacatgctggtgcagaccgagggccaggagagaacccccacccactaccacatgctgctgagcagcgccggcttcagagacttccagttcaagaagaccggcgccatctacgacgccatcctggccagaaagtag

SEQ ID NO: 71415 - DNA, 375 bp, Artificial Sequence
  Description of Artificial Sequence: Synthetic coding sequence
gactgcagactgaccagcgtgtgcctgccctgcgtgcccggcgacttcttcaaggaccccctgcccgaggccgacctgtacatcctggccagagtgctgcacgactgggccgacggcaagtgcagccacctgctggagagaatctaccacacctgcaagcccggcggcggcatcctggtgatcgagagcctgctggacgaggacagaagaggccccctgctgacccagctgtacagcctgaacatgctggtgcagaccgagggccaggagagaacccccacccactaccacatgctgctgagcagcgccggcttcagagacttccagttcaagaagaccggcgccatctacgacgccatcctggccagaaagtag

SEQ ID NO: 71416 - DNA, 711 bp, Artificial Sequence
  Description of Artificial Sequence: Synthetic coding sequence
atggagagcagcgccaagatggagagcggcggcgccggccagcagccccagccccagccccagcagcccttcctgccccccgccgcctgcttcttcgccaccgccgccgccgccgccgccgccgccgccgccgccgccgcccagagcgcccagcagcagcagcagcagcagcagcagcagcagcaggccccccagctgagacccgccgccgacggccagcccagcggcggcggccacaagagcgcccccaagcaggtgaagagacagagaagcagcagccccgagctgatgagatgcaagagaagactgaacttcagcggcttcggctacagcctgccccagcagcagcccgccgccgtggccagaagaaacgagagagagagaaacagagtgaagctggtgaacctgggcttcgccaccctgagagagcacgtgcccaacggcgccgccaacaagaagatgagcaaggtggagaccctgagaagcgccgtggagtacatcagagccctgcagcagctgctggacgagcacgacgccgtgagcgccgccttccaggccggcgtgctgagccccaccatcagccccaactacagcaacgacctgaacagcatggccggcagccccgtgagcagctacagcagcgacgagggcagctacgaccccctgagccccgaggagcaggagctgctggacttcaccaactggttctag

SEQ ID NO: 71417 - DNA, 582 bp, Artificial Sequence
  Description of Artificial Sequence: Synthetic coding sequence
atggacggcggcaccctgcccagaagcgccccccccgccccccccgtgcccgtgggctgcgccgccagaagaagacccgccagccccgagctgctgagatgcagcagaagaagaagacccgccaccgccgagaccggcggcggcgccgccgccgtggccagaagaaacgagagagagagaaacagagtgaagctggtgaacctgggcttccaggccctgagacagcacgtgccccacggcggcgccagcaagaagctgagcaaggtggagaccctgagaagcgccgtggagtacatcagagccctgcagagactgctggccgagcacgacgccgtgagaaacgccctggccggcggcctgagaccccaggccgtgagacccagcgcccccagaggcccccccggcaccacccccgtggccgccagccccagcagagccagcagcagccccggcagaggcggcagcagcgagcccggcagccccagaagcgcctacagcagcgacgacagcggctgcgagggcgccctgagccccgccgagagagagctgctggacttcagcagctggctgggcggctactag

SEQ ID NO: 71418 - DNA, 1542 bp, Artificial Sequence
  Description of Artificial Sequence: Synthetic coding sequence
atgtgcagcctgggcctgttccccccccccccccccagaggccaggtgaccctgtacgagcacaacaacgagctggtgaccggcagcagctacgagagccccccccccgacttcagaggccagtggatcaacctgcccgtgctgcagctgaccaaggaccccctgaagacccccggcagactggaccacggcaccagaaccgccttcatccaccacagagagcaggtgtggaagagatgcatcaacatctggagagacgtgggcctgttcggcgtgctgaacgagatcgccaacagcgaggaggaggtgttcgagtgggtgaagaccgccagcggctgggccctggccctgtgcagatgggccagcagcctgcacggcagcctgttcccccacctgagcctgagaagcgaggacctgatcgccgagttcgcccaggtgaccaactgcaccatcgtgcccagcctgaagcacagactgcagagaaacgtggccagcctggcctggaagcccctgagcgccagcgtgctggccgtggcctgccagagctgcatcctgatctggaccctggaccccaccagcctgagcaccagacccagcagcggctgcgcccaggtgctgagccaccccggccacacccccgtgaccagcctggcctgggcccccagcggcggcagactgctgagcgccagccccgtggacgccgccatcagagtgtgggacgtgagcaccgagacctgcgtgcccctgccctggttcagaggcggcggcgtgaccaacctgctgtggagccccgacggcagcaagatcctggccaccacccccagcgccgtgttcagagtgtgggaggcccagatgtggacctgcgagagatggcccaccctgagcggcagatgccagaccggctgctggagccccgacggcagcagactgctgttcaccgtgctgggcgagcccctgatctacagcctgagcttccccgagagatgcggcgagggcaagggctgcgtgggcggcgccaagagcgccaccatcgtggccgacctgagcgagaccaccatccagacccccgacggcgaggagagactgggcggcgaggcccacagcatggtgtgggaccccagcggcgagagactggccgtgctgatgaagggcaagcccagagtgcaggacggcaagcccgtgatcctgctgttcagaaccagaaacagccccgtgttcgagctgctgccctgcggcatcatccagggcgagcccggcgcccagccccagctgatcaccttccaccccagcttcaacaagggcgccctgctgagcgtgggctggagcaccggcagaatcgcccacatccccctgtacttcgtgaacgcccagttccccagattcagccccgtgctgggcagagcccaggagccccccgccggcggcggcggcagcatccacgacctgcccctgttcaccgagaccagccccaccagcgccccctgggaccccctgcccggccccccccccgtgctgccccacagcccccacagccacctgtag

SEQ ID NO: 71419 - DNA, 1683 bp, Artificial Sequence
  Description of Artificial Sequence: Synthetic coding sequence
atgccccagaccagaagccaggcccaggccaccatcagcttccccaagagaaagctgagcagagccctgaacaaggccaagaacagcagcgacgccaagctggagcccaccaacgtgcagaccgtgacctgcagccccagagtgaaggccctgcccctgagccccagaaagagactgggcgacgacaacctgtgcaacaccccccacctgcccccctgcagcccccccaagcagggcaagaaggagaacggccccccccacagccacaccctgaagggcagaagactggtgttcgacaaccagctgaccatcaagagccccagcaagagagagctggccaaggtgcaccagaacaagatcctgagcagcgtgagaaagagccaggagatcaccaccaacagcgagcagagatgccccctgaagaaggagagcgcctgcgtgagactgttcaagcaggagggcacctgctaccagcaggccaagctggtgctgaacaccgccgtgcccgacagactgcccgccagagagagagagatggacgtgatcagaaacttcctgagagagcacatctgcggcaagaaggccggcagcctgtacctgagcggcgcccccggcaccggcaagaccgcctgcctgagcagaatcctgcaggacctgaagaaggagctgaagggcttcaagaccatcatgctgaactgcatgagcctgagaaccgcccaggccgtgttccccgccatcgcccaggagatctgccaggaggaggtgagcagacccgccggcaaggacatgatgagaaagctggagaagcacatgaccgccgagaagggccccatgatcgtgctggtgctggacgagatggaccagctggacagcaagggccaggacgtgctgtacaccctgttcgagtggccctggctgagcaacagccacctggtgctgatcggcatcgccaacaccctggacctgaccgacagaatcctgcccagactgcaggccagagagaagtgcaagccccagctgctgaacttccccccctacaccagaaaccagatcgtgaccatcctgcaggacagactgaaccaggtgagcagagaccaggtgctggacaacgccgccgtgcagttctgcgccagaaaggtgagcgccgtgagcggcgacgtgagaaaggccctggacgtgtgcagaagagccatcgagatcgtggagagcgacgtgaagagccagaccatcctgaagcccctgagcgagtgcaagagccccagcgagcccctgatccccaagagagtgggcctgatccacatcagccaggtgatcagcgaggtggacggcaacagaatgaccctgagccaggagggcgcccaggacagcttccccctgcagcagaagatcctggtgtgcagcctgatgctgctgatcagacagctgaagatcaaggaggtgaccctgggcaagctgtacgaggcctacagcaaggtgtgcagaaagcagcaggtggccgccgtggaccagagcgagtgcctgagcctgagcggcctgctggaggccagaggcatcctgggcctgaagagaaacaaggagaccagactgaccaaggtgttcttcaagatcgaggagaaggagatcgagcacgccctgaaggacaaggccctgatcggcaacatcctggccaccggcctgccctag

SEQ ID NO: 71420 - DNA, 339 bp, Artificial Sequence
  Description of Artificial Sequence: Synthetic coding sequence
atggccgagcaggccaccaagagcgtgctgttcgtgtgcctgggcaacatctgcagaagccccatcgccgaggccgtgttcagaaagctggtgaccgaccagaacatcagcgagaactggagagtggacagcgccgccaccagcggctacgagatcggcaacccccccgactacagaggccagagctgcatgaagagacacggcatccccatgagccacgtggccagacaggtgcccagcctggacctgaagctgtgcgtgctgtgcttcagcggcagcctgaccgccgtgctgttcctgaccggcacctgggccggcccccagacccaggagctgtag

SEQ ID NO: 71421 - DNA, 477 bp, Artificial Sequence
  Description of Artificial Sequence: Synthetic coding sequence
atggccgagcaggccaccaagagcgtgctgttcgtgtgcctgggcaacatctgcagaagccccatcgccgaggccgtgttcagaaagctggtgaccgaccagaacatcagcgagaactggagagtggacagcgccgccaccagcggctacgagatcggcaacccccccgactacagaggccagagctgcatgaagagacacggcatccccatgagccacgtggccagacagatcaccaaggaggacttcgccaccttcgactacatcctgtgcatggacgagagcaacctgagagacctgaacagaaagagcaaccaggtgaagacctgcaaggccaagatcgagctgctgggcagctacgacccccagaagcagctgatcatcgaggacccctactacggcaacgacagcgacttcgagaccgtgtaccagcagtgcgtgagatgctgcagagccttcctggagaaggcccactag

SEQ ID NO: 71422 - DNA, 477 bp, Artificial Sequence
  Description of Artificial Sequence: Synthetic coding sequence
atggccgagcaggccaccaagagcgtgctgttcgtgtgcctgggcaacatctgcagaagccccatcgccgaggccgtgttcagaaagctggtgaccgaccagaacatcagcgagaactgggtgatcgacagcggcgccgtgagcgactggaacgtgggcagaagccccgaccccagagccgtgagctgcctgagaaaccacggcatccacaccgcccacaaggccagacagatcaccaaggaggacttcgccaccttcgactacatcctgtgcatggacgagagcaacctgagagacctgaacagaaagagcaaccaggtgaagacctgcaaggccaagatcgagctgctgggcagctacgacccccagaagcagctgatcatcgaggacccctactacggcaacgacagcgacttcgagaccgtgtaccagcagtgcgtgagatgctgcagagccttcctggagaaggcccactag

SEQ ID NO: 71423 - DNA, 219 bp, Artificial Sequence
  Description of Artificial Sequence: Synthetic coding sequence
atggccgagcaggccaccaagagcgtgctgttcgtgtgcctgggcaacatctgcagaagccccatcgccgaggccgtgttcagaaagctggtgaccgaccagaacatcagcgagaactggagagtggacagcgccgccaccagcggcggcagcctgaccgccgtgctgttcctgaccggcacctgggccggcccccagaccaagagctgcgccgcctag

SEQ ID NO: 71424 - DNA, 483 bp, Artificial Sequence
  Description of Artificial Sequence: Synthetic coding sequence
atggccggcaagagaagcggctggagcagagccgccctgctgcagctgctgctgggcgtgaacctggtggtgatgccccccaccagagccagaagcctgagattcgtgaccctgctgtacagacacggcgacagaagccccgtgaagacctaccccaaggacccctaccaggaggaggagtggccccagggcttcggccagctgaccaaggagggcatgctgcagcactgggagctgggccaggccctgagacagagataccacggcttcctgaacaccagctaccacagacaggaggtgtacgtgagaagcaccgacttcgacagaaccctgatgagcgccgaggccaacctggccggcctgttcccccccaacggcatgcagagattcaaccccaacatcagctggcagcccatccccgtgcacaccgtgcccatcaccgaggacagagtgagagtggccagccccagcctgggctggtag

SEQ ID NO: 71425 - DNA, 1272 bp, Artificial Sequence
  Description of Artificial Sequence: Synthetic coding sequence
atggccggcaagagaagcggctggagcagagccgccctgctgcagctgctgctgggcgtgaacctggtggtgatgccccccaccagagccagaagcctgagattcgtgaccctgctgtacagacacggcgacagaagccccgtgaagacctaccccaaggacccctaccaggaggaggagtggccccagggcttcggccagctgaccaaggagggcatgctgcagcactgggagctgggccaggccctgagacagagataccacggcttcctgaacaccagctaccacagacaggaggtgtacgtgagaagcaccgacttcgacagaaccctgatgagcgccgaggccaacctggccggcctgttcccccccaacggcatgcagagattcaaccccaacatcagctggcagcccatccccgtgcacaccgtgcccatcaccgaggacagactgctgaagttccccctgggcccctgccccagatacgagcagctgcagaacgagaccagacagacccccgagtaccagaacgagagcagcagaaacgcccagttcctggacatggtggccaacgagaccggcctgaccgacctgaccctggagaccgtgtggaacgtgtacgacaccctgttctgcgagcagacccacggcctgagactgcccccctgggccagcccccagaccatgcagagactgagcagactgaaggacttcagcttcagattcctgttcggcatctaccagcaggccgagaaggccagactgcagggcggcgtgctgctggcccagatcagaaagaacctgaccctgatggccaccaccagccagctgcccaagctgctggtgtacagcgcccacgacaccaccctggtggccctgcagatggccctggacgtgtacaacggcgagcaggccccctacgccagctgccacatcttcgagctgtaccaggaggacagcggcaacttcagcgtggagatgtacttcagaaacgagagcgacaaggccccctggcccctgagcctgcccggctgcccccacagatgccccctgcaggacttcctgagactgaccgagcccgtggtgcccaaggactggcagcaggagtgccagctggccagcggccccgccgacaccgaggtgatcgtggccctggccgtgtgcggcagcatcctgttcctgctgatcgtgctgctgctgaccgtgctgttcagaatgcaggcccagccccccggctacagacacgtggccgacggcgaggaccacgcctag

SEQ ID NO: 71426 - DNA, 1176 bp, Artificial Sequence
  Description of Artificial Sequence: Synthetic coding sequence
atggccggcaagagaagcggctggagcagagccgccctgctgcagctgctgctgggcgtgaacctggtggtgatgccccccaccagagccagaagcctgagattcgtgaccctggagggcatgctgcagcactgggagctgggccaggccctgagacagagataccacggcttcctgaacaccagctaccacagacaggaggtgtacgtgagaagcaccgacttcgacagaaccctgatgagcgccgaggccaacctggccggcctgttcccccccaacggcatgcagagattcaaccccaacatcagctggcagcccatccccgtgcacaccgtgcccatcaccgaggacagactgctgaagttccccctgggcccctgccccagatacgagcagctgcagaacgagaccagacagacccccgagtaccagaacgagagcagcagaaacgcccagttcctggacatggtggccaacgagaccggcctgaccgacctgaccctggagaccgtgtggaacgtgtacgacaccctgttctgcgagcagacccacggcctgagactgcccccctgggccagcccccagaccatgcagagactgagcagactgaaggacttcagcttcagattcctgttcggcatctaccagcaggccgagaaggccagactgcagggcggcgtgctgctggcccagatcagaaagaacctgaccctgatggccaccaccagccagctgcccaagctgctggtgtacagcgcccacgacaccaccctggtggccctgcagatggccctggacgtgtacaacggcgagcaggccccctacgccagctgccacatcttcgagctgtaccaggaggacagcggcaacttcagcgtggagatgtacttcagaaacgagagcgacaaggccccctggcccctgagcctgcccggctgcccccacagatgccccctgcaggacttcctgagactgaccgagcccgtggtgcccaaggactggcagcaggagtgccagctggccagcggccccgccgacaccgaggtgatcgtggccctggccgtgtgcggcagcatcctgttcctgctgatcgtgctgctgctgaccgtgctgttcagaatgcaggcccagccccccggctacagacacgtggccgacggcgaggaccacgcctag

SEQ ID NO: 71427 - DNA, 711 bp, Artificial Sequence
  Description of Artificial Sequence: Synthetic coding sequence
atggtggccaacgagaccggcctgaccgacctgaccctggagaccgtgtggaacgtgtacgacaccctgttctgcgagcagacccacggcctgagactgcccccctgggccagcccccagaccatgcagagactgagcagactgaaggacttcagcttcagattcctgttcggcatctaccagcaggccgagaaggccagactgcagggcggcgtgctgctggcccagatcagaaagaacctgaccctgatggccaccaccagccagctgcccaagctgctggtgtacagcgcccacgacaccaccctggtggccctgcagatggccctggacgtgtacaacggcgagcaggccccctacgccagctgccacatcttcgagctgtaccaggaggacagcggcaacttcagcgtggagatgtacttcagaaacgagagcgacaaggccccctggcccctgagcctgcccggctgcccccacagatgccccctgcaggacttcctgagactgaccgagcccgtggtgcccaaggactggcagcaggagtgccagctggccagcggccccgccgacaccgaggtgatcgtggccctggccgtgtgcggcagcatcctgttcctgctgatcgtgctgctgctgaccgtgctgttcagaatgcaggcccagccccccggctacagacacgtggccgacggcgaggaccacgcctag

SEQ ID NO: 71428 - DNA, 1242 bp, Artificial Sequence
  Description of Artificial Sequence: Synthetic coding sequence
atggccggcaagagaagcggctggagcagagccgccctgctgcagctgctgctgggcgtgaacctggtggtgatgccccccaccagagccagaagcctgagattcgtgaccctgctgtacagacacggcgacagaagccccgtgaagacctaccccaaggacccctaccaggaggaggagtggccccagggcttcggccagctgaccaaggagggcatgctgcagagataccacggcttcctgaacaccagctaccacagacaggaggtgtacgtgagaagcaccgacttcgacagaaccctgatgagcgccgaggccaacctggccggcctgttcccccccaacggcatgcagagattcaaccccaacatcagctggcagcccatccccgtgcacaccgtgcccatcaccgaggacagactgctgaagttccccctgggcccctgccccagatacgagcagctgcagaacgagaccagacagacccccgagtaccagaacgagagcagcagaaacgcccagttcctggacatggtggccaacgagaccggcctgaccgacctgaccctggagaccgtgtggaacgtgtacgacaccctgttctgcgagcagacccacggcctgagactgcccccctgggccagcccccagaccatgcagagactgagcagactgaaggacttcagcttcagattcctgttcggcatctaccagcaggccgagaaggccagactgcagggcggcgtgctgctggcccagatcagaaagaacctgaccctgatggccaccaccagccagctgcccaagctgctggtgtacagcgcccacgacaccaccctggtggccctgcagatggccctggacgtgtacaacggcgagcaggccccctacgccagctgccacatcttcgagctgtaccaggaggacagcggcaacttcagcgtggagatgtacttcagaaacgagagcgacaaggccccctggcccctgagcctgcccggctgcccccacagatgccccctgcaggacttcctgagactgaccgagcccgtggtgcccaaggactggcagcaggagtgccagctggccagcggccccgccgacaccgaggtgatcgtggccctggccgtgtgcggcagcatcctgttcctgctgatcgtgctgctgctgaccgtgctgttcagaatgcaggcccagccccccggctacagacacgtggccgacggcgaggaccacgcctag

SEQ ID NO: 71429 - DNA, 978 bp, Artificial Sequence
  Description of Artificial Sequence: Synthetic coding sequence
atggacatgtggaccgccctgctgatcctgcaggccctgctgctgcccagcctggccgacggcgccacccccgccctgagattcgtggccgtgggcgactggggcggcgtgcccaacgcccccttccacaccgccagagagatggccaacgccaaggagatcgccagaaccgtgcagatcctgggcgccgacttcatcctgagcctgggcgacaacttctacttcaccggcgtgcaggacatcaacgacaagagattccaggagaccttcgaggacgtgttcagcgacagaagcctgagaaaggtgccctggtacgtgctggccggcaaccacgaccacctgggcaacgtgagcgcccagatcgcctacagcaagatcagcaagagatggaacttccccagccccttctacagactgcacttcaagatcccccagaccaacgtgagcgtggccatcttcatgctggacaccgtgaccctgtgcggcaacagcgacgacttcctgagccagcagcccgagagacccagagacgtgaagctggccagaacccagctgagctggctgaagaagcagctggccgccgccagagaggactacgtgctggtggccggccactaccccgtgtggagcatcgccgagcacggccccacccactgcctggtgaagcagctgagacccctgctggccacctacggcgtgaccgcctacctgtgcggccacgaccacaacctgcagtacctgcaggacgagaacggcgtgggctacgtgctgagcggcgccggcaacttcatggaccccagcaagagacaccagagaaaggtgcccaacggctacctgagattccactacggcaccgaggacagcctgggcggcttcgcctacgtggagatcagcagcaaggagatgaccgtgacctacatcgaggccagcggcaagagcctgttcaagaccagactgcccagaagagccagaccctag

SEQ ID NO: 71430 - DNA, 1239 bp, Artificial Sequence
  Description of Artificial Sequence: Synthetic coding sequence
atgggcagcccctggaacggcagcgacggccccgagggcgccagagagcccccctggcccgccctgcccccctgcgacgagagaagatgcagccccttccccctgggcgccctggtgcccgtgaccgccgtgtgcctgtgcctgttcgtggtgggcgtgagcggcaacgtggtgaccgtgatgctgatcggcagatacagagacatgagaaccaccaccaacctgtacctgggcagcatggccgtgagcgacctgctgatcctgctgggcctgcccttcgacctgtacagactgtggagaagcagaccctgggtgttcggccccctgctgtgcagactgagcctgtacgtgggcgagggctgcacctacgccaccctgctgcacatgaccgccctgagcgtggagagatacctggccatctgcagacccctgagagccagagtgctggtgaccagaagaagagtgagagccctgatcgccgtgctgtgggccgtggccctgctgagcgccggccccttcctgttcctggtgggcgtggagcaggaccccggcatcagcgtggtgcccggcctgaacggcaccgccagaatcgccagcagccccctggccagcagcccccccctgtggctgagcagagcccccccccccagcccccccagcggccccgagaccgccgaggccgccgccctgttcagcagagagtgcagacccagccccgcccagctgggcgccctgagagtgatgctgtgggtgaccaccgcctacttcttcctgcccttcctgtgcctgagcatcctgtacggcctgatcggcagagagctgtggagcagcagaagacccctgagaggccccgccgccagcggcagagagagaggccacagacagaccgtgagagtgctgctggtggtggtgctggccttcatcatctgctggctgcccttccacgtgggcagaatcatctacatcaacaccgaggacagcagaatgatgtacttcagccagtacttcaacatcgtggccctgcagctgttctacctgagcgccagcatcaaccccatcctgtacaacctgatcagcaagaagtacagagccgccgccttcaagctgctgctggccagaaagagcagacccagaggcttccacagaagcagagacaccgccggcgaggtggccggcgacaccggcggcgacaccgtgggctacaccgagaccagcgccaacgtgaagaccatgggctag

SEQ ID NO: 71431 - DNA, 978 bp, Artificial Sequence; identical to SEQ ID NO: 71429
  Description of Artificial Sequence: Synthetic coding sequence

SEQ ID NO: 71432 - DNA, 978 bp, Artificial Sequence; identical to SEQ ID NO: 71429
  Description of Artificial Sequence: Synthetic coding sequence

SEQ ID NO: 71433 - DNA, 1161 bp, Artificial Sequence
  Description of Artificial Sequence: Synthetic coding sequence
atgagagccgcccccctgctgctggccagagccgccagcctgagcctgggcttcctgttcctgctgttcttctggctggacagaagcgtgctggccaaggagctgaagttcgtgaccctggtgttcagacacggcgacagaagccccatcgacaccttccccaccgaccccatcaaggagagcagctggccccagggcttcggccagctgacccagctgggcatggagcagcactacgagctgggcgagtacatcagaaagagatacagaaagttcctgaacgagagctacaagcacgagcaggtgtacatcagaagcaccgacgtggacagaaccctgatgagcgccatgaccaacctggccgccctgttcccccccgagggcgtgagcatctggaaccccatcctgctgtggcagcccatccccgtgcacaccgtgcccctgagcgaggaccagctgctgtacctgcccttcagaaactgccccagattccaggagctggagagcgagaccctgaagagcgaggagttccagaagagactgcacccctacaaggacttcatcgccaccctgggcaagctgagcggcctgcacggccaggacctgttcggcatctggagcaaggtgtacgaccccctgtactgcgagagcgtgcacaacttcaccctgcccagctgggccaccgaggacaccatgaccaagctgagagagctgagcgagctgagcctgctgagcctgtacggcatccacaagcagaaggagaagagcagactgcagggcggcgtgctggtgaacgagatcctgaaccacatgaagagagccacccagatccccagctacaagaagctgatcatgtacagcgcccacgacaccaccgtgagcggcctgcagatggccctggacgtgtacaacggcctgctgcccccctacgccagctgccacctgaccgagctgtacttcgagaagggcgagtacttcgtggagatgtactacagaaacgagacccagcacgagccctaccccctgatgctgcccggctgcagccccagctgccccctggagagattcgccgagctggtgggccccgtgatcccccaggactggagcaccgagtgcatgaccaccaacagccaccagggcaccgaggacagcaccgactag

SEQ ID NO: 71434 - DNA, 1257 bp, Artificial Sequence
  Description of Artificial Sequence: Synthetic coding sequence
atgagagccgcccccctgctgctggccagagccgccagcctgagcctgggcttcctgttcctgctgttcttctggctggacagaagcgtgctggccaaggagctgaagttcgtgaccctggtgttcagacacggcgacagaagccccatcgacaccttccccaccgaccccatcaaggagagcagctggccccagggcttcggccagctgacccagctgggcatggagcagcactacgagctgggcgagtacatcagaaagagatacagaaagttcctgaacgagagctacaagcacgagcaggtgtacatcagaagcaccgacgtggacagaaccctgatgagcgccatgaccaacctggccgccctgttcccccccgagggcgtgagcatctggaaccccatcctgctgtggcagcccatccccgtgcacaccgtgcccctgagcgaggaccagctgctgtacctgcccttcagaaactgccccagattccaggagctggagagcgagaccctgaagagcgaggagttccagaagagactgcacccctacaaggacttcatcgccaccctgggcaagctgagcggcctgcacggccaggacctgttcggcatctggagcaaggtgtacgaccccctgtactgcgagagcgtgcacaacttcaccctgcccagctgggccaccgaggacaccatgaccaagctgagagagctgagcgagctgagcctgctgagcctgtacggcatccacaagcagaaggagaagagcagactgcagggcggcgtgctggtgaacgagatcctgaaccacatgaagagagccacccagatccccagctacaagaagctgatcatgtacagcgcccacgacaccaccgtgagcggcctgcagatggccctggacgtgtacaacggcctgctgcccccctacgccagctgccacctgaccgagctgtacttcgagaagggcgagtacttcgtggagatgtactacagaaacgagacccagcacgagccctaccccctgatgctgcccggctgcagccccagctgccccctggagagattcgccgagctggtgggccccgtgatcccccaggactggagcaccgagtgcatgaccaccaacagccaccaggtgctgaaggtgatcttcgccgtggccttctgcctgatcagcgccgtgctgatggtgctgctgttcatccacatcagaagaggcctgtgctggcagagagagagctacggcaacatctag

SEQ ID NO: 71435 - DNA, 1281 bp, Artificial Sequence
  Description of Artificial Sequence: Synthetic coding sequence
atggccggcctgggcttctggggccaccccgccggccccctgctgctgctgctgctgctggtgctgccccccagagccctgcccgagggccccctggtgttcgtggccctggtgttcagacacggcgacagagcccccctggccagctaccccatggacccccacaaggaggtggccagcaccctgtggcccagaggcctgggccagctgaccaccgagggcgtgagacagcagctggagctgggcagattcctgagaagcagatacgaggccttcctgagccccgagtacagaagagaggaggtgtacatcagaagcaccgacttcgacagaaccctggagagcgcccaggccaacctggccggcctgttccccgaggccgcccccggcagccccgaggccagatggagacccatccccgtgcacaccgtgcccgtggccgaggacaagctgctgagattccccatgagaagctgccccagataccacgagctgctgagagaggccaccgaggccgccgagtaccaggaggccctggagggctggaccggcttcctgagcagactggagaacttcaccggcctgagcctggtgggcgagcccctgagaagagcctggaaggtgctggacaccctgatgtgccagcaggcccacggcctgcccctgcccgcctgggccagccccgacgtgctgagaaccctggcccagatcagcgccctggacatcggcgcccacgtgggcccccccagagccgccgagaaggcccagctgaccggcggcatcctgctgaacgccatcctggccaacttcagcagagtgcagagactgggcctgcccctgaagatggtgatgtacagcgcccacgacagcaccctgctggccctgcagggcgccctgggcctgtacgacggccacacccccccctacgccgcctgcctgggcttcgagttcagaaagcacctgggcaaccccgccaaggacggcggcaacgtgaccgtgagcctgttctacagaaacgacagcgcccacctgcccctgcccctgagcctgcccggctgccccgccccctgccccctgggcagattctaccagctgaccgcccccgccagaccccccgcccacggcgtgagctgccacggcccctacgaggccgccatcccccccgcccccgtggtgcccctgctggccggcgccgtggccgtgctggtggccctgagcctgggcctgggcctgctggcctggagacccggctgcctgagagccctgggcggccccgtgtag

SEQ ID NO: 71436 - DNA, 1002 bp, Artificial Sequence
  Description of Artificial Sequence: Synthetic coding sequence
atggccggcctgggcttctggggccaccccgccggccccctgctgctgctgctgctgctggtgctgccccccagagccctgcccgagggccccctggtgttcgtggccctggtgttcagacacggcgacagagcccccctggccagctaccccatggacccccacaaggaggtggccagcaccctgtggcccagaggcctgggccagctgaccaccgagggcgtgagacagcagctggagctgggcagattcctgagaagcagatacgagggcttcctgagcagactggagaacttcaccggcctgagcctggtgggcgagcccctgagaagagcctggaaggtgctggacaccctgatgtgccagcaggcccacggcctgcccctgcccgcctgggccagccccgacgtgctgagaaccctggcccagatcagcgccctggacatcggcgcccacgtgggcccccccagagccgccgagaaggcccagctgaccggcggcatcctgctgaacgccatcctggccaacttcagcagagtgcagagactgggcctgcccctgaagatggtgatgtacagcgcccacgacagcaccctgctggccctgcagggcgccctgggcctgtacgacggccacacccccccctacgccgcctgcctgggcttcgagttcagaaagcacctgggcaaccccgccaaggacggcggcaacgtgaccgtgagcctgttctacagaaacgacagcgcccacctgcccctgcccctgagcctgcccggctgccccgccccctgccccctgggcagattctaccagctgaccgcccccgccagaccccccgcccacggcgtgagctgccacggcccctacgaggccgccatcccccccgcccccgtggtgcccctgctggccggcgccgtggccgtgctggtggccctgagcctgggcctgggcctgctggcctggagacccggctgcctgagagccctgggcggccccgtgtag

SEQ ID NO: 71437 - DNA, 633 bp, Artificial Sequence
  Description of Artificial Sequence: Synthetic coding sequence
atggagatgggcagaagaatccacctggagctgagaaacagaacccccagcgacgtgaaggagctggtgctggacaacagcagaagcaacgagggcaagctggagggcctgaccgacgagttcgaggagctggagttcctgagcaccatcaacgtgggcctgaccagcatcgccaacctgcccaagctgaacaagctgaagaagctggagctgagcgacaacagagtgagcggcggcctggaggtgctggccgagaagtgccccaacctgacccacctgaacctgagcggcaacaagatcaaggacctgagcaccatcgagcccctgaagaagctggagaacctgaagagcctggacctgttcaactgcgaggtgaccaacctgaacgactacagagagaacgtgttcaagctgctgccccagctgacctacctggacggctacgacagagacgacaaggaggcccccgacagcgacgccgagggctacgtggagggcctggacgacgaggaggaggacgaggacgaggaggagtacgacgacgaggagggctacaacgacggcgaggtggacgacgaggaggacaagaagaagaagaagaagaagaagaagaagaagaagaagaagaagtag

SEQ ID NO: 71438 - DNA, 750 bp, Artificial Sequence
  Description of Artificial Sequence: Synthetic coding sequence
atggagatgggcagaagaatccacctggagctgagaaacagaacccccagcgacgtgaaggagctggtgctggacaacagcagaagcaacgagggcaagctggagggcctgaccgacgagttcgaggagctggagttcctgagcaccatcaacgtgggcctgaccagcatcgccaacctgcccaagctgaacaagctgaagaagctggagctgagcgacaacagagtgagcggcggcctggaggtgctggccgagaagtgccccaacctgacccacctgaacctgagcggcaacaagatcaaggacctgagcaccatcgagcccctgaagaagctggagaacctgaagagcctggacctgttcaactgcgaggtgaccaacctgaacgactacagagagaacgtgttcaagctgctgccccagctgacctacctggacggctacgacagagacgacaaggaggcccccgacagcgacgccgagggctacgtggagggcctggacgacgaggaggaggacgaggacgaggaggagtacgacgaggacgcccaggtggtggaggacgaggaggacgaggacgaggaggaggagggcgaggaggaggacgtgagcggcgaggaggaggaggacgaggagggctacaacgacggcgaggtggacgacgaggaggacgaggaggagctgggcgaggaggagagaggccagaagagaaagagagagcccgaggacgagggcgaggacgacgactag

SEQ ID NO: 71439 - DNA, 396 bp, Artificial Sequence
  Description of Artificial Sequence: Synthetic coding sequence
atggagatgggcaagtggatccacctggagctgagaaacagaacccccagcgacgtgaaggagctgttcctggacaacagccagagcaacgagggcaagctggagggcctgaccgacgagttcgaggagctggagctgctgaacaccatcaacatcggcctgaccagcatcgccaacctgcccaagctgaacaagctgaagaagctggagctgagcagcaacagagccagcgtgggcctggaggtgctggccgagaagtgccccaacctgatccacctgaacctgagcggcaacaagatcaaggacctgagcaccatcgagcccctgaagaagctggagaacctggagagcctggacctgttcacctgcgaggtgaccaacctgaacaactactag

SEQ ID NO: 71440 - DNA, 807 bp, Artificial Sequence
  Description of Artificial Sequence: Synthetic coding sequence
atggagatgaagaagaagatcaacctggagctgagaaacagaagccccgaggaggtgaccgagctggtgctggacaactgcctgtgcgtgaacggcgagatcgagggcctgaacgacaccttcaaggagctggagttcctgagcatggccaacgtggagctgagcagcctggccagactgcccagcctgaacaagctgagaaagctggagctgagcgacaacatcatcagcggcggcctggaggtgctggccgagaagtgccccaacctgacctacctgaacctgagcggcaacaagatcaaggacctgagcaccgtggaggccctgcagaacctgaagaacctgaagagcctggacctgttcaactgcgagatcaccaacctggaggactacagagagagcatcttcgagctgctgcagcagatcacctacctggacggcttcgaccaggaggacaacgaggcccccgacagcgaggaggaggacgacgaggacggcgacgaggacgacgaggaggaggaggagaacgaggccggcccccccgagggctacgaggaggaggaggaggaggaggaggaggaggacgaggacgaggacgaggacgaggacgaggccggcagcgagctgggcgagggcgaggaggaggtgggcctgagctacctgatgaaggaggagatccaggacgaggaggacgacgacgactacgtggaggagggcgaggaggaggaggaggaggaggagggcggcctgagaggcgagaagagaaagagagacgccgaggacgacggcgaggaggaggacgactag

SEQ ID NO: 71441 - DNA, 411 bp, Artificial Sequence
  Description of Artificial Sequence: Synthetic coding sequence
atggagatgaagaagaagatcaacctggagctgagaaacagaagccccgaggaggaggacaacgaggcccccgacagcgaggaggaggacgacgaggacggcgacgaggacgacgaggaggaggaggagaacgaggccggcccccccgagggctacgaggaggaggaggaggaggaggaggaggaggacgaggacgaggacgaggacgaggacgaggccggcagcgagctgggcgagggcgaggaggaggtgggcctgagctacctgatgaaggaggagatccaggacgaggaggacgacgacgactacgtggaggagggcgaggaggaggaggaggaggaggagggcggcctgagaggcgagaagagaaagagagacgccgaggacgacggcgaggaggaggacgactag

SEQ ID NO: 71442 - DNA, 663 bp, Artificial Sequence
  Description of Artificial Sequence: Synthetic coding sequence
atggccaacgtggagctgagcagcctggccagactgcccagcctgaacaagctgagaaagctggagctgagcgacaacatcatcagcggcggcctggaggtgctggccgagaagtgccccaacctgacctacctgaacctgagcggcaacaagatcaaggacctgagcaccgtggaggccctgcagaacctgaagaacctgaagagcctggacctgttcaactgcgagatcaccaacctggaggactacagagagagcatcttcgagctgctgcagcagatcacctacctggacggcttcgaccaggaggacaacgaggcccccgacagcgaggaggaggacgacgaggacggcgacgaggacgacgaggaggaggaggagaacgaggccggcccccccgagggctacgaggaggaggaggaggaggaggaggaggaggacgaggacgaggacgaggacgaggacgaggccggcagcgagctgggcgagggcgaggaggaggtgggcctgagctacctgatgaaggaggagatccaggacgaggaggacgacgacgactacgtggaggagggcgaggaggaggaggaggaggaggagggcggcctgagaggcgagaagagaaagagagacgccgaggacgacggcgaggaggaggacgactag

SEQ ID NO: 71443 - DNA, 684 bp, Artificial Sequence
  Description of Artificial Sequence: Synthetic coding sequence
atggagatgaagaagaagatcaacctggagctgagaaacagaagccccgaggaggtgaccgagctggtgctggacaactgcctgtgcgtgaacggcgagatcgagggcctgaacgacaccttcaaggagctggagttcctgagcatggccaacgtggagctgagcagcctggccagactgcccagcctgaacaagctgagaaagcagaacctgaagaacctgaagagcctggacctgttcaactgcgagatcaccaacctggaggactacagagagagcatcttcgagctgctgcagcagatcacctacctggacggcttcgaccaggaggacaacgaggcccccgacagcgaggaggaggacgacgaggacggcgacgaggacgacgaggaggaggaggagaacgaggccggcccccccgagggctacgaggaggaggaggaggaggaggaggaggaggacgaggacgaggacgaggacgaggacgaggccggcagcgagctgggcgagggcgaggaggaggtgggcctgagctacctgatgaaggaggagatccaggacgaggaggacgacgacgactacgtggaggagggcgaggaggaggaggaggaggaggagggcggcctgagaggcgagaagagaaagagagacgccgaggacgacggcgaggaggaggacgactag

SEQ ID NO: 71444 - DNA, 2076 bp, Artificial Sequence
  Description of Artificial Sequence: Synthetic coding sequence
atggacggctgcaagaaggagctgcccagactgcaggagcccgaggaggacgaggactgctacatcctgaacgtgcagagcagcagcgacgacaccagcggcagcagcgtggccagaagagcccccaagagacaggccagctgcatcctgaacgtgcagagcagaagcggcgacaccagcggcagcagcgtggccagaagagcccccaagagacaggccagcagcgtggtggtgatcgacagcgacagcgacgaggagtgccacacccacgaggagaagaaggccaagctgctggagatcaacagcgacgacgagagccccgagtgctgccacgtgaagcccgccatccaggagccccccatcgtgatcagcgacgacgacaacgacgacgacaacggcaacgacctggaggtgcccgacgacaacagcgacgacagcgaggcccccgacgacaacagcgacgacagcgaggcccccgacgacaacagcgacgacagcgaggcccccgacgacaacagcgacgacagcgaggcccccgacgacaacagcgacgacagcgacgtgcccgacgacaacagcgacgacagcagcgacgacaacagcgacgacagcagcgacgacaacagcgacgacagcgacgtgcccgacgacaagagcgacgacagcgacgtgcccgacgacagcagcgacgacagcgacgtgcccgacgacagcagcgacgacagcgaggcccccgacgacagcagcgacgacagcgaggcccccgacgacagcagcgacgacagcgaggcccccgacgacagcagcgacgacagcgaggcccccgacgacagcagcgacgacagcgaggccagcgacgacagcagcgacgacagcgaggccagcgacgacagcagcgacgacagcgaggcccccgacgacaagagcgacgacagcgacgtgcccgaggacaagagcgacgacagcgacgtgcccgacgacaacagcgacgacctggaggtgcccgtgcccgccgaggacctgtgcaacgagggccagatcgccagcgacgaggaggagctggtggaggccgccgccgccgtgagccagcacgacagcagcgacgacgccggcgagcaggacctgggcgagaacctgagcaagccccccagcgaccccgaggccaaccccgaggtgagcgagagaaagctgcccaccgaggaggagcccgcccccgtggtggagcagagcggcaagagaaagagcaagaccaagaccatcgtggagccccccagaaagagacagaccaagaccaagaacatcgtggagccccccagaaagagacagaccaagaccaagaacatcgtggagcccctgagaaagagaaaggccaagaccaagaacgtgagcgtgacccccggccacaagaagagaggccccagcaagaagaagcccggcgccgccaaggtggagaagagaaagaccagaacccccaagtgcaaggtgcccggctgcttcctgcaggacctggagaagagcaagaagtacagcggcaagaacctgaagagaaacaaggacgagctggtgcagagaatctacgacctgttcaacagaagcgtgtgcgacaagaagctgcccgagaagctgagaatcggctggaacaacaagatggtgaagaccgccggcctgtgcagcaccggcgagatgtggtaccccaagtggagaagattcgccaagatccagatcggcctgaaggtgtgcgacagcgccgacagaatcagagacaccctgatccacgagatgtgccacgccgccagctggctgatcgacggcatccacgacagccacggcgacgcctggaagtactacgccagaaagagcaacagaatccaccccgagctgcccagagtgaccagatgccacaactacaagatcaactacaaggtgcactacgagtgcaccggctgcaagaccagaatcggctgctacaccaagagcctggacaccagcagattcatctgcgccaagtgcaagggcagcctggtgatggtgcccctgacccagaaggacggcaccagaatcgtgccccacgtgtag

SEQ ID NO: 71445 - DNA, 2076 bp, Artificial Sequence; identical to SEQ ID NO: 71444
  Description of Artificial Sequence: Synthetic coding sequence

SEQ ID NO: 71446 - DNA, 540 bp, Artificial Sequence
  Description of Artificial Sequence: Synthetic coding sequence
atggtgcaggcctggtacatggacgacgcccccggcgaccccagacagccccacagacccgaccccggcagacccgtgggcctggagcagctgagaagactgggcgtgctgtactggaagctggacgccgacaagtacgagaacgaccccgagctggagaagatcagaagagagagaaactacagctggatggacatcatcaccatctgcaaggacaagctgcccaactacgaggagaagatcaagatgttctacgaggagcacctgcacctggacgacgagatcagatacatcctggacggcagcggctacttcgacgtgagagacaaggaggaccagtggatcagaatcttcatggagaagggcgacatggtgaccctgcccgccggcatctaccacagattcaccgtggacgagaagaactacaccaaggccatgagactgttcgtgggcgagcccgtgtggaccgcctacaacagacccgccgaccacttcgaggccagaggccagtacgtgaagttcctggcccagaccgcctag

SEQ ID NO: 71447 - DNA, 2670 bp, Artificial Sequence
  Description of Artificial Sequence: Synthetic coding sequence
atgagcaaccccttcgcccacctggccgagcccctggaccccgtgcagcccggcaagaagttcttcaacctgaacaagctggaggacagcagatacggcagactgcccttcagcatcagagtgctgctggaggccgccatcagaaactgcgacgagttcctggtgaagaagcaggacatcgagaacatcctgcactggaacgtgacccagcacaagaacatcgaggtgcccttcaagcccgccagagtgatcctgcaggacttcaccggcgtgcccgccgtggtggacttcgccgccatgagagacgccgtgaagaagctgggcggcgaccccgagaagatcaaccccgtgtgccccgccgacctggtgatcgaccacagcatccaggtggacttcaacagaagagccgacagcctgcagaagaaccaggacctggagttcgagagaaacagagagagattcgagttcctgaagtggggcagccaggccttccacaacatgagaatcatcccccccggcagcggcatcatccaccaggtgaacctggagtacctggccagagtggtgttcgaccaggacggctactactaccccgacagcctggtgggcaccgacagccacaccaccatgatcgacggcctgggcatcctgggctggggcgtgggcggcatcgaggccgaggccgtgatgctgggccagcccatcagcatggtgctgccccaggtgatcggctacagactgatgggcaagccccaccccctggtgaccagcaccgacatcgtgctgaccatcaccaagcacctgagacaggtgggcgtggtgggcaagttcgtggagttcttcggccccggcgtggcccagctgagcatcgccgacagagccaccatcgccaacatgtgccccgagtacggcgccaccgccgccttcttccccgtggacgaggtgagcatcacctacctggtgcagaccggcagagacgaggagaagctgaagtacatcaagaagtacctgcaggccgtgggcatgttcagagacttcaacgaccccagccaggaccccgacttcacccaggtggtggagctggacctgaagaccgtggtgccctgctgcagcggccccaagagaccccaggacaaggtggccgtgagcgacatgaagaaggacttcgagagctgcctgggcgccaagcagggcttcaagggcttccaggtggcccccgagcaccacaacgaccacaagaccttcatctacgacaacaccgagttcaccctggcccacggcagcgtggtgatcgccgccatcaccagctgcaccaacaccagcaaccccagcgtgatgctgggcgccggcctgctggccaagaaggccgtggacgccggcctgaacgtgatgccctacatcaagaccagcctgagccccggcagcggcgtggtgacctactacctgcaggagagcggcgtgatgccctacctgagccagctgggcttcgacgtggtgggctacggctgcatgacctgcatcggcaacagcggccccctgcccgagcccgtggtggaggccatcacccagggcgacctggtggccgtgggcgtgctgagcggcaacagaaacttcgagggcagagtgcaccccaacaccagagccaactacctggccagcccccccctggtgatcgcctacgccatcgccggcaccatcagaatcgacttcgagaaggagcccctgggcgtgaacgccaagggccagcaggtgttcctgaaggacatctggcccaccagagacgagatccaggccgtggagagacagtacgtgatccccggcatgttcaaggaggtgtaccagaagatcgagaccgtgaacgagagctggaacgccctggccacccccagcgacaagctgttcttctggaacagcaagagcacctacatcaagagcccccccttcttcgagaacctgaccctggacctgcagccccccaagagcatcgtggacgcctacgtgctgctgaacctgggcgacagcgtgaccaccgaccacatcagccccgccggcaacatcgccagaaacagccccgccgccagatacctgaccaacagaggcctgacccccagagagttcaacagctacggcagcagaagaggcaacgacgccgtgatggccagaggcaccttcgccaacatcagactgctgaacagattcctgaacaagcaggccccccagaccatccacctgcccagcggcgagatcctggacgtgttcgacgccgccgagagataccagcaggccggcctgcccctgatcgtgctggccggcaaggagtacggcgccggcagcagcagagactgggccgccaagggccccttcctgctgggcatcaaggccgtgctggccgagagctacgagagaatccacagaagcaacctggtgggcatgggcgtgatccccctggagtacctgcccggcgagaacgccgacgccctgggcctgaccggccaggagagatacaccatcatcatccccgagaacctgaagccccagatgaaggtgcaggtgaagctggacaccggcaagaccttccaggccgtgatgagattcgacaccgacgtggagctgacctacttcctgaacggcggcatcctgaactacatgatcagaaagatggccaagtag

SEQ ID NO: 71448 - DNA, 1305 bp, Artificial Sequence
  Description of Artificial Sequence: Synthetic coding sequence
atgagcaaccccttcgcccacctggccgagcccctggaccccgtgcagcccggcaagaagttcttcaacctgaacaagctggaggacagcagatacggcagactgcccttcagcatcagagtgctgctggaggccgccatcagaaactgcgacgagttcctggtgaagaagcaggacatcgagaacatcctgcactggaacgtgacccagcacaagaacatcgaggtgcccttcaagcccgccagagtgatcctgcaggacttcaccggcgtgcccgccgtggtggacttcgccgccatgagagacgccgtgaagaagctgggcggcgaccccgagaagatcaaccccgtgtgccccgccgacctggtgatcgaccacagcatccaggtggacttcaacagaagagccgacagcctgcagaagaaccaggacctggagttcgagagaaacagagagagattcgagttcctgaagtggggcagccaggccttccacaacatgagaatcatcccccccggcagcggcatcatccaccaggtgaacctggagtacctggccagagtggtgttcgaccaggacggctactactaccccgacagcctggtgggcaccgacagccacaccaccatgatcgacggcctgggcatcctgggctggggcgtgggcggcatcgaggccgaggccgtgatgctgggccagcccatcagcatggtgctgccccaggtgatcggctacagactgatgggcaagccccaccccctggtgaccagcaccgacatcgtgctgaccatcaccaagcacctgagacaggtgggcgtggtgggcaagttcgtggagttcttcggccccggcgtggcccagctgagcatcgccgacagagccaccatcgccaacatgtgccccgagtacggcgccaccgccgccttcttccccgtggacgaggtgagcatcacctacctggtgcagaccggcagagacgaggagaagctgaagtacatcaagaagtacctgcaggccgtgggcatgttcagagacttcaacgaccccagccaggaccccgacttcacccaggtggtggagctggacctgaagaccgtggtgccctgctgcagcggccccaagagaccccaggacaaggtggccgtgagcgacatgaagaaggacttcgagagctgcctgggcgccaagcagggcttcaagggcttccaggtggcccccgagcaccacaacgaccacaagaccttcatctacgacaacaccgagttcaccctggcccacggcagcgtggtgatcgccgccctgtag

SEQ ID NO: 71449 - DNA, 2670 bp, Artificial Sequence; identical to SEQ ID NO: 71447
  Description of Artificial Sequence: Synthetic coding sequence

SEQ ID NO: 71450 - DNA, 2346 bp, Artificial Sequence
  Description of Artificial Sequence: Synthetic coding sequence
cagctggagcccagaagcgccagagagagagtgcccctgctgggcagcggcagccccgtggccggcgcccccccctgcagcagaagaaacacctggcccagcgtgatcatgagcaaccccttcgcccacctggccgagcccctggaccccgtgcagcccggcaagaagttcttcaacctgaacaagctggaggacagcagatacggcagactgcccttcagcatcagagtgctgctggaggccgccatcagaaactgcgacgagttcctggtgaagaagcaggacatcgagaacatcctgcactggaacgtgacccagcacaagaacatcgaggtgcccttcaagcccgccagagtgatcctgcaggacttcaccggcgtgcccgccgtggtggacttcgccgccatgagagacgccgtgaagaagctgggcggcgaccccgagaagatcaaccccgtgtgccccgccgacctggtgatcgaccacagcatccaggtggacttcaacagaagagccgacagcctgcagaagaaccaggacctggagttcgagagaaacagagagagattcgagttcctgaagtggggcagccaggccttccacaacatgagaatcatcccccccggcagcggcatcatccaccaggtgaacctggagtacctggccagagtggtgttcgaccaggacggctactactaccccgacagcctggtgggcaccgacagccacaccaccatgatcgacggcctgggcatcctgggctggggcgtgggcggcatcgaggccgaggccgtgatgctgggccagcccatcagcatggtgctgccccaggtgatcggctacagactgatgggcaagccccaccccctggtgaccagcaccgacatcgtgctgaccatcaccaagcacctgagacaggtgggcgtggtgggcaagttcgtggagttcttcggccccggcgtggcccagctgagcatcgccgacagagccaccatcgccaacatgtgccccgagtacggcgccaccgccgccttcttccccgtggacgaggtgagcatcacctacctggtgcagaccggcagagacgaggagaagctgaagtacatcaagaagtacctgcaggccgtgggcatgttcagagacttcaacgaccccagccaggaccccgacttcacccaggtggtggagctggacctgaagaccgtggtgccctgctgcagcggccccaagagaccccaggacaaggtggccgtgagcgacatgaagaaggacttcgagagctgcctgggcgccaagcagggcttcaagggcttccaggtggcccccgagcaccacaacgaccacaagaccttcatctacgacaacaccgagttcaccctggcccacggcagcgtggtgatcgccgccatcaccagctgcaccaacaccagcaaccccagcgtgatgctgggcgccggcctgctggccaagaaggccgtggacgccggcctgaacgtgatgccctacatcaagaccagcctgagccccggcagcggcgtggtgacctactacctgcaggagagcggcgtgatgccctacctgagccagctgggcttcgacgtggtgggctacggctgcatgacctgcatcggcaacagcggccccctgcccgagcccgtggtggaggccatcacccagggcgacctggtggccgtgggcgtgctgagcggcaacagaaacttcgagggcagagtgcaccccaacaccagagccaactacctggccagcccccccctggtgatcgcctacgccatcgccggcaccatcagaatcgacttcgagaaggagcccctgggcgtgaacgccaagggccagcaggtgttcctgaaggacatctggcccaccagagacgagatccaggccgtggagagacagtacgtgatccccggcatgttcaaggaggtgtaccagaagatcgagaccgtgaacgagagctggaacgccctggccacccccagcgacaagctgttcttctggaacagcaagagcacctacatcaagagcccccccttcttcgagaacctgaccctggacctgcagccccccaagagcatcgtggacgcctacgtgctgctgaacctgggcgacagcgtgaccaccgaccacatcagccccgccggcaacatcgccagaaacagccccgccgccagatacctgaccaacagaggcttcgagagacagctgacccaggagaacaccgacctgtgcctgagcccccccctgctgaccagcctgagcagccccctgaagctgtggggccagctgttctgccacggcgagcagtgcctgggcgacctggagaagtag

SEQ ID NO: 71451 - DNA, 2373 bp, Artificial Sequence
  Description of Artificial Sequence: Synthetic coding sequence
atgagagacgccgtgaagaagctgggcggcgaccccgagaagatcaaccccgtgtgccccgccgacctggtgatcgaccacagcatccaggtggacttcaacagaagagccgacagcctgcagaagaaccaggacctggagttcgagagaaacagagagagattcgagttcctgaagtggggcagccaggccttccacaacatgagaatcatcccccccggcagcggcatcatccaccaggtgaacctggagtacctggccagagtggtgttcgaccaggacggctactactaccccgacagcctggtgggcaccgacagccacaccaccatgatcgacggcctgggcatcctgggctggggcgtgggcggcatcgaggccgaggccgtgatgctgggccagcccatcagcatggtgctgccccaggtgatcggctacagactgatgggcaagccccaccccctggtgaccagcaccgacatcgtgctgaccatcaccaagcacctgagacaggtgggcgtggtgggcaagttcgtggagttcttcggccccggcgtggcccagctgagcatcgccgacagagccaccatcgccaacatgtgccccgagtacggcgccaccgccgccttcttccccgtggacgaggtgagcatcacctacctggtgcagaccggcagagacgaggagaagctgaagtacatcaagaagtacctgcaggccgtgggcatgttcagagacttcaacgaccccagccaggaccccgacttcacccaggtggtggagctggacctgaagaccgtggtgccctgctgcagcggccccaagagaccccaggacaaggtggccgtgagcgacatgaagaaggacttcgagagctgcctgggcgccaagcagggcttcaagggcttccaggtggcccccgagcaccacaacgaccacaagaccttcatctacgacaacaccgagttcaccctggcccacggcagcgtggtgatcgccgccatcaccagctgcaccaacaccagcaaccccagcgtgatgctgggcgccggcctgctggccaagaaggccgtggacgccggcctgaacgtgatgccctacatcaagaccagcctgagccccggcagcggcgtggtgacctactacctgcaggagagcggcgtgatgccctacctgagccagctgggcttcgacgtggtgggctacggctgcatgacctgcatcggcaacagcggccccctgcccgagcccgtggtggaggccatcacccagggcgacctggtggccgtgggcgtgctgagcggcaacagaaacttcgagggcagagtgcaccccaacaccagagccaactacctggccagcccccccctggtgatcgcctacgccatcgccggcaccatcagaatcgacttcgagaaggagcccctgggcgtgaacgccaagggccagcaggtgttcctgaaggacatctggcccaccagagacgagatccaggccgtggagagacagtacgtgatccccggcatgttcaaggaggtgtaccagaagatcgagaccgtgaacgagagctggaacgccctggccacccccagcgacaagctgttcttctggaacagcaagagcacctacatcaagagcccccccttcttcgagaacctgaccctggacctgcagccccccaagagcatcgtggacgcctacgtgctgctgaacctgggcgacagcgtgaccaccgaccacatcagccccgccggcaacatcgccagaaacagccccgccgccagatacctgaccaacagaggcctgacccccagagagttcaacagctacggcagcagaagaggcaacgacgccgtgatggccagaggcaccttcgccaacatcagactgctgaacagattcctgaacaagcaggccccccagaccatccacctgcccagcggcgagatcctggacgtgttcgacgccgccgagagataccagcaggccggcctgcccctgatcgtgctggccggcaaggagtacggcgccggcagcagcagagactgggccgccaagggccccttcctgctgggcatcaaggccgtgctggccgagagctacgagagaatccacagaagcaacctggtgggcatgggcgtgatccccctggagtacctgcccggcgagaacgccgacgccctgggcctgaccggccaggagagatacaccatcatcatccccgagaacctgaagccccagatgaaggtgcaggtgaagctggacaccggcaagaccttccaggccgtgatgagattcgacaccgacgtggagctgacctacttcctgaacggcggcatcctgaactacatgatcagaaagatggccaagtag

SEQ ID NO: 71452 - DNA, 333 bp, Artificial Sequence
  Description of Artificial Sequence: Synthetic coding sequence
atggccaagcaccaccccgacctgatcttctgcagaaagcaggccggcgtggccatcggcagactgtgcgagaagtgcgacggcaagtgcgtgatctgcgacagctacgtgagaccctgcaccctggtgagaatctgcgacgagtgcaactacggcagctaccagggcagatgcgtgatctgcggcggccccggcgtgagcgacgcctactactgcaaggagtgcaccatccaggagaaggacagagacggctgccccaagatcgtgaacctgggcagcagcaagaccgacctgttctacgagagaaagaagtacggcttcaagaagagatag

SEQ ID NO: 71453 - DNA, 2418 bp, Artificial Sequence
  Description of Artificial Sequence: Synthetic coding sequence
atggccccctacagcctgctggtgaccagactgcagaaggccctgggcgtgagacagtaccacgtggccagcgtgctgtgccagagagccaaggtggccatgagccacttcgagcccaacgagtacatccactacgacctgctggagaagaacatcaacatcgtgagaaagagactgaacagacccctgaccctgagcgagaagatcgtgtacggccacctggacgaccccgccagccaggagatcgagagaggcaagagctacctgagactgagacccgacagagtggccatgcaggacgccaccgcccagatggccatgctgcagttcatcagcagcggcctgagcaaggtggccgtgcccagcaccatccactgcgaccacctgatcgaggcccaggtgggcggcgagaaggacctgagaagagccaaggacatcaaccaggaggtgtacaacttcctggccaccgccggcgccaagtacggcgtgggcttctggaagcccggcagcggcatcatccaccagatcatcctggagaactacgcctaccccggcgtgctgctgatcggcaccgacagccacacccccaacggcggcggcctgggcggcatctgcatcggcgtgggcggcgccgacgccgtggacgtgatggccggcatcccctgggagctgaagtgccccaaggtgatcggcgtgaagctgaccggcagcctgagcggctggagcagccccaaggacgtgatcctgaaggtggccggcatcctgaccgtgaagggcggcaccggcgccatcgtggagtaccacggccccggcgtggacagcatcagctgcaccggcgaggagggcggccaggccacctggcccctgccctgcgccggccccgacggcagccccgtgggcagcagaagcggcatggccaccatctgcaacatgggcgccgagatcggcgccaccaccagcgtgttcccctacaaccacagaatgaagaagtacctgagcaagaccggcagagaggacatcgccaacctggccgacgagttcaaggaccacctggtgcccgaccccggctgccactacgaccagctgatcgagatcaacctgagcgagctgaagccccacatcaacggccccttcacccccgacctggcccaccccgtggccgaggtgggcaaggtggccgagaaggagggctggcccctggacatcagagtgggcctgatcggcagctgcaccaacagcagctacgaggacatgggcagaagcgccgccgtggccaagcaggccctggcccacggcctgaagtgcaagagccagttcaccatcacccccggcagcgagcagatcagagccaccatcgagagagacggctacgcccagatcctgagagacctgggcggcatcgtgctggccaacgcctgcggcccctgcatcggccagtgggacagaaaggacatcaagaagggcgagaagaacaccatcgtgaccagctacaacagaaacttcaccggcagaaacgacgccaaccccgagacccacgccttcgtgaccagccccgagatcgtgaccgccctggccatcgccggcaccctgaagttcaaccccgagaccgactacctgaccggcaccgacggcaagaagttcagactggaggcccccgacgccgacgagctgcccaagggcgagttcgaccccggccaggacacctaccagcacccccccaaggacagcagcggccagcacgtggacgtgagccccaccagccagagactgcagctgctggagcccttcgacaagtgggacggcaaggacctggaggacctgcagatcctgatcaaggtgaagggcaagtgcaccaccgaccacatcagcgccgccggcccctggctgaagttcagaggccacctggacaacatcagcaacaacctgctgatcggcgccatcaacatcgagaacggcaaggccaacagcgtgagaaacgccgtgacccaggagttcggccccgtgcccgacaccgccagatactacaagaagcacggcatcagatgggtggtgatcggcgacgagaactacggcgagggcagcagcagagagcacgccgccctggagcccagacacctgggcggcagagccatcatcaccaagagcttcgccagaatccacgagaccaacctgaagaagcagggcctgctgcccctgaccttcgccgaccccgccgactacaacaagatccaccccgtggacaagctgaccatccagggcctgaaggacttcacccccggcaagcccctgaagtgcatcatcaagcaccccaacggcacccaggagaccatcctgctgaaccacaccttcaacgagacccagatcgagtggttcagagccggcagcgccctgaacagaatgaaggagctgcagcagtag

SEQ ID NO: 71454 - DNA, 1506 bp, Artificial Sequence
  Description of Artificial Sequence: Synthetic coding sequence
atggccaccatctgcaacatgggcgccgagatcggcgccaccaccagcgtgttcccctacaaccacagaatgaagaagtacctgagcaagaccggcagagaggacatcgccaacctggccgacgagttcaaggaccacctggtgcccgaccccggctgccactacgaccagctgatcgagatcaacctgagcgagctgaagccccacatcaacggccccttcacccccgacctggcccaccccgtggccgaggtgggcaaggtggccgagaaggagggctggcccctggacatcagagtgggcctgatcggcagctgcaccaacagcagctacgaggacatgggcagaagcgccgccgtggccaagcaggccctggcccacggcctgaagtgcaagagccagttcaccatcacccccggcagcgagcagatcagagccaccatcgagagagacggctacgcccagatcctgagagacctgggcggcatcgtgctggccaacgcctgcggcccctgcatcggccagtgggacagaaaggacatcaagaagggcgagaagaacaccatcgtgaccagctacaacagaaacttcaccggcagaaacgacgccaaccccgagacccacgccttcgtgaccagccccgagatcgtgaccgccctggccatcgccggcaccctgaagttcaaccccgagaccgactacctgaccggcaccgacggcaagaagttcagactggaggcccccgacgccgacgagctgcccaagggcgagttcgaccccggccaggacacctaccagcacccccccaaggacagcagcggccagcacgtggacgtgagccccaccagccagagactgcagctgctggagcccttcgacaagtgggacggcaaggacctggaggacctgcagatcctgatcaaggtgaagggcaagtgcaccaccgaccacatcagcgccgccggcccctggctgaagttcagaggccacctggacaacatcagcaacaacctgctgatcggcgccatcaacatcgagaacggcaaggccaacagcgtgagaaacgccgtgacccaggagttcggccccgtgcccgacaccgccagatactacaagaagcacggcatcagatgggtggtgatcggcgacgagaactacggcgagggcagcagcagagagcacgccgccctggagcccagacacctgggcggcagagccatcatcaccaagagcttcgccagaatccacgagaccaacctgaagaagcagggcctgctgcccctgaccttcgccgaccccgccgactacaacaagatccaccccgtggacaagctgaccatccagggcctgaaggacttcacccccggcaagcccctgaagtgcatcatcaagcaccccaacggcacccaggagaccatcctgctgaaccacaccttcaacgagacccagatcgagtggttcagagccggcagcgccctgaacagaatgaaggagctgcagcagtag

SEQ ID NO: 71455 - DNA, 2286 bp, Artificial Sequence
  Description of Artificial Sequence: Synthetic coding sequence
atggccccctacagcctgctggtgaccagactgcagaaggccctgggcgtgagacagtaccacgtggccagcgtgctgtgccagagagccaaggtggccatgagccacttcgagcccaacgagtacatccactacgacctgctggagaagaacatcaacatcgtgagaaagagactgaacagacccctgaccctgagcgagaagatcgtgtacggccacctggacgaccccgccagccaggagatcgagagaggcaagagctacctgagactgagacccgacagagtggccatggtggccgtgcccagcaccatccactgcgaccacctgatcgaggcccaggtgggcggcgagaaggacctgagaagagccaaggacatcaaccaggaggtgtacaacttcctggccaccgccggcgccaagtacggcgtgggcttctggaagcccggcagcggcatcatccaccagatcatcctggagaactacgcctaccccggcgtgctgctgatcggcaccgacagccacacccccaacggcggcggcctgggcggcatctgcatcggcgtgggcggcgccgacgccgtggacgtgatggccggcatcccctgggagctgaagtgccccaaggtgatcggcgtgaagctgaccggcagcctgagcggctggagcagccccaaggacgtgatcctgaaggtggccggcatcctgaccgtgaagggcggcaccggcgccatcgtggagtaccacggccccggcgtggacagcatcagctgcaccggcatggccaccatctgcaacatgggcgccgagatcggcgccaccaccagcgtgttcccctacaaccacagaatgaagaagtacctgagcaagaccggcagagaggacatcgccaacctggccgacgagttcaaggaccacctggtgcccgaccccggctgccactacgaccagctgatcgagatcaacctgagcgagctgaagccccacatcaacggccccttcacccccgacctggcccaccccgtggccgaggtgggcaaggtggccgagaaggagggctggcccctggacatcagagtgggcctgatcggcagctgcaccaacagcagctacgaggacatgggcagaagcgccgccgtggccaagcaggccctggcccacggcctgaagtgcaagagccagttcaccatcacccccggcagcgagcagatcagagccaccatcgagagagacggctacgcccagatcctgagagacctgggcggcatcgtgctggccaacgcctgcggcccctgcatcggccagtgggacagaaaggacatcaagaagggcgagaagaacaccatcgtgaccagctacaacagaaacttcaccggcagaaacgacgccaaccccgagacccacgccttcgtgaccagccccgagatcgtgaccgccctggccatcgccggcaccctgaagttcaaccccgagaccgactacctgaccggcaccgacggcaagaagttcagactggaggcccccgacgccgacgagctgcccaagggcgagttcgaccccggccaggacacctaccagcacccccccaaggacagcagcggccagcacgtggacgtgagccccaccagccagagactgcagctgctggagcccttcgacaagtgggacggcaaggacctggaggacctgcagatcctgatcaaggtgaagggcaagtgcaccaccgaccacatcagcgccgccggcccctggctgaagttcagaggccacctggacaacatcagcaacaacctgctgatcggcgccatcaacatcgagaacggcaaggccaacagcgtgagaaacgccgtgacccaggagttcggccccgtgcccgacaccgccagatactacaagaagcacggcatcagatgggtggtgatcggcgacgagaactacggcgagggcagcagcagagagcacgccgccctggagcccagacacctgggcggcagagccatcatcaccaagagcttcgccagaatccacgagaccaacctgaagaagcagggcctgctgcccctgaccttcgccgaccccgccgactacaacaagatccaccccgtggacaagctgaccatccagggcctgaaggacttcacccccggcaagcccctgaagtgcatcatcaagcaccccaacggcacccaggagaccatcctgctgaaccacaccttcaacgagacccagatcgagtggttcagagccggcagcgccctgaacagaatgaaggagctgcagcagtag

SEQ ID NO: 71456 - DNA, 756 bp, Artificial Sequence
  Description of Artificial Sequence: Synthetic coding sequence
atggagctgagcgccatcggcgagcaggtgttcgccgtggagagcatcagaaagaagagagtgagaaagggcaaggtggagtacctggtgaagtggaagggctggccccccaagtacagcacctgggagcccgaggagcacatcctggaccccagactggtgatggcctacgaggagaaggaggagagagacagagccagcggctacagaaagagaggccccaagcccaagagactgctgctgcagagactgtacagcatggacctgagaagcagccacaaggccaagggcaaggagaagctgtgcttcagcctgacctgccccctgggcagcggcagccccgagggcgtggtgaaggccggcgcccccgagctggtggacaagggccccctggtgcccaccctgcccttccccctgagaaagcccagaaaggcccacaagtacctgagactgagcagaaagaagttcccccccagaggccccaacctggagagccacagccacagaagagagctgttcctgcaggagccccccgcccccgacgtgctgcaggccgccggcgagtgggagcccgccgcccagccccccgaggaggaggccgacgccgacctggccgagggcccccccccctggacccccgccctgcccagcagcgaggtgaccgtgaccgacatcaccgccaacagcatcaccgtgaccttcagagaggcccaggccgccgagggcttcttcagagacagaagcggcaagttctag

SEQ ID NO: 71457 - DNA, 633 bp, Artificial Sequence
  Description of Artificial Sequence: Synthetic coding sequence
atgaacagattcctgctgctgatgagcctgtacctgctgggcagcgccagaggcaccagcagccagcccaacgagctgagcggcagcatcgaccaccagaccagcgtgcagcagctgcccggcgagcccgccgccaccgagcacgccgagggcgagcacaccgtgggcgagcagcccagcggcgagcagcccagcggcgagcacctgagcggcgagcagcccctgagcgagctggagagcggcgagcagcccagcgacgagcagcccagcggcgagcacggcagcggcgagcagcccagcggcgagcaggccagcggcgagcagcccagcggcgagcacgccagcggcgagcaggccagcggcgcccccatcagcagcaccagcaccggcaccatcctgaactgctacacctgcgcctacatgaacgaccagggcaagtgcctgagaggcgagggcacctgcatcacccagaacagccagcagtgcatgctgaagaagatcttcgagggcggcaagctgcagttcatggtgcagggctgcgagaacatgtgccccagcatgaacctgttcagccacggcaccagaatgcagatcatctgctgcagaaaccagagcttctgcaacaagatctag

SEQ ID NO: 71458 - DNA, 741 bp, Artificial Sequence
  Description of Artificial Sequence: Synthetic coding sequence
atgaacagattcctgctgctgatgagcctgtacctgctgggcagcgccagaggcaccagcagccagcccaacgagctgagcggcagcatcgaccaccagaccagcgtgcagcagctgcccggcgagttcttcagcctggagaaccccagcgacgccgaggccctgtacgagaccagcagcggcctgaacaccctgagcgagcacggcagcagcgagcacggcagcagcaagcacaccgtggccgagcacaccagcggcgagcacgccgagagcgagcacgccagcggcgagcccgccgccaccgagcacgccgagggcgagcacaccgtgggcgagcagcccagcggcgagcagcccagcggcgagcacctgagcggcgagcagcccctgagcgagctggagagcggcgagcagcccagcgacgagcagcccagcggcgagcacggcagcggcgagcagcccagcggcgagcaggccagcggcgagcagcccagcggcaccatcctgaactgctacacctgcgcctacatgaacgaccagggcaagtgcctgagaggcgagggcacctgcatcacccagaacagccagcagtgcatgctgaagaagatcttcgagggcggcaagctgcagttcatggtgcagggctgcgagaacatgtgccccagcatgaacctgttcagccacggcaccagaatgcagatcatctgctgcagaaaccagagcttctgcaacaagatctag

SEQ ID NO: 71459 - DNA, 468 bp, Artificial Sequence
  Description of Artificial Sequence: Synthetic coding sequence
atgaacagattcctgctgctgatgagcctgtacctgctgggcagcgccagaggcaccagcagccagcccaacgagctgagcggcagcatcgaccaccagaccagcgtgcagcagctgcccggcgagcagcccagcggcgagcagcccagcggcgagcacctgagcggcgagcagcccctgagcgagctggagagcggcgagcagcccagcgacgagcagcccagcggcgagcacggcagcggcgagcagcccagcggcgagcaggccagcggcgagcagcccagcggcgagcacgccagcggcgagcaggccagcggcgcccccatcagcagcaccagcaccggcggcaagctgcagttcatggtgcagggctgcgagaacatgtgccccagcatgaacctgttcagccacggcaccagaatgcagatcatctgctgcagaaaccagagcttctgcaacaagatctag

SEQ ID NO: 71460 - DNA, 498 bp, Artificial Sequence
  Description of Artificial Sequence: Synthetic coding sequence
atgaacagattcctgctgctgatgagcctgtacctgctgggcagcgccagaggcaccagcagccagcccaacgagctgagcggcagcatcgaccaccagaccagcgtgcagcagctgcccggcgagcccgccgccaccgagcacgccgagggcgagcacaccgtgggcgagcagcccagcggcgagcagcccagcggcgagcacgccagcggcgagcaggccagcggcgcccccatcagcagcaccagcaccggcaccatcctgaactgctacacctgcgcctacatgaacgaccagggcaagtgcctgagaggcgagggcacctgcatcacccagaacagccagcagtgcatgctgaagaagatcttcgagggcggcaagctgcagttcatggtgcagggctgcgagaacatgtgccccagcatgaacctgttcagccacggcaccagaatgcagatcatctgctgcagaaaccagagcttctgcaacaagatctag

SEQ ID NO: 71461 - DNA, 246 bp, Artificial Sequence
  Description of Artificial Sequence: Synthetic coding sequence
atgaacagattcctgctgctgatgagcctgtacctgctgggcagcgccagaggcaccagcagccagcccaacgagctgagcggcagcatcgaccaccagaccagcgtgcagcagctgcccggcggcaagctgcagttcatggtgcagggctgcgagaacatgtgccccagcatgaacctgttcagccacggcaccagaatgcagatcatctgctgcagaaaccagagcttctgcaacaagatctag

SEQ ID NO: 71462 - DNA, 366 bp, Artificial Sequence
  Description of Artificial Sequence: Synthetic coding sequence
atgaacagattcctgctgctgatgagcctgtacctgctgggcagcgccagaggcaccagcagccagcccaacgagctgagcggcagcatcgaccaccagaccagcgtgcagcagctgcccggcaccatcctgaactgctacacctgcgcctacatgaacgaccagggcaagtgcctgagaggcgagggcacctgcatcacccagaacagccagcagtgcatgctgaagaagatcttcgagggcggcaagctgcagttcatggtgcagggctgcgagaacatgtgccccagcatgaacctgttcagccacggcaccagaatgcagatcatctgctgcagaaaccagagcttctgcaacaagatctag

SEQ ID NO: 71463 - DNA, 588 bp, Artificial Sequence
  Description of Artificial Sequence: Synthetic coding sequence
atgaacagattcctgctgctgatgagcctgtacctgctgggcagcgccagaggcaccagcagccagcccaacgagctgagcggcagcatcgaccaccagaccagcgtgcagcagctgcccggcgagcagcccagcggcgagcagcccagcggcgagcacctgagcggcgagcagcccctgagcgagctggagagcggcgagcagcccagcgacgagcagcccagcggcgagcacggcagcggcgagcagcccagcggcgagcaggccagcggcgagcagcccagcggcgagcacgccagcggcgagcaggccagcggcgcccccatcagcagcaccagcaccggcaccatcctgaactgctacacctgcgcctacatgaacgaccagggcaagtgcctgagaggcgagggcacctgcatcacccagaacagccagcagtgcatgctgaagaagatcttcgagggcggcaagctgcagttcatggtgcagggctgcgagaacatgtgccccagcatgaacctgttcagccacggcaccagaatgcagatcatctgctgcagaaaccagagcttctgcaacaagatctag

SEQ ID NO: 71464 - DNA, 741 bp, Artificial Sequence; identical to SEQ ID NO: 71458
  Description of Artificial Sequence: Synthetic coding sequence

SEQ ID NO: 71465 - DNA, 513 bp, Artificial Sequence
  Description of Artificial Sequence: Synthetic coding sequence
atgaacagattcctgctgctgatgagcctgtacctgctgggcagcgccagaggcaccagcagccagcccaacgagctgagcggcagcatcgaccaccagaccagcgtgcagcagctgcccggcgagcagcccagcgacgagcagcccagcggcgagcacggcagcggcgagcagcccagcggcgagcaggccagcggcgagcagcccagcggcgagcacgccagcggcgagcaggccagcggcgcccccatcagcagcaccagcaccggcaccatcctgaactgctacacctgcgcctacatgaacgaccagggcaagtgcctgagaggcgagggcacctgcatcacccagaacagccagcagtgcatgctgaagaagatcttcgagggcggcaagctgcagttcatggtgcagggctgcgagaacatgtgccccagcatgaacctgttcagccacggcaccagaatgcagatcatctgctgcagaaaccagagcttctgcaacaagatctag

SEQ ID NO: 71466 - DNA, 531 bp, Artificial Sequence
  Description of Artificial Sequence: Synthetic coding sequence
atgaacagattcctgctgctgatgagcctgtacctgctgggcagcgccagaggcaccagcagccagcccaacgagctgagcggcagcatcgaccaccagaccagcgtgcagcagctgcccggcgagcagcccagcggcgagcagcccagcggcgagcacctgagcggcgagcagcccctgagcgagctggagagcggcgagcagcccagcgacgagcagcccagcggcgagcacggcagcggcgagcagcccagcggcgagcaggccagcggcgagcagcccagcggcaccatcctgaactgctacacctgcgcctacatgaacgaccagggcaagtgcctgagaggcgagggcacctgcatcacccagaacagccagcagtgcatgctgaagaagatcttcgagggcggcaagctgcagttcatggtgcagggctgcgagaacatgtgccccagcatgaacctgttcagccacggcaccagaatgcagatcatctgctgcagaaaccagagcttctgcaacaagatctag

SEQ ID NO: 71467 - DNA, 588 bp, Artificial Sequence; identical to SEQ ID NO: 71463
  Description of Artificial Sequence: Synthetic coding sequence

SEQ ID NO: 71468 - DNA, 633 bp, Artificial Sequence; identical to SEQ ID NO: 71457
  Description of Artificial Sequence: Synthetic coding sequence

SEQ ID NO: 71469 - DNA, 798 bp, Artificial Sequence
  Description of Artificial Sequence: Synthetic coding sequence
atgaacagattcctgctgctgatgagcctgtacctgctgggcagcgccagaggcaccagcagccagcccaacgagctgagcggcagcatcgaccaccagaccagcgtgcagcagctgcccggcgagttcttcagcctggagaaccccagcgacgccgaggccctgtacgagaccagcagcggcctgaacaccctgagcgagcacggcagcagcgagcacggcagcagcaagcacaccgtggccgagcacaccagcggcgagcacgccgagagcgagcacgccagcggcgagcccgccgccaccgagcacgccgagggcgagcacaccgtgggcgagcagcccagcggcgagcagcccagcggcgagcacctgagcggcgagcagcccctgagcgagctggagagcggcgagcagcccagcgacgagcagcccagcggcgagcacggcagcggcgagcagcccagcggcgagcaggccagcggcgagcagcccagcggcgagcacgccagcggcgagcaggccagcggcgcccccatcagcagcaccagcaccggcaccatcctgaactgctacacctgcgcctacatgaacgaccagggcaagtgcctgagaggcgagggcacctgcatcacccagaacagccagcagtgcatgctgaagaagatcttcgagggcggcaagctgcagttcatggtgcagggctgcgagaacatgtgccccagcatgaacctgttcagccacggcaccagaatgcagatcatctgctgcagaaaccagagcttctgcaacaagatctag

SEQ ID NO: 71470 - DNA, 1722 bp, Artificial Sequence
  Description of Artificial Sequence: Synthetic coding sequence
atgagcgccgtgagccagccccaggccgcccccagccccctggagaagagccccagcaccgccatcctgtgcaacacctgcggcaacgtgtgcaagggcgaggtgctgagagtgcaggacaagtacttccacatcaagtgcttcgtgtgcaaggcctgcggctgcgacctggccgagggcggcttcttcgtgagacagggcgagtacatctgcaccctggactaccagagactgtacggcaccagatgcttcagctgcgaccagttcatcgagggcgaggtggtgagcgccctgggcaagacctaccaccccgactgcttcgtgtgcgccgtgtgcagactgcccttcccccccggcgacagagtgaccttcaacggcaaggagtgcatgtgccagaagtgcagcctgcccgtgagcgtgggcagcagcgcccacctgagccagggcctgagaagctgcggcggctgcggcaccgagatcaagaacggccaggccctggtggccctggacaagcactggcacctgggctgcttcaagtgcaagagctgcggcaagctgctgaacgccgagtacatcagcaaggacggcctgccctactgcgaggccgactaccacgccaagttcggcatcagatgcgacagctgcgagaagtacatcaccggcagagtgctggaggccggcgagaagcactaccaccccagctgcgccctgtgcgtgagatgcggccagatgttcgccgagggcgaggagatgtacctgcagggcagcagcatctggcaccccgcctgcagacaggccgccagaaccgaggacagaaacaaggagaccagaaccagcagcgagagcatcatcagcgtgcccgccagcagcaccagcggcagccccagcagagtgatctacgccaagctgggcggcgagatcctggactacagagacctggccgccctgcccaagagcaaggccatctacgacatcgacagacccgacatgatcagctacagcccctacatcagccacagcgccggcgacagacagagctacggcgagggcgaccaggacgacagaagctacaagcagtgcagaaccagcagccccagcagcaccggcagcgtgagcctgggcagatacacccccaccagcagaagcccccagcactacagcagacccggcagcgagagcggcagaagcacccccagcctgagcgtgctgagcgacagcaagcccccccccagcacctaccagcaggcccccagacacttccacgtgcccgacaccggcgtgaaggacaacatctacagaaagccccccatctacagacagcacgccgccagaagaagcgacggcgaggacggcagcctggaccaggacaacagaaagcagaagagcagctggctgatgctgaagggcgacgccgacaccagaaccaacagccccgacctggacacccagagcctgagccacagcagcggcaccgacagagaccccctgcagagaatggccggcgacagcttccacagcagagagaagatctacccctacgacagcctgatcgtgaccaacagaatcagagtgaagctgcccaaggacgtggacagaaccagactggagagacacctgagccccgaggagttccaggaggtgttcggcatgagcatcgaggagttcgacagactggccctgtggaagagaaacgacctgaagaagaaggccctgctgttctag

SEQ ID NO: 71471 - DNA, 1041 bp, Artificial Sequence
  Description of Artificial Sequence: Synthetic coding sequence
atgttcgccgagggcgaggagatgtacctgcagggcagcagcatctggcaccccgcctgcagacaggccgccagaaccgaggacagaaacaaggagaccagaaccagcagcgagagcatcatcagcgtgcccgccagcagcaccagcggcagccccagcagagtgatctacgccaagctgggcggcgagatcctggactacagagacctggccgccctgcccaagagcaaggccatctacgacatcgacagacccgacatgatcagctacagcccctacatcagccacagcgccggcgacagacagagctacggcgagagcccccagctgctgagccccacccccaccgagggcgaccaggacgacagaagctacaagcagtgcagaaccagcagccccagcagcaccggcagcgtgagcctgggcagatacacccccaccagcagaagcccccagcactacagcagacccgacaccggcgtgaaggacaacatctacagaaagccccccatctacagacagcacgccgccagaagaagcgacggcgaggacggcagcctggaccaggacaacagaaagcagaagagcagctggctgatgctgaagggcgacgccgacaccagaaccaacagccccgacctggacacccagagcctgagccacagcagcggcaccgacagagaccccctgcagagaatggccggcgacagcttccacagcagattcccctacagcaagagcgaccccctgcccggccacggcaagaacggcctggaccagagaaacgccaacctggccccctgcggcgccgaccccgacgccagctggggcatgagagagtacaagatctacccctacgacagcctgatcgtgaccaacagaatcagagtgaagctgcccaaggacgtggacagaaccagactggagagacacctgagccccgaggagttccaggaggtgttcggcatgagcatcgaggagttcgacagactggccctgtggaagagaaacgacctgaagaagaaggccctgctgttctag

SEQ ID NO: 71472 - DNA, 1836 bp, Artificial Sequence
  Description of Artificial Sequence: Synthetic coding sequence
atgagcgccgtgagccagccccaggccgcccccagccccctggagaagagccccagcaccgccatcctgtgcaacacctgcggcaacgtgtgcaagggcgaggtgctgagagtgcaggacaagtacttccacatcaagtgcttcgtgtgcaaggcctgcggctgcgacctggccgagggcggcttcttcgtgagacagggcgagtacatctgcaccctggactaccagagactgtacggcaccagatgcttcagctgcgaccagttcatcgagggcgaggtggtgagcgccctgggcaagacctaccaccccgactgcttcgtgtgcgccgtgtgcagactgcccttcccccccggcgacagagtgaccttcaacggcaaggagtgcatgtgccagaagtgcagcctgcccgtgagcgtgggcagcagcgcccacctgagccagggcctgagaagctgcggcggctgcggcaccgagatcaagaacggccaggccctggtggccctggacaagcactggcacctgggctgcttcaagtgcaagagctgcggcaagctgctgaacgccgagtacatcagcaaggacggcctgccctactgcgaggccgactaccacgccaagttcggcatcagatgcgacagctgcgagaagtacatcaccggcagagtgctggaggccggcgagaagcactaccaccccagctgcgccctgtgcgtgagatgcggccagatgttcgccgagggcgaggagatgtacctgcagggcagcagcatctggcaccccgcctgcagacaggccgccagaaccgaggacagaaacaaggagaccagaaccagcagcgagagcatcatcagcgtgcccgccagcagcaccagcggcagccccagcagagtgatctacgccaagctgggcggcgagatcctggactacagagacctggccgccctgcccaagagcaaggccatctacgacatcgacagacccgacatgatcagctacagcccctacatcagccacagcgccggcgacagacagagctacggcgagggcgaccaggacgacagaagctacaagcagtgcagaaccagcagccccagcagcaccggcagcgtgagcctgggcagatacacccccaccagcagaagcccccagcactacagcagacccggcagcgagagcggcagaagcacccccagcctgagcgtgctgagcgacagcaagcccccccccagcacctaccagcaggcccccagacacttccacgtgcccgacaccggcgtgaaggacaacatctacagaaagccccccatctacagacagcacgccgccagaagaagcgacggcgaggacggcagcctggaccaggacaacagaaagaagagcagctggctgatgctgaagggcgacgccgacaccagaaccaacagccccgacctggacacccagagcctgagccacagcagcggcaccgacagagaccccctgcagagaatggccggcgacagcttccacagcagattcccctacagcaagagcgaccccctgcccggccacggcaagaacggcctggaccagagaaacgccaacctggccccctgcggcgccgaccccgacgccagctggggcatgagagagtacaagatctacccctacgacagcctgatcgtgaccaacagaatcagagtgaagctgcccaaggacgtggacagaaccagactggagagacacctgagccccgaggagttccaggaggtgttcggcatgagcatcgaggagttcgacagactggccctgtggaagagaaacgacctgaagaagaaggccctgctgttctag

SEQ ID NO: 71473 - DNA, 1719 bp, Artificial Sequence
  Description of Artificial Sequence: Synthetic coding sequence
atgagcgccgtgagccagccccaggccgcccccagccccctggagaagagccccagcaccgccatcctgtgcaacacctgcggcaacgtgtgcaagggcgaggtgctgagagtgcaggacaagtacttccacatcaagtgcttcgtgtgcaaggcctgcggctgcgacctggccgagggcggcttcttcgtgagacagggcgagtacatctgcaccctggactaccagagactgtacggcaccagatgcttcagctgcgaccagttcatcgagggcgaggtggtgagcgccctgggcaagacctaccaccccgactgcttcgtgtgcgccgtgtgcagactgcccttcccccccggcgacagagtgaccttcaacggcaaggagtgcatgtgccagaagtgcagcctgcccgtgagcgtgggcagcagcgcccacctgagccagggcctgagaagctgcggcggctgcggcaccgagatcaagaacggccaggccctggtggccctggacaagcactggcacctgggctgcttcaagtgcaagagctgcggcaagctgctgaacgccgagtacatcagcaaggacggcctgccctactgcgaggccgactaccacgccaagttcggcatcagatgcgacagctgcgagaagtacatcaccggcagagtgctggaggccggcgagaagcactaccaccccagctgcgccctgtgcgtgagatgcggccagatgttcgccgagggcgaggagatgtacctgcagggcagcagcatctggcaccccgcctgcagacaggccgccagaaccgaggacagaaacaaggagaccagaaccagcagcgagagcatcatcagcgtgcccgccagcagcaccagcggcagccccagcagagtgatctacgccaagctgggcggcgagatcctggactacagagacctggccgccctgcccaagagcaaggccatctacgacatcgacagacccgacatgatcagctacagcccctacatcagccacagcgccggcgacagacagagctacggcgagggcgaccaggacgacagaagctacaagcagtgcagaaccagcagccccagcagcaccggcagcgtgagcctgggcagatacacccccaccagcagaagcccccagcactacagcagacccggcagcgagagcggcagaagcacccccagcctgagcgtgctgagcgacagcaagcccccccccagcacctaccagcaggcccccagacacttccacgtgcccgacaccggcgtgaaggacaacatctacagaaagccccccatctacagacagcacgccgccagaagaagcgacggcgaggacggcagcctggaccaggacaacagaaagaagagcagctggctgatgctgaagggcgacgccgacaccagaaccaacagccccgacctggacacccagagcctgagccacagcagcggcaccgacagagaccccctgcagagaatggccggcgacagcttccacagccagtacaagatctacccctacgacagcctgatcgtgaccaacagaatcagagtgaagctgcccaaggacgtggacagaaccagactggagagacacctgagccccgaggagttccaggaggtgttcggcatgagcatcgaggagttcgacagactggccctgtggaagagaaacgacctgaagaagaaggccctgctgttctag

SEQ ID NO: 71474 - DNA, 1596 bp, Artificial Sequence
  Description of Artificial Sequence: Synthetic coding sequence
atgagcgccgtgagccagccccaggccgcccccagccccctggagaagagccccagcaccgccatcctgtgcaacacctgcggcaacgtgtgcaagggcgaggtgctgagagtgcaggacaagtacttccacatcaagtgcttcgtgtgcaaggcctgcggctgcgacctggccgagggcggcttcttcgtgagacagggcgagtacatctgcaccctggactaccagagactgtacggcaccagatgcttcagctgcgaccagttcatcgagggcgaggtggtgagcgccctgggcaagacctaccaccccgactgcttcgtgtgcgccgtgtgcagactgcccttcccccccggcgacagagtgaccttcaacggcaaggagtgcatgtgccagaagtgcagcctgcccgtgagcgtgggcagcagcgcccacctgagccagggcctgagaagctgcggcggctgcggcaccgagatcaagaacggccaggccctggtggccctggacaagcactggcacctgggctgcttcaagtgcaagagctgcggcaagctgctgaacgccgagtacatcagcaaggacggcctgccctactgcgaggccgactaccacgccaagttcggcatcagatgcgacagctgcgagaagtacatcaccggcagagtgctggaggccggcgagaagcactaccaccccagctgcgccctgtgcgtgagatgcggccagatgttcgccgagggcgaggagatgtacctgcagggcagcagcatctggcaccccgcctgcagacaggccgccagaaccgaggacagaaacaaggagaccagaaccagcagcgagagcatcatcagcgtgcccgccagcagcaccagcggcagccccagcagagtgatctacgccaagctgggcggcgagatcctggactacagagacctggccgccctgcccaagagcaaggccatctacgacatcgacagacccgacatgatcagctacagcccctacatcagccacagcgccggcgacagacagagctacggcgagagcccccagctgctgagccccacccccaccgagggcgaccaggacgacagaagctacaagcagtgcagaaccagcagccccagcagcaccggcagcgtgagcctgggcagatacacccccaccagcagaagcccccagcactacagcagacccgccgccagaagaagcgacggcgaggacggcagcctggaccaggacaacagaaagaagagcagctggctgatgctgaagggcgacgccgacaccagaaccaacagccccgacctggacacccagagcctgagccacagcagcggcaccgacagagaccccctgcagagaatggccggcgacagcttccacagccagtacaagatctacccctacgacagcctgatcgtgaccaacagaatcagagtgaagctgcccaaggacgtggacagaaccagactggagagacacctgagccccgaggagttccaggaggtgttcggcatgagcatcgaggagttcgacagactggccctgtggaagagaaacgacctgaagaagaaggccctgctgttctag

SEQ ID NO: 71475 - DNA, 1935 bp, Artificial Sequence
  Description of Artificial Sequence: Synthetic coding sequence
atgagcgccgtgagccagccccaggccgcccccagccccctggagaagagccccagcaccgccatcctgtgcaacacctgcggcaacgtgtgcaagggcgaggtgctgagagtgcaggacaagtacttccacatcaagtgcttcgtgtgcaaggcctgcggctgcgacctggccgagggcggcttcttcgtgagacagggcgagtacatctgcaccctggactaccagagactgtacggcaccagatgcttcagctgcgaccagttcatcgagggcgaggtggtgagcgccctgggcaagacctaccaccccgactgcttcgtgtgcgccgtgtgcagactgcccttcccccccggcgacagagtgaccttcaacggcaaggagtgcatgtgccagaagtgcagcctgcccgtgagcgtgggcagcagcgcccacctgagccagggcctgagaagctgcggcggctgcggcaccgagatcaagaacggccaggccctggtggccctggacaagcactggcacctgggctgcttcaagtgcaagagctgcggcaagctgctgaacgccgagtacatcagcaaggacggcctgccctactgcgaggccgactaccacgccaagttcggcatcagatgcgacagctgcgagaagtacatcaccggcagagtgctggaggccggcgagaagcactaccaccccagctgcgccctgtgcgtgagatgcggccagatgttcgccgagggcgaggagatgtacctgcagggcagcagcatctggcaccccgcctgcagacaggccgccagaaccgaggacagaaacaaggagaccagaaccagcagcgagagcatcatcagcgtgcccgccagcagcaccagcggcagccccagcagagtgatctacgccaagctgggcggcgagatcctggactacagagacctggccgccctgcccaagagcaaggccatctacgacatcgacagacccgacatgatcagctacagcccctacatcagccacagcgccggcgacagacagagctacggcgagggcgaccaggacgacagaagctacaagcagtgcagaaccagcagccccagcagcaccggcagcgtgagcctgggcagatacacccccaccagcagaagcccccagcactacagcagacccgccggcaccgtgagcgtgggcaccagcagctgcctgagcctgagccagcaccccagccccaccagcgtgttcagacaccactacatcccctacttcagaggcagcgagagcggcagaagcacccccagcctgagcgtgctgagcgacagcaagcccccccccccccccaccagcagacacctggccacccacgtgcccgacaccggcgtgaaggacaacatctacagaaagccccccatctacagacagcacgccgccagaagaagcgacggcgaggacggcagcctggaccaggacaacagaaagcagaagagcagctggctgatgctgaagggcgacgccgacaccagaaccaacagccccgacctggacacccagagcctgagccacagcagcggcaccgacagagaccccctgcagagaatggccggcgacagcttccacagcagattcccctacagcaagagcgaccccctgcccggccacggcaagaacggcctggaccagagaaacgccaacctggccccctgcggcgccgaccccgacgccagctggggcatgagagagtacaagatctacccctacgacagcctgatcgtgaccaacagaatcagagtgaagctgcccaaggacgtggacagaaccagactggagagacacctgagccccgaggagttccaggaggtgttcggcatgagcatcgaggagttcgacagactggccctgtggaagagaaacgacctgaagaagaaggccctgctgttctag

SEQ ID NO: 71476 - DNA, 1566 bp, Artificial Sequence
  Description of Artificial Sequence: Synthetic coding sequence
atgagcgccgtgagccagccccaggccgcccccagccccctggagaagagccccagcaccgccatcctgtgcaacacctgcggcaacgtgtgcaagggcgaggtgctgagagtgcaggacaagtacttccacatcaagtgcttcgtgtgcaaggcctgcggctgcgacctggccgagggcggcttcttcgtgagacagggcgagtacatctgcaccctggactaccagagactgtacggcaccagatgcttcagctgcgaccagttcatcgagggcgaggtggtgagcgccctgggcaagacctaccaccccgactgcttcgtgtgcgccgtgtgcagactgcccttcccccccggcgacagagtgaccttcaacggcaaggagtgcatgtgccagaagtgcagcctgcccgtgagcgtgggcagcagcgcccacctgagccagggcctgagaagctgcggcggctgcggcaccgagatcaagaacggccaggccctggtggccctggacaagcactggcacctgggctgcttcaagtgcaagagctgcggcaagctgctgaacgccgagtacatcagcaaggacggcctgccctactgcgaggccgactaccacgccaagttcggcatcagatgcgacagctgcgagaagtacatcaccggcagagtgctggaggccggcgagaagcactaccaccccagctgcgccctgtgcgtgagatgcggccagatgttcgccgagggcgaggagatgtacctgcagggcagcagcatctggcaccccgcctgcagacaggccgccagaaccgaggacagaaacaaggagaccagaaccagcagcgagagcatcatcagcgtgcccgccagcagcaccagcggcagccccagcagagtgatctacgccaagctgggcggcgagatcctggactacagagacctggccgccctgcccaagagcaaggccatctacgacatcgacagacccgacatgatcagctacagcccctacatcagccacagcgccggcgacagacagagctacggcgagggcgaccaggacgacagaagctacaagcagtgcagaaccagcagccccagcagcaccggcagcgtgagcctgggcagatacacccccaccagcagaagcccccagcactacagcagacccgccgccagaagaagcgacggcgaggacggcagcctggaccaggacaacagaaagcagaagagcagctggctgatgctgaagggcgacgccgacaccagaaccaacagccccgacctggacacccagagcctgagccacagcagcggcaccgacagagaccccctgcagagaatggccggcgacagcttccacagccagtacaagatctacccctacgacagcctgatcgtgaccaacagaatcagagtgaagctgcccaaggacgtggacagaaccagactggagagacacctgagccccgaggagttccaggaggtgttcggcatgagcatcgaggagttcgacagactggccctgtggaagagaaacgacctgaagaagaaggccctgctgttctag

SEQ ID NO: 71477 - DNA, 1413 bp, Artificial Sequence
  Description of Artificial Sequence: Synthetic coding sequence
atgagcgccgtgagccagccccaggccgcccccagccccctggagaagagccccagcaccgccatcctgtgcaacacctgcggcaacgtgtgcaagggcgaggtgctgagagtgcaggacaagtacttccacatcaagtgcttcgtgtgcaaggcctgcggctgcgacctggccgagggcggcttcttcgtgagacagggcgagtacatctgcaccctggactaccagagactgtacggcaccagatgcttcagctgcgaccagttcatcgagggcgaggtggtgagcgccctgggcaagacctaccaccccgactgcttcgtgtgcgccgtgtgcagactgcccttcccccccggcgacagagtgaccttcaacggcaaggagtgcatgtgccagaagtgcagcctgcccgtgagcgtgggcagcagcgcccacctgagccagggcctgagaagctgcggcggctgcggcaccgagatcaagaacggccaggccctggtggccctggacaagcactggcacctgggctgcttcaagtgcaagagctgcggcaagctgctgaacgccgagtacatcagcaaggacggcctgccctactgcgaggccgactaccacgccaagttcggcatcagatgcgacagctgcgagaagtacatcaccggcagagtgctggaggccggcgagaagcactaccaccccagctgcgccctgtgcgtgagatgcggccagatgttcgccgagggcgaggagatgtacctgcagggcagcagcatctggcaccccgcctgcagacaggccgccagaaccgaggacagaaacaaggagaccagaaccagcagcgagagcatcatcagcgtgcccgccagcagcaccagcggcagccccagcagagtgatctacgccaagctgggcggcgagatcctggactacagagacctggccgccctgcccaagagcaaggccatctacgacatcgacagacccgacatgatcagctacagcccctacatcagccacagcgccggcgacagacagagctacggcgagagcccccagctgctgagccccacccccaccgagggcgaccaggacgacagaagctacaagcagtgcagaaccagcagccccagcagcaccggcagcgtgagcctgggcagatacacccccaccagcagaagcccccagcactacagcagacccgccgccagaagaagcgacggcgaggacggcagcctggaccaggacaacagaaagcagaagagcagctggctgatgctgaagggcgacgccgacaccagaaccaacagccccgacctggacacccagagcctgagccacagcagcggcaccgacagagaccccctgcagagaatggccggcgacagcttccacagcagagagtggttcttctag

SEQ ID NO: 71478 - DNA, 1938 bp, Artificial Sequence
  Description of Artificial Sequence: Synthetic coding sequence
atgagcgccgtgagccagccccaggccgcccccagccccctggagaagagccccagcaccgccatcctgtgcaacacctgcggcaacgtgtgcaagggcgaggtgctgagagtgcaggacaagtacttccacatcaagtgcttcgtgtgcaaggcctgcggctgcgacctggccgagggcggcttcttcgtgagacagggcgagtacatctgcaccctggactaccagagactgtacggcaccagatgcttcagctgcgaccagttcatcgagggcgaggtggtgagcgccctgggcaagacctaccaccccgactgcttcgtgtgcgccgtgtgcagactgcccttcccccccggcgacagagtgaccttcaacggcaaggagtgcatgtgccagaagtgcagcctgcccgtgagcgtgggcagcagcgcccacctgagccagggcctgagaagctgcggcggctgcggcaccgagatcaagaacggccaggccctggtggccctggacaagcactggcacctgggctgcttcaagtgcaagagctgcggcaagctgctgaacgccgagtacatcagcaaggacggcctgccctactgcgaggccgactaccacgccaagttcggcatcagatgcgacagctgcgagaagtacatcaccggcagagtgctggaggccggcgagaagcactaccaccccagctgcgccctgtgcgtgagatgcggccagatgttcgccgagggcgaggagatgtacctgcagggcagcagcatctggcaccccgcctgcagacaggccgccagaaccgaggacagaaacaaggagaccagaaccagcagcgagagcatcatcagcgtgcccgccagcagcaccagcggcagccccagcagagtgatctacgccaagctgggcggcgagatcctggactacagagacctggccgccctgcccaagagcaaggccatctacgacatcgacagacccgacatgatcagctacagcccctacatcagccacagcgccggcgacagacagagctacggcgagggcgaccaggacgacagaagctacaagcagtgcagaaccagcagccccagcagcaccggcagcgtgagcctgggcagatacacccccaccagcagaagcccccagcactacagcagacccgccggcaccgtgagcgtgggcaccagcagctgcctgagcctgagccagcaccccagccccaccagcgtgttcagacaccactacatcccctacttcagaggcagcgagagcggcagaagcacccccagcctgagcgtgctgagcgacagcaagcccccccccagcacctaccagcaggcccccagacacttccacgtgcccgacaccggcgtgaaggacaacatctacagaaagccccccatctacagacagcacgccgccagaagaagcgacggcgaggacggcagcctggaccaggacaacagaaagcagaagagcagctggctgatgctgaagggcgacgccgacaccagaaccaacagccccgacctggacacccagagcctgagccacagcagcggcaccgacagagaccccctgcagagaatggccggcgacagcttccacagcagattcccctacagcaagagcgaccccctgcccggccacggcaagaacggcctggaccagagaaacgccaacctggccccctgcggcgccgaccccgacgccagctggggcatgagagagtacaagatctacccctacgacagcctgatcgtgaccaacagaatcagagtgaagctgcccaaggacgtggacagaaccagactggagagacacctgagccccgaggagttccaggaggtgttcggcatgagcatcgaggagttcgacagactggccctgtggaagagaaacgacctgaagaagaaggccctgctgttctag

SEQ ID NO: 71479 - DNA, 1680 bp, Artificial Sequence
  Description of Artificial Sequence: Synthetic coding sequence
atgagcgccgtgagccagccccaggccgcccccagccccctggagaagagccccagcaccgccatcctgtgcaacacctgcggcaacgtgtgcaagggcgaggtgctgagagtgcaggacaagtacttccacatcaagtgcttcgtgtgcaaggcctgcggctgcgacctggccgagggcggcttcttcgtgagacagggcgagtacatctgcaccctggactaccagagactgtacggcaccagatgcttcagctgcgaccagttcatcgagggcgaggtggtgagcgccctgggcaagacctaccaccccgactgcttcgtgtgcgccgtgtgcagactgcccttcccccccggcgacagagtgaccttcaacggcaaggagtgcatgtgccagaagtgcagcctgcccgtgagcgtgggcagcagcgcccacctgagccagggcctgagaagctgcggcggctgcggcaccgagatcaagaacggccaggccctggtggccctggacaagcactggcacctgggctgcttcaagtgcaagagctgcggcaagctgctgaacgccgagtacatcagcaaggacggcctgccctactgcgaggccgactaccacgccaagttcggcatcagatgcgacagctgcgagaagtacatcaccggcagagtgctggaggccggcgagaagcactaccaccccagctgcgccctgtgcgtgagatgcggccagatgttcgccgagggcgaggagatgtacctgcagggcagcagcatctggcaccccgcctgcagacaggccgccagaaccgaggacagaaacaaggagaccagaaccagcagcgagagcatcatcagcgtgcccgccagcagcaccagcggcagccccagcagagtgatctacgccaagctgggcggcgagatcctggactacagagacctggccgccctgcccaagagcaaggccatctacgacatcgacagacccgacatgatcagctacagcccctacatcagccacagcgccggcgacagacagagctacggcgagggcgaccaggacgacagaagctacaagcagtgcagaaccagcagccccagcagcaccggcagcgtgagcctgggcagatacacccccaccagcagaagcccccagcactacagcagacccgccgccagaagaagcgacggcgaggacggcagcctggaccaggacaacagaaagaagagcagctggctgatgctgaagggcgacgccgacaccagaaccaacagccccgacctggacacccagagcctgagccacagcagcggcaccgacagagaccccctgcagagaatggccggcgacagcttccacagcagattcccctacagcaagagcgaccccctgcccggccacggcaagaacggcctggaccagagaaacgccaacctggccccctgcggcgccgaccccgacgccagctggggcatgagagagtacaagatctacccctacgacagcctgatcgtgaccaacagaatcagagtgaagctgcccaaggacgtggacagaaccagactggagagacacctgagccccgaggagttccaggaggtgttcggcatgagcatcgaggagttcgacagactggccctgtggaagagaaacgacctgaagaagaaggccctgctgttctag

SEQ ID NO: 71480 - DNA, 1041 bp, Artificial Sequence; identical to SEQ ID NO: 71471
  Description of Artificial Sequence: Synthetic coding sequence

SEQ ID NO: 71481 - DNA, 1716 bp, Artificial Sequence
  Description of Artificial Sequence: Synthetic coding sequence
atgagcgccgtgagccagccccaggccgcccccagccccctggagaagagccccagcaccgccatcctgtgcaacacctgcggcaacgtgtgcaagggcgaggtgctgagagtgcaggacaagtacttccacatcaagtgcttcgtgtgcaaggcctgcggctgcgacctggccgagggcggcttcttcgtgagacagggcgagtacatctgcaccctggactaccagagactgtacggcaccagatgcttcagctgcgaccagttcatcgagggcgaggtggtgagcgccctgggcaagacctaccaccccgactgcttcgtgtgcgccgtgtgcagactgcccttcccccccggcgacagagtgaccttcaacggcaaggagtgcatgtgccagaagtgcagcctgcccgtgagcgtgggcagcagcgcccacctgagccagggcctgagaagctgcggcggctgcggcaccgagatcaagaacggccaggccctggtggccctggacaagcactggcacctgggctgcttcaagtgcaagagctgcggcaagctgctgaacgccgagtacatcagcaaggacggcctgccctactgcgaggccgactaccacgccaagttcggcatcagatgcgacagctgcgagaagtacatcaccggcagagtgctggaggccggcgagaagcactaccaccccagctgcgccctgtgcgtgagatgcggccagatgttcgccgagggcgaggagatgtacctgcagggcagcagcatctggcaccccgcctgcagacaggccgccagaaccgaggacagaaacaaggagaccagaaccagcagcgagagcatcatcagcgtgcccgccagcagcaccagcggcagccccagcagagtgatctacgccaagctgggcggcgagatcctggactacagagacctggccgccctgcccaagagcaaggccatctacgacatcgacagacccgacatgatcagctacagcccctacatcagccacagcgccggcgacagacagagctacggcgagggcgaccaggacgacagaagctacaagcagtgcagaaccagcagccccagcagcaccggcagcgtgagcctgggcagatacacccccaccagcagaagcccccagcactacagcagacccggcagcgagagcggcagaagcacccccagcctgagcgtgctgagcgacagcaagcccccccccagcacctaccagcaggcccccagacacttccacgtgcccgacaccggcgtgaaggacaacatctacagaaagccccccatctacagacagcacgccgccagaagaagcgacggcgaggacggcagcctggaccaggacaacagaaagaagagcagctggctgatgctgaagggcgacgccgacaccagaaccaacagccccgacctggacacccagagcctgagccacagcagcggcaccgacagagaccccctgcagagaatggccggcgacagcttccacagccagcagatctacccctacgacagcctgatcgtgaccaacagaatcagagtgaagctgcccaaggacgtggacagaaccagactggagagacacctgagccccgaggagttccaggaggtgttcggcatgagcatcgaggagttcgacagactggccctgtggaagagaaacgacctgaagaagaaggccctgctgttctag

SEQ ID NO: 71482 - DNA, 1596 bp, Artificial Sequence
  Description of Artificial Sequence: Synthetic coding sequence
atgagcgccgtgagccagccccaggccgcccccagccccctggagaagagccccagcaccgccatcctgtgcaacacctgcggcaacgtgtgcaagggcgaggtgctgagagtgcaggacaagtacttccacatcaagtgcttcgtgtgcaaggcctgcggctgcgacctggccgagggcggcttcttcgtgagacagggcgagtacatctgcaccctggactaccagagactgtacggcaccagatgcttcagctgcgaccagttcatcgagggcgaggtggtgagcgccctgggcaagacctaccaccccgactgcttcgtgtgcgccgtgtgcagactgcccttcccccccggcgacagagtgaccttcaacggcaaggagtgcatgtgccagaagtgcagcctgcccgtgagcgtgggcagcagcgcccacctgagccagggcctgagaagctgcggcggctgcggcaccgagatcaagaacggccaggccctggtggccctggacaagcactggcacctgggctgcttcaagtgcaagagctgcggcaagctgctgaacgccgagtacatcagcaaggacggcctgccctactgcgaggccgactaccacgccaagttcggcatcagatgcgacagctgcgagaagtacatcaccggcagagtgctggaggccggcgagaagcactaccaccccagctgcgccctgtgcgtgagatgcggccagatgttcgccgagggcgaggagatgtacctgcagggcagcagcatctggcaccccgcctgcagacaggccgccagaaccgaggacagaaacaaggagaccagaaccagcagcgagagcatcatcagcgtgcccgccagcagcaccagcggcagccccagcagagtgatctacgccaagctgggcggcgagatcctggactacagagacctggccgccctgcccaagagcaaggccatctacgacatcgacagacccgacatgatcagctacagcccctacatcagccacagcgccggcgacagacagagctacggcgagagcccccagctgctgagccccacccccaccgagggcgaccaggacgacagaagctacaagcagtgcagaaccagcagccccagcagcaccggcagcgtgagcctgggcagatacacccccaccagcagaagcccccagcactacagcagacccgccgccagaagaagcgacggcgaggacggcagcctggaccaggacaacagaaagaagagcagctggctgatgctgaagggcgacgccgacaccagaaccaacagccccgacctggacacccagagcctgagccacagcagcggcaccgacagagaccccctgcagagaatggccggcgacagcttccacagcagagagcagatctacccctacgacagcctgatcgtgaccaacagaatcagagtgaagctgcccaaggacgtggacagaaccagactggagagacacctgagccccgaggagttccaggaggtgttcggcatgagcatcgaggagttcgacagactggccctgtggaagagaaacgacctgaagaagaaggccctgctgttctag

SEQ ID NO: 71483 - DNA, 2193 bp, Artificial Sequence
  Description of Artificial Sequence: Synthetic coding sequence
atggaggagctgatcgtggagctgagactgttcctggagctgctggaccacgagtacctgaccagcaccgtgagagagaagaaggccgtgatcaccaacatcctgctgagaatccagagcagcaagggcttcgacgtgaaggaccacgcccagaagcaggagaccgccaacagcctgcccgcccccccccagatgcccctgcccgagatcccccagccctggctgccccccgacagcggccccccccccctgcccaccagcagcctgcccgagggctactacgaggaggccgtgcccctgagccccggcaaggcccccgagtacatcaccagcaactacgacagcgacgccatgagcagcagctacgagagctacgacgaggaggaggaggacggcaagggcaagaagaccagacaccagtggcccagcgaggaggccagcatggacctggtgaaggacgccaagatctgcgccttcctgctgagaaagaagagattcggccagtggaccaagctgctgtgcgtgatcaaggacaccaagctgctgtgctacaagagcagcaaggaccagcagccccagatggagctgcccctgcagggctgcaacatcacctacatccccaaggacagcaagaagaagaagcacgagctgaagatcacccagcagggcaccgaccccctggtgctggccgtgcagagcaaggagcaggccgagcagtggctgaaggtgatcaaggaggcctacagcggctgcagcggccccgtggacagcgagtgcccccccccccccagcagccccgtgcacaaggccgagctggagaagaagctgagcagcgagagacccagcagcgacggcgagggcgtggtggagaacggcatcaccacctgcaacggcaaggagcaggtgaagagaaagaagagcagcaagagcgaggccaagggcaccgtgagcaaggtgaccggcaagaagatcaccaagatcatcagcctgggcaagaagaagcccagcaccgacgagcagaccagcagcgccgaggaggacgtgcccacctgcggctacctgaacgtgctgagcaacagcagatggagagagagatggtgcagagtgaaggacaacaagctgatcttccacaaggacagaaccgacctgaagacccacatcgtgagcatccccctgagaggctgcgaggtgatccccggcctggacagcaagcaccccctgaccttcagactgctgagaaacggccaggaggtggccgtgctggaggccagcagcagcgaggacatgggcagatggatcggcatcctgctggccgagaccggcagcagcaccgaccccgaggccctgcactacgactacatcgacgtggagatgagcgccagcgtgatccagaccgccaagcagaccttctgcttcatgaacagaagagtgatcagcgccaacccctacctgggcggcaccagcaacggctacgcccaccccagcggcaccgccctgcactacgacgacgtgccctgcatcaacggcagcctgaagggcaagaagccccccgtggccagcaacggcgtgaccggcaagggcaagaccctgagcagccagcccaagaaggccgaccccgccgccgtggtgaagagaaccggcagcaacgccgcccagtacaagtacggcaagaacagagtggaggccgacgccaagagactgcagaccaaggaggaggagctgctgaagagaaaggaggccctgagaaacagactggcccagctgagaaaggagagaaaggacctgagagccgccatcgaggtgaacgccggcagaaagccccaggccatcctggaggagaagctgaagcagctggaggaggagtgcagacagaaggaggccgagagagtgagcctggagctggagctgaccgaggtgaaggagagcctgaagaaggccctggccggcggcgtgaccctgggcctggccatcgagcccaagagcggcaccagcagcccccagagccccgtgttcagacacagaaccctggagaacagccccatcagcagctgcgacaccagcgacaccgagggccccgtgcccgtgaacagcgccgccgtgctgaagaagagccaggccgcccccggcagcagcccctgcagaggccacgtgctgagaaaggccaaggagtgggagctgaagaacggcacctag

SEQ ID NO: 71484 - DNA, 2193 bp, Artificial Sequence; identical to SEQ ID NO: 71483
  Description of Artificial Sequence: Synthetic coding sequence

SEQ ID NO: 71485 - DNA, 2445 bp, Artificial Sequence
  Description of Artificial Sequence: Synthetic coding sequence
atggaggagctgatcgtggagctgagactgttcctggagctgctggaccacgagtacctgaccagcaccgtgagagagaagaaggccgtgatcaccaacatcctgctgagaatccagagcagcaagggcttcgacgtgaaggaccacgcccagaagcaggagaccgccaacagcctgcccgcccccccccagatgcccctgcccgagatcccccagccctggctgccccccgacagcggccccccccccctgcccaccagcagcctgcccgagggctactacgaggaggccgtgcccctgagccccggcaaggcccccgagtacatcaccagcaactacgacagcgacgccatgagcagcagctacgagagctacgacgaggaggaggaggacggcaagggcaagaagaccagacaccagtggcccagcgaggaggccagcatggacctggtgaaggacgccaagatctgcgccttcctgctgagaaagaagagattcggccagtggaccaagctgctgtgcgtgatcaaggacaccaagctgctgtgctacaagagcagcaaggaccagcagccccagatggagctgcccctgcagggctgcaacatcacctacatccccaaggacagcaagaagaagaagcacgagctgaagatcacccagcagggcaccgaccccctggtgctggccgtgcagagcaaggagcaggccgagcagtggctgaaggtgatcaaggaggcctacagcggctgcagcggccccgtggacagcgagtgcccccccccccccagcagccccgtgcacaaggccgagctggagaagaagctgagcagcgagagacccagcagcgacggcgagggcgtggtggagaacggcatcaccacctgcaacggcaaggagcaggtgaagagaaagaagagcagcaagagcgaggccaagggcaccgtgagcaaggtgaccggcaagaagatcaccaagatcatcagcctgggcaagaagaagcccagcaccgacgagcagaccagcagcgccgaggaggacgtgcccacctgcggctacctgaacgtgctgagcaacagcagatggagagagagatggtgcagagtgaaggacaacaagctgatcttccacaaggacagaaccgacctgaagacccacatcgtgagcatccccctgagaggctgcgaggtgatccccggcctggacagcaagcaccccctgaccttcagactgctgagaaacggccaggaggtggccgtgctggaggccagcagcagcgaggacatgggcagatggatcggcatcctgctggccgagaccggcagcagcaccgaccccgaggccctgcactacgactacatcgacgtggagatgagcgccagcgtgatccagaccgccaagcagaccttctgcttcatgaacagaagagtgatcagcgccaacccctacctgggcggcaccagcaacggctacgcccaccccagcggcaccgccctgcactacgacgacgtgccctgcatcaacggcagctgggagcccgaggacggcttccccgccagctgcagcagaggcctgggcgaggaggtgctgtacgacaacgccggcctgtacgacaacctgccccccccccacatcttcgccagatacagccccgccgacagaaaggccagcagactgagcgccgacaagctgagcagcaaccactacaagtaccccgccagcgcccagagcgtgaccaacaccagcagcgtgggcagagccagcctgggcctgaacagccagctgaagggcaagaagccccccgtggccagcaacggcgtgaccggcaagggcaagaccctgagcagccagcccaagaaggccgaccccgccgccgtggtgaagagaaccggcagcaacgccgcccagtacaagtacggcaagaacagagtggaggccgacgccaagagactgcagaccaaggaggaggagctgctgaagagaaaggaggccctgagaaacagactggcccagctgagaaaggagagaaaggacctgagagccgccatcgaggtgaacgccggcagaaagccccaggccatcctggaggagaagctgaagcagctggaggaggagtgcagacagaaggaggccgagagagtgagcctggagctggagctgaccgaggtgaaggagagcctgaagaaggccctggccggcggcgtgaccctgggcctggccatcgagcccaagagcggcaccagcagcccccagagccccgtgttcagacacagaaccctggagaacagccccatcagcagctgcgacaccagcgacaccgagggccccgtgcccgtgaacagcgccgccgtgctgaagaagagccaggccgcccccggcagcagcccctgcagaggccacgtgctgagaaaggccaaggagtgggagctgaagaacggcacctag

SEQ ID NO: 71486 - DNA, 2307 bp, Artificial Sequence
  Description of Artificial Sequence: Synthetic coding sequence
atggacagaggccaggtgctggagcagctgctgcccgagctgaccggcctgctgagcctgctggaccacgagtacctgagcgacaccaccctggagaagaagatggccgtggccagcatcctgcagagcctgcagcccctgcccgccaaggaggtgagctacctgtacgtgaacaccgccgacctgcacagcggccccagcttcgtggagagcctgttcgaggagttcgactgcgacctgagcgacctgagagacatgcccgaggacgacggcgagcccagcaagggcgccagccccgagctggccaagagccccagactgagaaacgccgccgacctgcccccccccctgcccaacaagcccccccccgaggactactacgaggaggccctgcccctgggccccggcaagagccccgagtacatcagcagccacaacggctgcagccccagccacagcatcgtggacggctactacgaggacgccgacagcagctaccccgccaccagagtgaacggcgagctgaagagcagctacaacgacagcgacgccatgagcagcagctacgagagctacgacgaggaggaggaggagggcaagagcccccagcccagacaccagtggcccagcgaggaggccagcatgcacctggtgagagagtgcagaatctgcgccttcctgctgagaaagaagagattcggccagtgggccaagcagctgaccgtgatcagagaggaccagctgctgtgctacaagagcagcaaggacagacagccccacctgagactggccctggacacctgcagcatcatctacgtgcccaaggacagcagacacaagagacacgagctgagattcacccagggcgccaccgaggtgctggtgctggccctgcagagcagagagcaggccgaggagtggctgaaggtgatcagagaggtgagcaagcccgtgggcggcgccgagggcgtggaggtgcccagaagccccgtgctgctgtgcaagctggacctggacaagagactgagccaggagaagcagaccagcgacagcgacagcgtgggcgtgggcgacaactgcagcaccctgggcagaagagagacctgcgaccacggcaagggcaagaagagcagcctggccgagctgaagggcagcatgagcagagccgccggcagaaagatcaccagaatcatcggcttcagcaagaagaagaccctggccgacgacctgcagaccagcagcaccgaggaggaggtgccctgctgcggctacctgaacgtgctggtgaaccagggctggaaggagagatggtgcagactgaagtgcaacaccctgtacttccacaaggaccacatggacctgagaacccacgtgaacgccatcgccctgcagggctgcgaggtggcccccggcttcggccccagacaccccttcgccttcagaatcctgagaaacagacaggaggtggccatcctggaggccagctgcagcgaggacatgggcagatggctgggcctgctgctggtggagatgggcagcagagtgacccccgaggccctgcactacgactacgtggacgtggagaccctgaccagcatcgtgagcgccggcagaaacagcttcctgtacgccagaagctgccagaaccagtggcccgagcccagagtgtacgacgacgtgccctacgagaagatgcaggacgaggagcccgagagacccaccggcgcccaggtgaagagacacgccagcagctgcagcgagaagagccacagagtggacccccaggtgaaggtgaagagacacgccagcagcgccaaccagtacaagtacggcaagaacagagccgaggaggacgccagaagatacctggtggagaaggagaagctggagaaggagaaggagaccatcagaaccgagctgatcgccctgagacaggagaagagagagctgaaggaggccatcagaagcagccccggcgccaagctgaaggccctggaggaggccgtggccaccctggaggcccagtgcagagccaaggaggagagaagaatcgacctggagctgaagctggtggccgtgaaggagagactgcagcagagcctggccggcggccccgccctgggcctgagcgtgagcagcaagcccaagagcggcgagaccgccaacaagccccagaacagcgtgcccgagcagcccctgcccgtgaactgcgtgagcgagctgagaaagagaagccccagcatcgtggccagcaaccagggcagagtgctgcagaaggccaaggagtgggagatgaagaagacctag

SEQ ID NO: 71487 - DNA, 2178 bp, Artificial Sequence
  Description of Artificial Sequence: Synthetic coding sequence
atggacagaggccaggtgctggagcagctgctgcccgagctgaccggcctgctgagcctgctggaccacgagtacctgagcgacaccaccctggagaagaagatggccgtggccagcatcctgcagagcctgcagcccctgcccgccaaggaggtgagctacctgtacgtgaacaccgccgacctgcacagcggccccagcttcgtggagagcctgttcgaggagttcgactgcgacctgagcgacctgagagacatgcccgaggacgacggcgagcccagcaagggcgccagccccgagctggccaagagccccagactgagaaacgccgccgacctgcccccccccctgcccaacaagcccccccccgaggactactacgaggaggccctgcccctgggccccggcaagagccccgagtacatcagcagccacaacggctgcagccccagccacagcatcgtggacggctactacgaggacgccgacagcagctaccccgccaccagagtgaacggcgagctgaagagcagctacaacgacagcgacgccatgagcagcagctacgagagctacgacgaggaggaggaggagggcaagagcccccagcccagacaccagtggcccagcgaggaggccagcatgcacctggtgagagagtgcagaatctgcgccttcctgctgagaaagaagagattcggccagtgggccaagcagctgaccgtgatcagagaggaccagctgctgtgctacaagagcagcaaggacagacagccccacctgagactggccctggacacctgcagcatcatctacgtgcccaaggacagcagacacaagagacacgagctgagattcacccagggcgccaccgaggtgctggtgctggccctgcagagcagagagcaggccgaggagtggctgaaggtgatcagagaggtgagcaagcccgtgggcggcgccgagggcgtggaggtgcccagaagccccgtgctgctgtgcaagctggacctggacaagagactgagccaggagaagcagaccagcgacagcgacagcgtgggcgtgggcgacaactgcagcaccctgggcagaagagagacctgcgaccacggcaagggcaagaagagcagcctggccgagctgaagggcagcatgagcagagccgccggcagaaagatcaccagaatcatcggcttcagcaagaagaagaccctggccgacgacctgcagaccagcagcaccgaggaggaggtgccctgctgcggctacctgaacgtgctggtgaaccagggctggaaggagagatggtgcagactgaagtgcaacaccctgtacttccacaaggaccacatggacctgagaacccacgtgaacgccatcgccctgcagggctgcgaggtggcccccggcttcggccccagacaccccttcgccttcagaatcctgagaaacagacaggaggtggccatcctggaggccagctgcagcgaggacatgggcagatggctgggcctgctgctggtggagatgggcagcagagtgacccccgaggccctgcactacgactacgtggacgtggagaccctgaccagcatcgtgagcgccggcagaaacagcttcctgtacgccagaagctgccagaaccagtggcccgagcccagagtgtacgacgacgtgccctacgagaagatgcaggacgaggagcccgagagacccaccggcgcccaggtgaagagacacgccagcagctgcagcgagaagagccacagagtggacccccaggtgaaggtgaagagacacgccagcagcgccaaccagtacaagtacggcaagaacagagccgaggaggacgccagaagatacctggtggagaaggagaagctggagaaggagaaggagaccatcagaaccgagctgatcgccctgagacaggagaagagagagctgaaggaggccatcagaagcagccccggcgccaagctgaaggccctggaggaggccgtggccaccctggaggcccagtgcagagccaaggaggagagaagaatcgacctggagctgaagctggtggccgtgaaggagagactgcagcagagcctggccggcggccccgccctgggcctgagcgtgagcagcaagcccaagagcggcgagtgggagatgaagaagacctag

SEQ ID NO: 71488 - DNA, 2457 bp, Artificial Sequence
  Description of Artificial Sequence: Synthetic coding sequence
atggagagatacaaggccctggagcagctgctgaccgagctggacgacttcctgaagatcctggaccaggagaacctgagcagcaccgccctggtgaagaagagctgcctggccgagctgctgagactgtacaccaagagcagcagcagcgacgaggagtacatctacatgaacaaggtgaccatcaacaagcagcagaacgccgagagccagggcaaggcccccgaggagcagggcctgctgcccaacggcgagcccagccagcacagcagcgccccccagaagagcctgcccgacctgcccccccccaagatgatccccgagagaaagcagctggccatccccaagaccgagagccccgagggctactacgaggaggccgagccctacgacaccagcctgaacgaggacggcgaggccgtgagcagcagctacgagagctacgacgaggaggacggcagcaagggcaagagcgccccctaccagtggcccagccccgaggccggcatcgagctgatgagagacgccagaatctgcgccttcctgtggagaaagaagtggctgggccagtgggccaagcagctgtgcgtgatcaaggacaacagactgctgtgctacaagagcagcaaggaccacagcccccagctggacgtgaacctgctgggcagcagcgtgatccacaaggagaagcaggtgagaaagaaggagcacaagctgaagatcacccccatgaacgccgacgtgatcgtgctgggcctgcagagcaaggaccaggccgagcagtggctgagagtgatccaggaggtgagcggcctgcccagcgagggcgccagcgagggcaaccagtacacccccgacgcccagagattcaactgccagaagcccgacatcgccgagaagtacctgagcgccagcgagtacggcagcagcgtggacggccaccccgaggtgcccgagaccaaggacgtgaagaagaagtgcagcgccggcctgaagctgagcaacctgatgaacctgggcagaaagaagagcaccagcctggagcccgtggagagaagcctggagaccagcagctacctgaacgtgctggtgaacagccagtggaagagcagatggtgcagcgtgagagacaaccacctgcacttctaccaggacagaaacagaagcaaggtggcccagcagcccctgagcctggtgggctgcgaggtggtgcccgaccccagccccgaccacctgtacagcttcagaatcctgcacaagggcgaggagctggccaagctggaggccaagagcagcgaggagatgggccactggctgggcctgctgctgagcgagagcggcagcaagaccgaccccgaggagttcacctacgactacgtggacgccgacagagtgagctgcatcgtgagcgccgccaagaacagcctgctgctgatgcagagaaagttcagcgagcccaacacctacatcgacggcctgcccagccaggacagacaggaggagctgtacgacgacgtggacctgagcgagctgaccgccgccgtggagcccaccgaggaggccacccccgtggccgacgaccccaacgagagagagagcgacagagtgtacctggacctgacccccgtgaagagcttcctgcacggccccagcagcgcccaggcccaggccagcagccccaccctgagctgcctggacaacgccaccgaggccctgcccgccgacagcggccccggccccacccccgacgagccctgcatcaagtgccccgagaacctgggcgagcagcagctggagagcctggagcccgaggaccccagcctgagaatcaccaccgtgaagatccagaccgagcagcagagaatcagcttcccccccagctgccccgacgccgtggtggccaccccccccggcgccagcccccccgtgaaggacagactgagagtgaccagcgccgagatcaagctgggcaagaacagaaccgaggccgaggtgaagagatacaccgaggagaaggagagactggagaagaagaaggaggagatcagaggccacctggcccagctgagaaaggagaagagagagctgaaggagaccctgctgaagtgcaccgacaaggaggtgctggccagcctggagcagaagctgaaggagatcgacgaggagtgcagaggcgaggagagcagaagagtggacctggagctgagcatcatggaggtgaaggacaacctgaagaaggccgaggccggccccgtgaccctgggcaccaccgtggacaccacccacctggagaacgtgagccccagacccaaggccgtgacccccgccagcgcccccgactgcacccccgtgaacagcgccaccaccctgaagaacagacccctgagcgtggtggtgaccggcaagggcaccgtgctgcagaaggccaaggagtgggagaagaagggcgccagctag

SEQ ID NO: 71489 - DNA, 2445 bp, Artificial Sequence
  Description of Artificial Sequence: Synthetic coding sequence
atggagagatacaaggccctggagcagctgctgaccgagctggacgacttcctgaagatcctggaccaggagaacctgagcagcaccgccctggtgaagaagagctgcctggccgagctgctgagactgtacaccaagagcagcagcagcgacgaggagtacatctacatgaacaaggtgaccatcaacaagcagcagaacgccgagagccagggcaaggcccccgaggagcagggcctgctgcccaacggcgagcccagccagcacagcagcgccccccagaagagcctgcccgacctgcccccccccaagatgatccccgagagaaagcagctggccatccccaagaccgagagccccgagggctactacgaggaggccgagccctacgacaccagcctgaacgaggacggcgaggccgtgagcagcagctacgagagctacgacgaggaggacggcagcaagggcaagagcgccccctaccagtggcccagccccgaggccggcatcgagctgatgagagacgccagaatctgcgccttcctgtggagaaagaagtggctgggccagtgggccaagcagctgtgcgtgatcaaggacaacagactgctgtgctacaagagcagcaaggaccacagcccccagctggacgtgaacctgctgggcagcagcgtgatccacaaggagaagcaggtgagaaagaaggagcacaagctgaagatcacccccatgaacgccgacgtgatcgtgctgggcctgcagagcaaggaccaggccgagcagtggctgagagtgatccaggaggtgagcggcctgcccagcgagggcgccagcgagggcaaccagtacacccccgacgcccagagattcaactgccagaagcccgacatcgccgagaagtacctgagcgccagcgagtacggcagcagcgtggacggccaccccgaggtgcccgagaccaaggacgtgaagaagaagtgcagcgccggcctgaagctgagcaacctgatgaacctgggcagaaagaagagcaccagcctggagcccgtggagagaagcctggagaccagcagctacctgaacgtgctggtgaacagccagtggaagagcagatggtgcagcgtgagagacaaccacctgcacttctaccaggacagaaacagaagcaaggtggcccagcagcccctgagcctggtgggctgcgaggtggtgcccgaccccagccccgaccacctgtacagcttcagaatcctgcacaagggcgaggagctggccaagctggaggccaagagcagcgaggagatgggccactggctgggcctgctgctgagcgagagcggcagcaagaccgaccccgaggagttcacctacgactacgtggacgccgacagagtgagctgcatcgtgagcgccgccaagaacagcctgctgctgatgcagagaaagttcagcgagcccaacacctacatcgacggcctgcccagccaggacagacaggaggagctgtacgacgacgtggacctgagcgagctgaccgccgccgtggagcccaccgaggaggccacccccgtggccgacgaccccaacgagagagagagcgacagagtgtacctggacctgacccccgtgaagagcttcctgcacggccccagcagcgcccaggcccaggccagcagccccaccctgagctgcctggacaacgccaccgaggccctgcccgccgacagcggccccggccccacccccgacgagccctgcatcaagtgccccgagaacctgggcgagcagcagctggagagcctggagcccgaggaccccagcctgagaatcaccaccgtgaagatccagaccgagcagcagagaatcagcttcccccccagctgccccgacgccgtggtggccaccccccccggcgccagcccccccgtgaaggacagactgagagtgaccagcgccgagatcaagctgggcaagaacagaaccgaggccgaggtgaagagatacaccgaggagaaggagagactggagaagaagaaggaggagatcagaggccacctggcccagctgagaaaggagaagagagagctgaaggagaccctgctgaagtgcaccgacaaggaggtgctggccagcctggagcagaagctgaaggagatcgacgaggagtgcagaggcgaggagagcagaagagtggacctggagctgagcatcatggaggtgaaggacaacctgaagaaggccgaggccggccccgtgaccctgggcaccaccgtggacaccacccacctggagaaccccaaggccgtgacccccgccagcgcccccgactgcacccccgtgaacagcgccaccaccctgaagaacagacccctgagcgtggtggtgaccggcaagggcaccgtgctgcagaaggccaaggagtgggagaagaagggcgccagctag

SEQ ID NO: 71490 - DNA, 2526 bp, Artificial Sequence
  Description of Artificial Sequence: Synthetic coding sequence
cagagagtgagagccctggagcagctgctgaccgagctggacgacttcctgaagatcctggaccaggagaacctgagcagcaccgccctggtgaagaagagctgcctggccgagctgctgagactgtacaccaagagcagcagcagcgacgaggagtacatctacatgaacaaggtgaccatcaacaagcagcagaacgccgagagccagggcaaggcccccgaggagcagggcctgctgcccaacggcgagcccagccagcacagcagcgccccccagaagagcctgcccgacctgcccccccccaagatgatccccgagagaaagcagctggccatccccaagaccgagagccccgagggctactacgaggaggccgagccctacgacaccagcctgaacggccacagcggcggcttcctgcccaccggcgtgcccagatgggtgcaggtgcccgagggcgtgatctacgccaccatcaccctggaggacggcgaggccgtgagcagcagctacgagagctacgacgaggaggacggcagcaagggcaagagcgccccctaccagtggcccagccccgaggccggcatcgagctgatgagagacgccagaatctgcgccttcctgtggagaaagaagtggctgggccagtgggccaagcagctgtgcgtgatcaaggacaacagactgctgtgctacaagagcagcaaggaccacagcccccagctggacgtgaacctgctgggcagcagcgtgatccacaaggagaagcaggtgagaaagaaggagcacaagctgaagatcacccccatgaacgccgacgtgatcgtgctgggcctgcagagcaaggaccaggccgagcagtggctgagagtgatccaggaggtgagcggcctgcccagcgagggcgccagcgagggcaaccagtacacccccgacgcccagagattcaactgccagaagcccgacatcgccgagaagtacctgagcgccagcgagtacggcagcagcgtggacggccaccccgaggtgcccgagaccaaggacgtgaagaagaagtgcagcgccggcctgaagctgagcaacctgatgaacctgggcagaaagaagagcaccagcctggagcccgtggagagaagcctggagaccagcagctacctgaacgtgctggtgaacagccagtggaagagcagatggtgcagcgtgagagacaaccacctgcacttctaccaggacagaaacagaagcaaggtggcccagcagcccctgagcctggtgggctgcgaggtggtgcccgaccccagccccgaccacctgtacagcttcagaatcctgcacaagggcgaggagctggccaagctggaggccaagagcagcgaggagatgggccactggctgggcctgctgctgagcgagagcggcagcaagaccgaccccgaggagttcacctacgactacgtggacgccgacagagtgagctgcatcgtgagcgccgccaagaacagcctgctgctgatgcagagaaagttcagcgagcccaacacctacatcgacggcctgcccagccaggacagacaggaggagctgtacgacgacgtggacctgagcgagctgaccgccgccgtggagcccaccgaggaggccacccccgtggccgacgaccccaacgagagagagagcgacagagtgtacctggacctgacccccgtgaagagcttcctgcacggccccagcagcgcccaggcccaggccagcagccccaccctgagctgcctggacaacgccaccgaggccctgcccgccgacagcggccccggccccacccccgacgagccctgcatcaagtgccccgagaacctgggcgagcagcagctggagagcctggagcccgaggaccccagcctgagaatcaccaccgtgaagatccagaccgagcagcagagaatcagcttcccccccagctgccccgacgccgtggtggccaccccccccggcgccagcccccccgtgaaggacagactgagagtgaccagcgccgagatcaagctgggcaagaacagaaccgaggccgaggtgaagagatacaccgaggagaaggagagactggagaagaagaaggaggagatcagaggccacctggcccagctgagaaaggagaagagagagctgaaggagaccctgctgaagtgcaccgacaaggaggtgctggccagcctggagcagaagctgaaggagatcgacgaggagtgcagaggcgaggagagcagaagagtggacctggagctgagcatcatggaggtgaaggacaacctgaagaaggccgaggccggccccgtgaccctgggcaccaccgtggacaccacccacctggagaaccccaaggccgtgacccccgccagcgcccccgactgcacccccgtgaacagcgccaccaccctgaagaacagacccctgagcgtggtggtgaccggcaagggcaccgtgctgcagaaggccaaggagtgggagaagaagggcgccagctag

SEQ ID NO: 71491 - DNA, 939 bp, Artificial Sequence
  Description of Artificial Sequence: Synthetic coding sequence
atggagagatacaaggcccagggctgctgctgcctggtggtgcagagaagaatcagacaggtgagcgccagcctggagcagctgctgaccgagctggacgacttcctgaagatcctggaccaggagaacctgagcagcaccgccctggtgaagaagagctgcctggccgagctgctgagactgtacaccaagagcagcagcagcgacgaggagtacatctacatgaacaaggtgaccatcaacaagcagcagaacgccgagagccagggcaaggcccccgaggagcagggcctgctgcccaacggcgagcccagccagcacagcagcgccccccagaagagcctgcccgacctgcccccccccaagatgatccccgagagaaagcagctggccatccccaagaccgagagccccgagggctactacgaggaggccgagccctacgacaccagcctgaacgaggacggcgaggccgtgagcagcagctacgagagctacgacgaggaggacggcagcaagggcaagagcgccccctaccagtggcccagccccgaggccggcatcgagctgatgagagacgccagaatctgcgccttcctgtggagaaagaagtggctgggccagtgggccaagcagctgtgcgtgatcaaggacaacagactgctgtgctacaagagcagcaaggaccacagcccccagctggacgtgaacctgctgggcagcagcgtgatccacaaggagaagcaggtgagaaagaaggagcacaagctgaagatcacccccatgaacgccgacgtgatcgtgctgggcctgcagagcaaggaccaggccgagcagtggctgagagtgatccaggaggtgagcggcctgcccagcgagggcgccagcgagggcaaccagtacacccccgacgcccagagattcaactgccagaagtag

SEQ ID NO: 71492 - DNA, 939 bp, Artificial Sequence; identical to SEQ ID NO: 71491
  Description of Artificial Sequence: Synthetic coding sequence

SEQ ID NO: 71493 - DNA, 2616 bp, Artificial Sequence
  Description of Artificial Sequence: Synthetic coding sequence
atggagagatacaaggccctggagcagctgctgaccgagctggacgacttcctgaagatcctggaccaggagaacctgagcagcaccgccctggtgaagaagagctgcctggccgagctgctgagactgtacaccaagagcagcagcagcgacgaggagtacatctacatgaacaaggtgaccatcaacaagcagcagaacgccgagagccagggcaaggcccccgaggagcagggcctgctgcccaacggcgagcccagccagcacagcagcgccccccagaagagcctgcccgacctgcccccccccaagatgagaatcctgaccctgggccagatcagcggcgcccagagcttcagccccgacggcacccacctgaccggcaccgagttcctgggcggctggagctggagacccagccagatcagactgatgagccccggcacccactggggcgacctgaccgccaccgagatccccgagagaaagcagctggccatccccaagaccgagagccccgagggctactacgaggaggccgagccctacgacaccagcctgaacgaggacggcgaggccgtgagcagcagctacgagagctacgacgaggaggacggcagcaagggcaagagcgccccctaccagtggcccagccccgaggccggcatcgagctgatgagagacgccagaatctgcgccttcctgtggagaaagaagtggctgggccagtgggccaagcagctgtgcgtgatcaaggacaacagactgctgtgctacaagagcagcaaggaccacagcccccagctggacgtgaacctgctgggcagcagcgtgatccacaaggagaagcaggtgagaaagaaggagcacaagctgaagatcacccccatgaacgccgacgtgatcgtgctgggcctgcagagcaaggaccaggccgagcagtggctgagagtgatccaggaggtgagcggcctgcccagcgagggcgccagcgagggcaaccagtacacccccgacgcccagagattcaactgccagaagcccgacatcgccgagaagtacctgagcgccagcgagtacggcagcagcgtggacggccaccccgaggtgcccgagaccaaggacgtgaagaagaagtgcagcgccggcctgaagctgagcaacctgatgaacctgggcagaaagaagagcaccagcctggagcccgtggagagaagcctggagaccagcagctacctgaacgtgctggtgaacagccagtggaagagcagatggtgcagcgtgagagacaaccacctgcacttctaccaggacagaaacagaagcaaggtggcccagcagcccctgagcctggtgggctgcgaggtggtgcccgaccccagccccgaccacctgtacagcttcagaatcctgcacaagggcgaggagctggccaagctggaggccaagagcagcgaggagatgggccactggctgggcctgctgctgagcgagagcggcagcaagaccgaccccgaggagttcacctacgactacgtggacgccgacagagtgagctgcatcgtgagcgccgccaagaacagcctgctgctgatgcagagaaagttcagcgagcccaacacctacatcgacggcctgcccagccaggacagacaggaggagctgtacgacgacgtggacctgagcgagctgaccgccgccgtggagcccaccgaggaggccacccccgtggccgacgaccccaacgagagagagagcgacagagtgtacctggacctgacccccgtgaagagcttcctgcacggccccagcagcgcccaggcccaggccagcagccccaccctgagctgcctggacaacgccaccgaggccctgcccgccgacagcggccccggccccacccccgacgagccctgcatcaagtgccccgagaacctgggcgagcagcagctggagagcctggagcccgaggaccccagcctgagaatcaccaccgtgaagatccagaccgagcagcagagaatcagcttcccccccagctgccccgacgccgtggtggccaccccccccggcgccagcccccccgtgaaggacagactgagagtgaccagcgccgagatcaagctgggcaagaacagaaccgaggccgaggtgaagagatacaccgaggagaaggagagactggagaagaagaaggaggagatcagaggccacctggcccagctgagaaaggagaagagagagctgaaggagaccctgctgaagtgcaccgacaaggaggtgctggccagcctggagcagaagctgaaggagatcgacgaggagtgcagaggcgaggagagcagaagagtggacctggagctgagcatcatggaggtgaaggacaacctgaagaaggccgaggccggccccgtgaccctgggcaccaccgtggacaccacccacctggagaacgtgagccccagacccaaggccgtgacccccgccagcgcccccgactgcacccccgtgaacagcgccaccaccctgaagaacagacccctgagcgtggtggtgaccggcaagggcaccgtgctgcagaaggccaaggagtgggagaagaagggcgccagctag

SEQ ID NO: 71494 - DNA, 1002 bp, Artificial Sequence
  Description of Artificial Sequence: Synthetic coding sequence
atgtgcgaggaggagaccaccgccctggtgtgcgacaacggcagcggcctgtgcaaggccggcttcgccggcgacgacgcccccagagccgtgttccccagcatcgtgggcagacccagacaccagatctggcaccacagcttctacaacgagctgagagtggcccccgaggagcaccccaccctgctgaccgaggcccccctgaaccccaaggccaacagagagaagatgacccagatcatgttcgagaccttcaacgtgcccgccatgtacgtggccatccaggccgtgctgagcctgtacgccagcggcagaaccaccggcatcgtgctggacagcggcgacggcgtgacccacaacgtgcccatctacgagggctacgccctgccccacgccatcatgagactggacctggccggcagagacctgaccgactacctgatgaagatcctgaccgagagaggctacagcttcgtgaccaccgccgagagagagatcgtgagagacatcaaggagaagctgtgctacgtggccctggacttcgagaacgagatggccaccgccgccagcagcagcagcctggagaagagctacgagctgcccgacggccaggtgatcaccatcggcaacgagagattcagatgccccgagaccctgttccagcccagcttcatcggcatggagagcgccggcatccacgagaccacctacaacagcatcatgaagtgcgacatcgacatcagaaaggacctgtacgccaacaacgtgctgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcagcaagcccgagtacgacgaggccggccccagcatcgtgcacagaaagtgcttctag

SEQ ID NO: 71495 - DNA, 1113 bp, Artificial Sequence
  Description of Artificial Sequence: Synthetic coding sequence
atgagcctgcaccagttcctgctggagcccatcacctgccacgcctggaacagagacagaacccagatcgccctgagccccaacaaccacgaggtgcacatctacaagaagaacggcagccagtgggtgaaggcccacgagctgaaggagcacaacggccacatcaccggcatcgactgggcccccaagagcgacagaatcgtgacctgcggcgccgacagaaacgcctacgtgtggagccagaaggacggcgtgtggaagcccaccctggtgatcctgagaatcaacagagccgccaccttcgtgaagtggagccccctggagaacaagttcgccgtgggcagcggcgccagactgatcagcgtgtgctacttcgagagcgagaacgactggtgggtgagcaagcacatcaagaagcccatcagaagcaccgtgctgagcctggactggcaccccaacaacgtgctgctggccgccggcagctgcgacttcaagtgcagagtgttcagcgcctacatcaaggaggtggacgagaagcccgccagcaccccctggggcagcaagatgcccttcggccagctgatgagcgagttcggcggcagcggcaccggcggctgggtgcacggcgtgagcttcagcgccagcggcagcagactggcctgggtgagccacgacagcaccgtgagcgtggccgacgccagcaagagcgtgcaggtgagcaccctgaagaccgagttcctgcccctgctgagcgtgagcttcgtgagcgagaacagcgtggtggccgccggccacgactgctgccccatgctgttcaactacgacgacagaggctgcctgaccttcgtgagcaagctggacatccccaagcagagcatccagagaaacatgagcgccatggagagattcagaaacatggacaagagagccaccaccgaggacagaaacaccgccctggagaccctgcaccagaacagcatcacccaggtgagcatctacgaggtggacaagcaggactgcagaaagttctgcaccaccggcatcgacggcgccatgaccatctgggacttcaagaccctggagagcagcatccagggcctgagaatcatgtag

SEQ ID NO: 71496 - DNA, 1038 bp, Artificial Sequence
  Description of Artificial Sequence: Synthetic coding sequence
atgcacgagagattcatccactgcttctgcatcgactgggcccccaagagcgacagaatcgtgacctgcggcgccgacagaaacgcctacgtgtggagccagaaggacggcgtgtggaagcccaccctggtgatcctgagaatcaacagagccgccaccttcgtgaagtggagccccctggagaacaagttcgccgtgggcagcggcgccagactgatcagcgtgtgctacttcgagagcgagaacgactggtgggtgagcaagcacatcaagaagcccatcagaagcaccgtgctgagcctggactggcaccccaacaacgtgctgctggccgccggcagctgcgacttcaagtgcagagtgttcagcgcctacatcaaggaggtggacgagaagcccgccagcaccccctggggcagcaagatgcccttcggccagctgatgagcgagttcggcggcagcggcaccggcggctgggtgcacggcgtgagcttcagcgccagcggcagcagactggcctgggtgagccacgacagcaccgtgagcgtggccgacgccagcaagagcgtgcaggtgagcaccctgaagaccgagttcctgcccctgctgagcgtgagcttcgtgagcgagaacagcgtggtggccgccggccacgactgctgccccatgctgttcaactacgacgacagaggctgcctgaccttcgtgagcaagctggacatccccaagcagagcatccagagaaacatgagcgccatggagagattcagaaacatggacaagagagccaccaccgaggacagaaacaccgccctggagaccctgcaccagaacagcatcacccaggtgagcatctacgaggtggacaagcaggactgcagaaagttctgcaccaccggcatcgacggcgccatgaccatctgggacttcaaggagcccagcagacacggcctgccccagctgcccggcggcgcccaccagctgcccagactggagcagggcccccaccccgactgccacctgccccagcagccctag

SEQ ID NO: 71497 - DNA, 1119 bp, Artificial Sequence
  Description of Artificial Sequence: Synthetic coding sequence
atggcctaccacagcttcctggtggagcccatcagctgccacgcctggaacaaggacagaacccagatcgccatctgccccaacaaccacgaggtgcacatctacgagaagagcggcgccaagtggaccaaggtgcacgagctgaaggagcacaacggccaggtgaccggcatcgactgggcccccgagagcaacagaatcgtgacctgcggcaccgacagaaacgcctacgtgtggaccctgaagggcagaacctggaagcccaccctggtgatcctgagaatcaacagagccgccagatgcgtgagatgggcccccaacgagaacaagttcgccgtgggcagcggcagcagagtgatcagcatctgctacttcgagcaggagaacgactggtgggtgtgcaagcacatcaagaagcccatcagaagcaccgtgctgagcctggactggcaccccaacaacgtgctgctggccgccggcagctgcgacttcaagtgcagaatcttcagcgcctacatcaaggaggtggaggagagacccgcccccaccccctggggcagcaagatgcccttcggcgagctgatgttcgagagcagcagcagctgcggctgggtgcacggcgtgtgcttcagcgccagcggcagcagagtggcctgggtgagccacgacagcaccgtgtgcctggccgacgccgacaagaagatggccgtggccaccctggccagcgagaccctgcccctgctggccctgaccttcatcaccgacaacagcctggtggccgccggccacgactgcttccccgtgctgttcacctacgacgccgccgccggcatgctgagcttcggcggcagactggacgtgcccaagcagagcagccagagaggcctgaccgccagagagagattccagaacctggacaagaaggccagcagcgagggcggcaccgccgccggcgccggcctggacagcctgcacaagaacagcgtgagccagatcagcgtgctgagcggcggcaaggccaagtgcagccagttctgcaccaccggcatggacggcggcatgagcatctgggacgtgaagagcctggagagcgccctgaaggacctgaagatcaagtag

SEQ ID NO: 71498 - DNA, 309 bp, Artificial Sequence
  Description of Artificial Sequence: Synthetic coding sequence
atggcctaccacagcttcctggtggagcccatcagctgccacgcctggaacaaggacagaacccagatcgccatctgccccaacaaccacgaggtgcacatctacgagaagagcggcgccaagtggaccaaggtgcacgagctgaaggagcacaacggccaggtgaccggcatcgactgggcccccgagagcaacagaatcgtgacctgcggcaccgacagaaacgcctacgtgtggaccctgaagggcagaacctggaagcccaccctggtgatcctgagaatcaacagagccgccagatgcgtgtag

SEQ ID NO: 71499 - DNA, 393 bp, Artificial Sequence
  Description of Artificial Sequence: Synthetic coding sequence
atggcctaccacagcttcctggtggagcccatcagctgccacgcctggaacaaggacagaacccagatcgccatctgccccaacaaccacgaggtgcacatctacgagaagagcggcgccaagtggaccaaggtgcacgagctgaaggagcacaacggccaggtgaccggcatcgactgggcccccgagagcaacagaatcgtgacctgcggcaccgacagaaacgcctacgtgtggaccctgaagggcagaacctggaagcccaccctggtgatcctgagaatcaacagagccgccagatgcgtgagatgggcccccaacgagaacaagttcgccgtgggcagcggcagcagagtgatcagcatctgctacttcgagcaggagaacgactag

SEQ ID NO: 71500 - DNA, 252 bp, Artificial Sequence
  Description of Artificial Sequence: Synthetic coding sequence
atggcctaccacagcttcctggtggagcccatcagctgccacgcctggaacaaggacagaacccagatcgccatctgccccaacaaccacgaggtgcacatctacgagaagagcggcgccaagtggaccaaggtgcacgagctgaaggagcacaacggccaggtgaccggcatcgactgggcccccgagagcaacagaatcgtgacctgcggcaccgacagaaacgcctacgtgtggaccctgaagggctag

SEQ ID NO: 71501 - DNA, 402 bp, Artificial Sequence
  Description of Artificial Sequence: Synthetic coding sequence
atggcctaccacagcttcctggtggagcccatcagctgccacgcctggaacaaggacagaacccagatcgccatctgccccaacaaccacgaggtgcacatctacgagaagagcggcgccaagtggaccaaggtgcacgagctgaaggagcacaacggccaggtgaccggcatcgactgggcccccgagagcaacagaatcgtgacctgcggcaccgacagaaacgcctacgtgtggaccctgaagggcagaacctggaagcccaccctggtgatcctgagaatcaacagagccgccagatgcgtgagatgggcccccaacgagaacaagttcgccgtgggcagcggcagcagagtgatcagcatctgctacttcgagcaggagaacgactggtgggtgtag

SEQ ID NO: 71502 - DNA, 66 bp, Artificial Sequence
  Description of Artificial Sequence: Synthetic coding sequence
atggcctaccacagcttcctggtggagcccatcagctgccacgcctggaacaaggacagaacctag

SEQ ID NO: 71503 - DNA, 402 bp, Artificial Sequence; identical to SEQ ID NO: 71501
  Description of Artificial Sequence: Synthetic coding sequence

SEQ ID NO: 71504 - DNA, 327 bp, Artificial Sequence
  Description of Artificial Sequence: Synthetic coding sequence
atggcctaccacagcttcctggtggagcccatcagctgccacgcctggaacaaggacagaacccagatcgccatctgccccaacaaccacgaggtgcacatctacgagaagagcggcgccaagtggaccaaggtgcacgagctgaaggagcacaacggccaggtgaccggcatcgactgggcccccgagagcaacagaatcgtgacctgcggcaccgacagaaacgcctacgtgtggaccctgaagggcagaacctggaagcccaccctggtgatcctgagaatcaacagagccgccagatgcgtgagatgggcccccaacgagtag

SEQ ID NO: 71505 - DNA, 1119 bp, Artificial Sequence; identical to SEQ ID NO: 71497
  Description of Artificial Sequence: Synthetic coding sequence

SEQ ID NO: 71506 - DNA, 387 bp, Artificial Sequence
  Description of Artificial Sequence: Synthetic coding sequence
atggcctaccacagcttcctggtggagcccatcagctgccacgcctggaacaaggacagaacccagatcgccatctgccccaacaaccacgaggtgcacatctacgagaagagcggcgccaagtggaccaaggtgcacgagctgaaggagcacaacggccaggtgaccggcatcgactgggcccccgagagcaacagaatcgtgacctgcggcaccgacagaaacgcctacgtgtggaccctgaagggcagaacctggaagcccaccctggtgatcctgagaatcaacagagccgccagatgcgtgagatgggcccccaacgagaacaagttcgccgtgggcagcggcagcagagtgatcagcatctgctacttcgagcaggagtag

SEQ ID NO: 71507 - DNA, 402 bp, Artificial Sequence; identical to SEQ ID NO: 71501
  Description of Artificial Sequence: Synthetic coding sequence

SEQ ID NO: 71508 - DNA, 903 bp, Artificial Sequence
  Description of Artificial Sequence: Synthetic coding sequence
atgatcctgctggaggtgaacaacagaatcatcgaggagaccctggccctgaagttcgagaacgccgccgccggcaacaagcccgaggccgtggaggtgaccttcgccgacttcgacggcgtgctgtaccacatcagcaaccccaacggcgacaagaccaaggtgatggtgagcatcagcctgaagttctacaaggagctgcaggcccacggcgccgacgagctgctgaagagagtgtacggcagcttcctggtgaaccccgagagcggctacaacgtgagcctgctgtacgacctggagaacctgcccgccagcaaggacagcatcgtgcaccaggccggcatgctgaagagaaactgcttcgccagcgtgttcgagaagtacttccagttccaggaggagggcaaggagggcgagaacagagccgtgatccactacagagacgacgagaccatgtacgtggagagcaagaaggacagagtgaccgtggtgttcagcaccgtgttcaaggacgacgacgacgtggtgatcggcaaggtgttcatgcaggagttcaaggagggcagaagagccagccacaccgccccccaggtgctgttcagccacagagagccccccctggagctgaaggacaccgacgccgccgtgggcgacaacatcggctacatcaccttcgtgctgttccccagacacaccaacgccagcgccagagacaacaccatcaacctgatccacaccttcagagactacctgcactaccacatcaagtgcagcaaggcctacatccacaccagaatgagagccaagaccagcgacttcctgaaggtgctgaacagagccagacccgacgccgagaagaaggagatgaagaccatcaccggcaagaccttcagcagcagatag

SEQ ID NO: 71509 - DNA, 903 bp, Artificial Sequence; identical to SEQ ID NO: 71508
  Description of Artificial Sequence: Synthetic coding sequence

SEQ ID NO: 71510 - DNA, 273 bp, Artificial Sequence
  Description of Artificial Sequence: Synthetic coding sequence
atgatcctgctggaggtgaacaacagaatcatcgaggagaccctggccctgaagttcgagaacgccgccgccggcaacaagcccgaggccgtggaggtgaccttcgccgacttcgacggcgtgctgtaccacatcagcaaccccaacggcgacaagaccaaggtgatggtgagcatcagcctgaagttctacaaggagctgcaggcccacggcgccgacgagctgctgaagagagtgtacggcagcttcctggtgaaccccgagagcggctag

SEQ ID NO: 71511 - DNA, 864 bp, Artificial Sequence
  Description of Artificial Sequence: Synthetic coding sequence
atgtgcgacgaggacgagaccaccgccctggtgtgcgacaacggcagcggcctggtgaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcatcaccaactgggacgacatggagaagatctggcaccacaccttctacaacgagctgagagtggcccccgaggagcaccccaccctgctgaccgaggcccccctgaaccccaaggccaacagagagatcgtgagagacatcaaggagaagctgtgctacgtggccctggacttcgagaacgagatggccaccgccgccagcagcagcagcctggagaagagctacgagctgcccgacggccaggtgatcaccatcggcaacgagagattcagatgccccgagaccctgttccagcccagcttcatcggcatggagagcgccggcatccacgagaccacctacaacagcatcatgaagtgcgacatcgacatcagaaaggacctgtacgccaacaacgtgatgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcaccaagcaggagtacgacgaggccggccccagcatcgtgcacagaaagtgcttctag

SEQ ID NO: 71512 - DNA, 765 bp, Artificial Sequence
  Description of Artificial Sequence: Synthetic coding sequence
atgtgcgacgaggacgagaccaccgccctggtgtgcgacaacggcagcggcctggtgaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcatcaccaactgggacgacatggagaagatctggcaccacaccttctacaacgagctgagagtggcccccgaggagcaccccaccctgctgaccgaggcccccctgaaccccaaggccaacagagagaagatgacccagatcatgttcgagaccttcaacgtgcccgccatgtacgtggccatccaggccgtgctgagcctgtacgccagcggcagaaccaccggcatcgtgctggacagcggcgacggcatcatgaagtgcgacatcgacatcagaaaggacctgtacgccaacaacgtgatgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcaccaagcaggagtacgacgaggccggccccagcatcgtgcacagaaagtgcttctag

SEQ ID NO: 71513 - DNA, 1029 bp, Artificial Sequence
  Description of Artificial Sequence: Synthetic coding sequence
atgtgcgacgaggacgagaccaccgccctggtgtgcgacaacggcagcggcctggtgaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcatcaccaaggccaacagagagaagatgacccagatcatgttcgagaccttcaacgtgcccgccatgtacgtggccatccaggccgtgctgagcctgtacgccagcggcagaaccaccggcatcgtgctggacagcggcgacggcgtgacccacaacgtgcccatctacgagggctacgccctgccccacgccatcatgagactggacctggccggcagagacctgaccgactacctgatgaagatcctgaccgagagaggctacagcttcgtgaccaccgccgagagagagatcgtgagagacatcaaggagaagctgtgctacgtggccctggacttcgagaacgagatggccaccgccgccagcagcagcagcctggagaagagctacgagctgcccgacggccaggtgatcaccatcggcaacgagagattcagatgccccgagaccctgttccagcccagcttcatcggcatggagagcgccggcatccacgagaccacctacaacagcatcatgaagtgcgacatcgacatcagaaaggacctgtacgccaacaacgtgatgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcaccaagcaggagtacgacgaggccggccccagcatcgtgcacagaaagtgcttctag

SEQ ID NO: 71514 - DNA, 870 bp, Artificial Sequence
  Description of Artificial Sequence: Synthetic coding sequence
atgtgcgacgaggacgagaccaccgccctggtgtgcgacaacggcagcggcctggtgaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcatcaccaactgggacgacatggagaagatctggcaccacaccttctacaacgagctgagagtggcccccgaggagcaccccaccctgctgaccgaggcccccctgaaccccaaggccaaccccgagagagagatcgtgagagacatcaaggagaagctgtgctacgtggccctggacttcgagaacgagatggccaccgccgccagcagcagcagcctggagaagagctacgagctgcccgacggccaggtgatcaccatcggcaacgagagattcagatgccccgagaccctgttccagcccagcttcatcggcatggagagcgccggcatccacgagaccacctacaacagcatcatgaagtgcgacatcgacatcagaaaggacctgtacgccaacaacgtgatgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcaccaagcaggagtacgacgaggccggccccagcatcgtgcacagaaagtgcttctag

SEQ ID NO: 71515 - DNA, 1134 bp, Artificial Sequence
  Description of Artificial Sequence: Synthetic coding sequence
atgtgcgacgaggacgagaccaccgccctggtgtgcgacaacggcagcggcctggtgaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcatcaccaactgggacgacatggagaagatctggcaccacaccttctacaacgagctgagagtggcccccgaggagcaccccaccctgctgaccgaggcccccctgaaccccaaggccaacagagagaagatgacccagatcatgttcgagaccttcaacgtgcccgccatgtacgtggccatccaggccgtgctgagcctgtacgccagcggcagaaccaccggcatcgtgctggacagcggcgacggcgtgacccacaacgtgcccatctacgagggctacgccctgccccacgccatcatgagactggacctggccggcagagacctgaccgactacctgatgaagatcctgaccgagagaggctacagcttcgtgaccaccgccgagagagagatcgtgagagacatcaaggagaagctgtgctacgtggccctggacttcgagaacgagatggccaccgccgccagcagcagcagcctggagaagagctacgagctgcccgacggccaggtgatcaccatcggcaacgagagattcagatgccccgagaccctgttccagcccagcttcatcggcatggagagcgccggcatccacgagaccacctacaacagcatcatgaagtgcgacatcgacatcagaaaggacctgtacgccaacaacgtgatgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcaccaagcaggagtacgacgaggccggccccagcatcgtgcacagaaagtgcttctag

SEQ ID NO: 71516 - DNA, 1146 bp, Artificial Sequence
  Description of Artificial Sequence: Synthetic coding sequence
atggcccccggcgagaaggagagcggcgagggccccgccaagagcgccctgagaaagatcagaaccgccaccctggtgatcagcctggccagaggctggcagcagtgggccaacgagaacagcatcagacaggcccaggagcccaccggctggctgcccggcggcacccaggacagcccccaggcccccaagcccatcaccccccccaccagccaccagaaggcccagagcgcccccaagagcccccccagactgcccgagggccacggcgacggccagagcagcgagaaggcccccgaggtgagccacatcaagaagaaggaggtgagcaagaccgtggtgagcaagacctacgagagaggcggcgacgtgagccacctgagccacagatacgagagagacgccggcgtgctggagcccggccagcccgagaacgacatcgacagaatcctgcacagccacggcagccccaccagaagaagaaagtgcgccaacctggtgagcgagctgaccaagggctggagagtgatggagcaggaggagcccacctggagaagcgacagcgtggacaccgaggacagcggctacggcggcgaggccgaggagagacccgagcaggacggcgtgcaggtggccgtggtgagaatcaagagacccctgcccagccaggtgaacagattcaccgagaagctgaactgcaaggcccagcagaagtacagccccgtgggcaacctgaagggcagatggcagcagtgggccgacgagcacatccagagccagaagctgaaccccttcagcgaggagttcgactacgagctggccatgagcaccagactgcacaagggcgacgagggctacggcagacccaaggagggcaccaagaccgccgagagagccaagagagccgaggagcacatctacagagagatgatggacatgtgcttcatcatctgcaccatggccagacacagaagagacggcaagatccaggtgaccttcggcgacctgttcgacagatacgtgagaatcagcgacaaggtggtgggcatcctgatgagagccagaaagcacggcctggtggacttcgagggcgagatgctgtggcagggcagagacgaccacgtggtgatcaccctgctgaagtag

SEQ ID NO: 71517 - DNA, 2685 bp, Artificial Sequence
  Description of Artificial Sequence: Synthetic coding sequence
atgaaccagatcgagcccggcgtgcagtacaactacgtgtacgacgaggacgagtacatgatccaggaggaggagtgggacagagacctgctgctggaccccgcctgggagaagcagcagagaaagaccttcaccgcctggtgcaacagccacctgagaaaggccggcacccagatcgagaacatcgaggaggacttcagaaacggcctgaagctgatgctgctgctggaggtgatcagcggcgagagactgcccaagcccgacagaggcaagatgagattccacaagatcgccaacgtgaacaaggccctggactacatcgccagcaagggcgtgaagctggtgagcatcggcgccgaggagatcgtggacggcaacgtgaagatgaccctgggcatgatctggaccatcatcctgagattcgccatccaggacatcagcgtggaggagaccagcgccaaggagggcctgctgctgtggtgccagagaaagaccgccccctacagaaacgtgaacatccagaacttccacaccagctggaaggacggcctgggcctgtgcgccctgatccacagacacagacccgacctgatcgactacagcaagctgaacaaggacgaccccatcggcaacatcaacctggccatggagatcgccgagaagcacctggacatccccaagatgctggacgccgaggacatcgtgaacacccccaagcccgacgagagagccatcatgacctacgtgagctgcttctaccacgccttcgccggcgccgagcaggccgagaccgccgccaacagaatctgcaaggtgctggccgtgaaccaggagaacgagagactgatggaggagtacgagagactggccagcgagctgctggagtggatcagaagaaccatcccctggctggagaacagaacccccgagaagaccatgcaggccatgcagaagaagctggaggacttcagagactacagaagaaagcacaagccccccaaggtgcaggagaagtgccagctggagatcaacttcaacaccctgcagaccaagctgagaatcagcaacagacccgccttcatgcccagcgagggcaagatggtgagcgacatcgccggcgcctggcagagactggagcaggccgagaagggctacgaggagtggctgctgaacgagatcagaagactggagagactggagcacctggccgagaagttcagacagaaggccagcacccacgagacctgggcctacggcaaggagcagatcctgctgcagaaggactacgagagcgccagcctgaccgaggtgagagccctgctgagaaagcacgaggccttcgagagcgacctggccgcccaccaggacagagtggagcagatcgccgccatcgcccaggagctgaacgagctggactaccacgacgccgtgaacgtgaacgacagatgccagaagatctgcgaccagtgggacagactgggcaccctgacccagaagagaagagaggccctggagagaatggagaagctgctggagaccatcgaccagctgcacctggagttcgccaagagagccgcccccttcaacaactggatggagggcgccatggaggacctgcaggacatgttcatcgtgcacagcatcgaggagatccagagcctgatcaccgcccacgagcagttcaaggccaccctgcccgaggccgacggcgagagacagagcatcatggccatccagaacgaggtggagaaggtgatccagagctacaacatcagaatcagcagcagcaacccctacagcaccgtgaccatggacgagctgagaaccaagtgggacaaggtgaagcagctggtgcccatcagagaccagagcctgcaggaggagctggccagacagcacgccaacgagagactgagaagacagttcgccgcccaggccaacgccatcggcccctggatccagaacaagatggaggagatcgccagaagcagcatccagatcaccggcgccctggaggaccagatgaaccagctgaagcagtacgagcacaacatcatcaactacaagaacaacatcgacaagctggagggcgaccaccagctgatccaggaggccctggtgttcgacaacaagcacaccaactacaccatggagcacatcagagtgggctgggagctgctgctgaccaccatcgccagaaccatcaacgaggtggagacccagatcctgaccagagacgccaagggcatcacccaggagcagatgaacgagttcagagccagcttcaaccacttcgacagaagaaagaacggcctgatggaccacgaggacttcagagcctgcctgatcagcatgggctacgacctgggcgaggccgagttcgccagaatcatgaccctggtggaccccaacggccagggcaccgtgaccttccagagcttcatcgacttcatgaccagagagaccgccgacaccgacaccgccgagcaggtgatcgccagcttcagaatcctggccagcgacaagccctacatcctggccgaggagctgagaagagagctgccccccgaccaggcccagtactgcatcaagagaatgcccgcctacagcggccccggcagcgtgcccggcgccctggactacgccgccttcagcagcgccctgtacggcgagagcgacctgtag

SEQ ID NO: 71518 - DNA, 2685 bp, Artificial Sequence
  Description of Artificial Sequence: Synthetic coding sequence
atgaaccagatcgagcccggcgtgcagtacaactacgtgtacgacgaggacgagtacatgatccaggaggaggagtgggacagagacctgctgctggaccccgcctgggagaagcagcagagaaagaccttcaccgcctggtgcaacagccacctgagaaaggccggcacccagatcgagaacatcgaggaggacttcagaaacggcctgaagctgatgctgctgctggaggtgatcagcggcgagagactgcccaagcccgacagaggcaagatgagattccacaagatcgccaacgtgaacaaggccctggactacatcgccagcaagggcgtgaagctggtgagcatcggcgccgaggagatcgtggacggcaacgtgaagatgaccctgggcatgatctggaccatcatcctgagattcgccatccaggacatcagcgtggaggagaccagcgccaaggagggcctgctgctgtggtgccagagaaagaccgccccctacagaaacgtgaacatccagaacttccacaccagctggaaggacggcctgggcctgtgcgccctgatccacagacacagacccgacctgatcgactacagcaagctgaacaaggacgaccccatcggcaacatcaacctggccatggagatcgccgagaagcacctggacatccccaagatgctggacgccgaggacctggtgtacaccgccagacccgacgagagagccatcatgacctacgtgagctgctactaccacgccttcgccggcgcccagaaggccgagaccgccgccaacagaatctgcaaggtgctggccgtgaaccaggagaacgagagactgatggaggagtacgagagactggccagcgagctgctggagtggatcagaagaaccatcccctggctggagaacagaacccccgagaagaccatgcaggccatgcagaagaagctggaggacttcagagactacagaagaaagcacaagccccccaaggtgcaggagaagtgccagctggagatcaacttcaacaccctgcagaccaagctgagaatcagcaacagacccgccttcatgcccagcgagggcaagatggtgagcgacatcgccggcgcctggcagagactggagcaggccgagaagggctacgaggagtggctgctgaacgagatcagaagactggagagactggagcacctggccgagaagttcagacagaaggccagcacccacgagacctgggcctacggcaaggagcagatcctgctgcagaaggactacgagagcgccagcctgaccgaggtgagagccctgctgagaaagcacgaggccttcgagagcgacctggccgcccaccaggacagagtggagcagatcgccgccatcgcccaggagctgaacgagctggactaccacgacgccgtgaacgtgaacgacagatgccagaagatctgcgaccagtgggacagactgggcaccctgacccagaagagaagagaggccctggagagaatggagaagctgctggagaccatcgaccagctgcacctggagttcgccaagagagccgcccccttcaacaactggatggagggcgccatggaggacctgcaggacatgttcatcgtgcacagcatcgaggagatccagagcctgatcaccgcccacgagcagttcaaggccaccctgcccgaggccgacggcgagagacagagcatcatggccatccagaacgaggtggagaaggtgatccagagctacaacatcagaatcagcagcagcaacccctacagcaccgtgaccatggacgagctgagaaccaagtgggacaaggtgaagcagctggtgcccatcagagaccagagcctgcaggaggagctggccagacagcacgccaacgagagactgagaagacagttcgccgcccaggccaacgccatcggcccctggatccagaacaagatggaggagatcgccagaagcagcatccagatcaccggcgccctggaggaccagatgaaccagctgaagcagtacgagcacaacatcatcaactacaagaacaacatcgacaagctggagggcgaccaccagctgatccaggaggccctggtgttcgacaacaagcacaccaactacaccatggagcacatcagagtgggctgggagctgctgctgaccaccatcgccagaaccatcaacgaggtggagacccagatcctgaccagagacgccaagggcatcacccaggagcagatgaacgagttcagagccagcttcaaccacttcgacagaagaaagaacggcctgatggaccacgaggacttcagagcctgcctgatcagcatgggctacgacctgggcgaggccgagttcgccagaatcatgaccctggtggaccccaacggccagggcaccgtgaccttccagagcttcatcgacttcatgaccagagagaccgccgacaccgacaccgccgagcaggtgatcgccagcttcagaatcctggccagcgacaagccctacatcctggccgaggagctgagaagagagctgccccccgaccaggcccagtactgcatcaagagaatgcccgcctacagcggccccggcagcgtgcccggcgccctggactacgccgccttcagcagcgccctgtacggcgagagcgacctgtag

SEQ ID NO: 71519 - DNA, 1992 bp, Artificial Sequence
  Description of Artificial Sequence: Synthetic coding sequence
agcaccctgagcagcgtggagggcccccccgagagcagcacctgcagctaccaggagatgagaagaagcagcgtgaacagcagcgccatggccgagaccgccgccaacagaatctgcaaggtgctggccgtgaaccaggagaacgagagactgatggaggagtacgagagactggccagcgagctgctggagtggatcagaagaaccatcccctggctggagaacagaacccccgagaagaccatgcaggccatgcagaagaagctggaggacttcagagactacagaagaaagcacaagccccccaaggtgcaggagaagtgccagctggagatcaacttcaacaccctgcagaccaagctgagaatcagcaacagacccgccttcatgcccagcgagggcaagatggtgagcgacatcgccggcgcctggcagagactggagcaggccgagaagggctacgaggagtggctgctgaacgagatcagaagactggagagactggagcacctggccgagaagttcagacagaaggccagcacccacgagacctgggcctacggcaaggagcagatcctgctgcagaaggactacgagagcgccagcctgaccgaggtgagagccctgctgagaaagcacgaggccttcgagagcgacctggccgcccaccaggacagagtggagcagatcgccgccatcgcccaggagctgaacgagctggactaccacgacgccgtgaacgtgaacgacagatgccagaagatctgcgaccagtgggacagactgggcaccctgacccagaagagaagagaggccctggagagaatggagaagctgctggagaccatcgaccagctgcacctggagttcgccaagagagccgcccccttcaacaactggatggagggcgccatggaggacctgcaggacatgttcatcgtgcacagcatcgaggagatccagagcctgatcaccgcccacgagcagttcaaggccaccctgcccgaggccgacggcgagagacagagcatcatggccatccagaacgaggtggagaaggtgatccagagctacaacatcagaatcagcagcagcaacccctacagcaccgtgaccatggacgagctgagaaccaagtgggacaaggtgaagcagctggtgcccatcagagaccagagcctgcaggaggagctggccagacagcacgccaacgagagactgagaagacagttcgccgcccaggccaacgccatcggcccctggatccagaacaagatggaggagatcgccagaagcagcatccagatcaccggcgccctggaggaccagatgaaccagctgaagcagtacgagcacaacatcatcaactacaagaacaacatcgacaagctggagggcgaccaccagctgatccaggaggccctggtgttcgacaacaagcacaccaactacaccatggagcacatcagagtgggctgggagctgctgctgaccaccatcgccagaaccatcaacgaggtggagacccagatcctgaccagagacgccaagggcatcacccaggagcagatgaacgagttcagagccagcttcaaccacttcgacagaagaaagaacggcctgatggaccacgaggacttcagagcctgcctgatcagcatgggctacgacctgggcgaggccgagttcgccagaatcatgaccctggtggaccccaacggccagggcaccgtgaccttccagagcttcatcgacttcatgaccagagagaccgccgacaccgacaccgccgagcaggtgatcgccagcttcagaatcctggccagcgacaagccctacatcctggccgaggagctgagaagagagctgccccccgaccaggcccagtactgcatcaagagaatgcccgcctacagcggccccggcagcgtgcccggcgccctggactacgccgccttcagcagcgccctgtacggcgagagcgacctgtag

SEQ ID NO: 71520 - DNA, 1167 bp, Artificial Sequence
  Description of Artificial Sequence: Synthetic coding sequence
atggagaagctgctggagaccatcgaccagctgcacctggagttcgccaagagagccgcccccttcaacaactggatggagggcgccatggaggacctgcaggacatgttcatcgtgcacagcatcgaggagatccagagcctgatcaccgcccacgagcagttcaaggccaccctgcccgaggccgacggcgagagacagagcatcatggccatccagaacgaggtggagaaggtgatccagagctacaacatcagaatcagcagcagcaacccctacagcaccgtgaccatggacgagctgagaaccaagtgggacaaggtgaagcagctggtgcccatcagagaccagagcctgcaggaggagctggccagacagcacgccaacgagagactgagaagacagttcgccgcccaggccaacgccatcggcccctggatccagaacaagatggaggagatcgccagaagcagcatccagatcaccggcgccctggaggaccagatgaaccagctgaagcagtacgagcacaacatcatcaactacaagaacaacatcgacaagctggagggcgaccaccagctgatccaggaggccctggtgttcgacaacaagcacaccaactacaccatggagcacatcagagtgggctgggagctgctgctgaccaccatcgccagaaccatcaacgaggtggagacccagatcctgaccagagacgccaagggcatcacccaggagcagatgaacgagttcagagccagcttcaaccacttcgacagaagaaagaacggcctgatggaccacgaggacttcagagcctgcctgatcagcatgggctacgacctgggcgaggccgagttcgccagaatcatgaccctggtggaccccaacggccagggcaccgtgaccttccagagcttcatcgacttcatgaccagagagaccgccgacaccgacaccgccgagcaggtgatcgccagcttcagaatcctggccagcgacaagccctacatcctggccgaggagctgagaagagagctgccccccgaccaggcccagtactgcatcaagagaatgcccgcctacagcggccccggcagcgtgcccggcgccctggactacgccgccttcagcagcgccctgtacggcgagagcgacctgtag

SEQ ID NO: 71521 - DNA, 1131 bp, Artificial Sequence
  Description of Artificial Sequence: Synthetic coding sequence
atgttcaacccccacgccctggacgtgcccgccgtgatcttcgacaacggcagcggcctgtgcaaggccggcctgagcggcgagatcggccccagacacgtgatcagcagcgtgctgggccactgcaagttcaacgtgcccctggccagactgaaccagaagtacttcgtgggccaggaggccctgtacaagtacgaggccctgcacctgcactaccccatcgagagaggcctggtgaccggctgggacgacatggagaagctgtggaagcacctgttcgagagagagctgggcgtgaagcccagccagcagcccgtgctgatgaccgagcccagcctgaaccccagagagatcagagagaagctggccgagatgatgttcgagaccttcagcgtgcccggcttctacctgagcaaccacgccgtggccgccctgtacgccagcgcctgcgtgaccggcctggtggtggacagcggcgacggcgtgacctgcaccgtgcccatcttcgagggctacagcctgccccacgccgtgaccaagctgtgcatggccggcagagacatcaccgagcacctgaccagactgctgttcgccagcggcttcaacttcccctgcatcctgaacaaggccgtggtgaacaacatcaaggagaagctgtgctacatcgccctggagcccgagaaggagctgagaaagagcagaggcgaggtgctgggcgcctacagactgcccgacggccacgtgatccacttcggcgacgagctgtaccaggtgcccgaggtgctgttcgcccccgaccagctgggcatccacagccccggcctgagcaagatggtgagcagcagcatcatgaagtgcgacaccgacatccagaacaagctgtacgccgacatcgtgctgagcggcggcaccaccctgctgcccggcctggaggagagactgatgaaggaggtggagcagctggccagcaagggcacccccatcaagatcaccgccagccccgacagatgcttcagcgcctggatcggcgccagcatcatgaccagcatgagcagcttcaagcagatgtgggtgaccagcgccgacttcaaggagtacggcaccagcgtggtgcagagaagatgcttctag

SEQ ID NO: 71522 - DNA, 1134 bp, Artificial Sequence
  Description of Artificial Sequence: Synthetic coding sequence
atgttcaacccccacgccctggacagccccgccgtgatcttcgacaacggcagcggcttctgcaaggccggcctgagcggcgagttcggccccagacacatggtgagcagcatcgtgggccacctgaagttccaggcccccagcgccgaggccaaccagaagaagtacttcgtgggcgaggaggccctgtacaagcaggaggccctgcagctgcacagccccttcgagagaggcctgatcaccggctgggacgacgtggagagactgtggaagcacctgttcgagtgggagctgggcgtgaagcccagcgaccagcccctgctggccaccgagcccagcctgaaccccagagagaacagagagaagatggccgaggtgatgttcgagaacttcggcgtgcccgccttctacctgagcgaccaggccgtgctggccctgtacgccagcgcctgcgtgaccggcctggtggtggacagcggcgacgccgtgacctgcaccgtgcccatcttcgagggctacagcctgccccacgccgtgaccaagctgcacgtggccggcagagacatcaccgagctgctgatgcagctgctgctggccagcggccacaccttcccctgccagctggacaagggcctggtggacgacatcaagaagaagctgtgctacgtggccctggagcccgagaaggagctgagcagaagacccgaggaggtgctgagagagtacaagctgcccgacggcaacatcatcagcctgggcgaccccctgcaccaggcccccgaggccctgttcgtgccccagcagctgggcagccagagccccggcctgagcaacatggtgagcagcagcatcaccaagtgcgacaccgacatccagaagatcctgttcggcgagatcgtgctgagcggcggcaccaccctgttccacggcctggacgacagactgctgaaggagctggagcagctggccagcaaggacacccccatcaagatcaccgccccccccgacagatggttcagcacctggatcggcgccagcatcgtgaccagcctgagcagcttcaagcagatgtgggtgaccgccgccgacttcaaggagttcggcaccagcgtggtgcagagaagatgcttctag

SEQ ID NO: 71523 - DNA, 987 bp, Artificial Sequence
  Description of Artificial Sequence: Synthetic coding sequence
atgttcaacccccacgccctggacagccccgccgtgatcttcgacaacggcagcggcttctgcaaggccggcctgagcggcgagttcggccccagacacatggtgagcagcatcgtgggccacctgaagttccaggcccccagcgccgaggccaaccagaagaagtacttcgtgggcgaggaggccctgtacaagcaggaggccctgcagctgcacagccccttcgagagaggcctgatcaccggctgggacgacgtggagagactgtggaagcacctgttcgagtgggagctgggcgtgaagcccagcgaccagcccctgctggccaccgagcccagcctgaaccccagagagaacagagagaagatggccgaggtgatgttcgagaacttcggcgtgcccgccttctacctgagcgaccaggccgtgctggccctgtacgccagcgcctgcgtgaccggcctggtggtggacagcggcgacgccgtgacctgcaccgtgcccatcttcgagggctacagcctgccccacgccgtgaccaagctgcacgtggccggcagagacatcaccgagctgctgatgcagctgctgctggccagcggccacaccttcccctgccagctggacaagggcctggtggacgacatcaagaagaagctgtgctacgtggccctggagcccgagaaggagctgagcagaagacccgaggaggtgctgagagagtacaagctgcccgacggcaacatcatcagcctgggcgaccccctgcaccaggcccccgaggccctgttcgtgccccagcagctgggcagccagagccccggcctgagcaacatggtgagcagcagcatcaccaagtgcgacaccgacatccagaagatcctgttcggcgagatcgtgctgagcggcggcaccaccctgttccacggcctggacgacagactgctgcacctggactggagcctgcacagacacctgagcgagtag

SEQ ID NO: 71524 - DNA, 1752 bp, Artificial Sequence
  Description of Artificial Sequence: Synthetic coding sequence
atggagagcaagggcgccagcagctgcagactgctgttctgcctgctgatcagcgccaccgtgttcagacccggcctgggctggtacaccgtgaacagcgcctacggcgacaccatcatcatcccctgcagactggacgtgccccagaacctgatgttcggcaagtggaagtacgagaagcccgacggcagccccgtgttcatcgccttcagaagcagcaccaagaagagcgtgcagtacgacgacgtgcccgagtacaaggacagactgaacctgagcgagaactacaccctgagcatcagcaacgccagaatcagcgacgagaagagattcgtgtgcatgctggtgaccgaggacaacgtgttcgaggcccccaccatcgtgaaggtgttcaagcagcccagcaagcccgagatcgtgagcaaggccctgttcctggagaccgagcagctgaagaagctgggcgactgcatcagcgaggacagctaccccgacggcaacatcacctggtacagaaacggcaaggtgctgcaccccctggagggcgccgtggtgatcatcttcaagaaggagatggaccccgtgacccagctgtacaccatgaccagcaccctggagtacaagaccaccaaggccgacatccagatgcccttcacctgcagcgtgacctactacggccccagcggccagaagaccatccacagcgagcaggccgtgttcgacatctactaccccaccgagcaggtgaccatccaggtgctgccccccaagaacgccatcaaggagggcgacaacatcaccctgaagtgcctgggcaacggcaaccccccccccgaggagttcctgttctacctgcccggccagcccgagggcatcagaagcagcaacacctacaccctgaccgacgtgagaagaaacgccaccggcgactacaagtgcagcctgatcgacaagaagagcatgatcgccagcaccgccatcaccgtgcactacctggacctgagcctgaaccccagcggcgaggtgaccagacagatcggcgacgccctgcccgtgagctgcaccatcagcgccagcagaaacgccaccgtggtgtggatgaaggacaacatcagactgagaagcagccccagcttcagcagcctgcactaccaggacgccggcaactacgtgtgcgagaccgccctgcaggaggtggagggcctgaagaagagagagagcctgaccctgatcgtggagggcaagccccagatcaagatgaccaagaagaccgaccccagcggcctgagcaagaccatcatctgccacgtggagggcttccccaagcccgccatccagtggaccatcaccggcagcggcagcgtgatcaaccagaccgaggagagcccctacatcaacggcagatactacagcaagatcatcatcagccccgaggagaacgtgaccctgacctgcaccgccgagaaccagctggagagaaccgtgaacagcctgaacgtgagcgccatcagcatccccgagcacgacgaggccgacgagatcagcgacgagaacagagagaaggtgaacgaccaggccaagctgatcgtgggcatcgtggtgggcctgctgctggccgccctggtggccggcgtggtgtactggctgtacatgaagaagagcaagaccgccagcaagcacgtgaacaaggacctgggcaacatggaggagaacaagaagctggaggagaacaaccacaagaccgaggcctag

SEQ ID NO: 71525 - DNA, 918 bp, Artificial Sequence
  Description of Artificial Sequence: Synthetic coding sequence
atggaccccgtgacccagctgtacaccatgaccagcaccctggagtacaagaccaccaaggccgacatccagatgcccttcacctgcagcgtgacctactacggccccagcggccagaagaccatccacagcgagcaggccgtgttcgacatctactacctggacctgagcctgaaccccagcggcgaggtgaccagacagatcggcgacgccctgcccgtgagctgcaccatcagcgccagcagaaacgccaccgtggtgtggatgaaggacaacatcagactgagaagcagccccagcttcagcagcctgcactaccaggacgccggcaactacgtgtgcgagaccgccctgcaggaggtggagggcctgaagaagagagagagcctgaccctgatcgtggagggcaagccccagatcaagatgaccaagaagaccgaccccagcggcctgagcaagaccatcatctgccacgtggagggcttccccaagcccgccatccagtggaccatcaccggcagcggcagcgtgatcaaccagaccgaggagagcccctacatcaacggcagatactacagcaagatcatcatcagccccgaggagaacgtgaccctgacctgcaccgccgagaaccagctggagagaaccgtgaacagcctgaacgtgagcgccatcagcatccccgagcacgacgaggccgacgagatcagcgacgagaacagagagaaggtgaacgaccaggccaagctgatcgtgggcatcgtggtgggcctgctgctggccgccctggtggccggcgtggtgtactggctgtacatgaagaagagcaagaccgccagcaagcacgtgaacaaggacctgggcaacatggaggagaacaagaagctggaggagaacaaccacaagaccgaggcctag

SEQ ID NO: 71526 - DNA, 1035 bp, Artificial Sequence
  Description of Artificial Sequence: Synthetic coding sequence
tgactgggcgactgcatcagcgaggacagctaccccgacggcaacatcacctggtacagaaacggcaaggtgctgcaccccctggagggcgccgtggtgatcatcttcaagaaggagatggaccccgtgacccagctgtacaccatgaccagcaccctggagtacaagaccaccaaggccgacatccagatgcccttcacctgcagcgtgacctactacggccccagcggccagaagaccatccacagcgagcaggccgtgttcgacatctactacctggacctgagcctgaaccccagcggcgaggtgaccagacagatcggcgacgccctgcccgtgagctgcaccatcagcgccagcagaaacgccaccgtggtgtggatgaaggacaacatcagactgagaagcagccccagcttcagcagcctgcactaccaggacgccggcaactacgtgtgcgagaccgccctgcaggaggtggagggcctgaagaagagagagagcctgaccctgatcgtggagggcaagccccagatcaagatgaccaagaagaccgaccccagcggcctgagcaagaccatcatctgccacgtggagggcttccccaagcccgccatccagtggaccatcaccggcagcggcagcgtgatcaaccagaccgaggagagcccctacatcaacggcagatactacagcaagatcatcatcagccccgaggagaacgtgaccctgacctgcaccgccgagaaccagctggagagaaccgtgaacagcctgaacgtgagcgccatcagcatccccgagcacgacgaggccgacgagatcagcgacgagaacagagagaaggtgaacgaccaggccaagctgatcgtgggcatcgtggtgggcctgctgctggccgccctggtggccggcgtggtgtactggctgtacatgaagaagagcaagaccgccagcaagcacgtgaacaaggacctgggcaacatggaggagaacaagaagctggaggagaacaaccacaagaccgaggcctag

SEQ ID NO: 71527 - DNA, 1713 bp, Artificial Sequence
  Description of Artificial Sequence: Synthetic coding sequence
atggagagcaagggcgccagcagctgcagactgctgttctgcctgctgatcagcgccaccgtgttcagacccggcctgggctggtacaccgtgaacagcgcctacggcgacaccatcatcatcccctgcagactggacgtgccccagaacctgatgttcggcaagtggaagtacgagaagcccgacggcagccccgtgttcatcgccttcagaagcagcaccaagaagagcgtgcagtacgacgacgtgcccgagtacaaggacagactgaacctgagcgagaactacaccctgagcatcagcaacgccagaatcagcgacgagaagagattcgtgtgcatgctggtgaccgaggacaacgtgttcgaggcccccaccatcgtgaaggtgttcaagcagcccagcaagcccgagatcgtgagcaaggccctgttcctggagaccgagcagctgaagaagctgggcgactgcatcagcgaggacagctaccccgacggcaacatcacctggtacagaaacggcaaggtgctgcaccccctggagggcgccgtggtgatcatcttcaagaaggagatggaccccgtgacccagctgtacaccatgaccagcaccctggagtacaagaccaccaaggccgacatccagatgcccttcacctgcagcgtgacctactacggccccagcggccagaagaccatccacagcgagcaggccgtgttcgacatctactaccccaccgagcaggtgaccatccaggtgctgccccccaagaacgccatcaaggagggcgacaacatcaccctgaagtgcctgggcaacggcaaccccccccccgaggagttcctgttctacctgcccggccagcccgagggcatcagaagcagcaacacctacaccctgaccgacgtgagaagaaacgccaccggcgactacaagtgcagcctgatcgacaagaagagcatgatcgccagcaccgccatcaccgtgcactacctggacctgagcctgaaccccagcggcgaggtgaccagacagatcggcgacgccctgcccgtgagctgcaccatcagcgccagcagaaacgccaccgtggtgtggatgaaggacaacatcagactgagaagcagccccagcttcagcagcctgcactaccaggacgccggcaactacgtgtgcgagaccgccctgcaggaggtggagggcctgaagaagagagagagcctgaccctgatcgtggagggcaagccccagatcaagatgaccaagaagaccgaccccagcggcctgagcaagaccatcatctgccacgtggagggcttccccaagcccgccatccagtggaccatcaccggcagcggcagcgtgatcaaccagaccgaggagagcccctacatcaacggcagatactacagcaagatcatcatcagccccgaggagaacgtgaccctgacctgcaccgccgagaaccagctggagagaaccgtgaacagcctgaacgtgagcgccaacgagaacagagagaaggtgaacgaccaggccaagctgatcgtgggcatcgtggtgggcctgctgctggccgccctggtggccggcgtggtgtactggctgtacatgaagaagagcaagaccgccagcaagcacgtgaacaaggacctgggcaacatggaggagaacaagaagctggaggagaacaaccacaagaccgaggcctag

SEQ ID NO: 71528 - DNA, 1074 bp, Artificial Sequence
  Description of Artificial Sequence: Synthetic coding sequence
atggaggtgctgagaccccagctgatcagaatcgacggcagaaactacagaaagaaccccgtgcaggagcagacctaccagcacgaggaggacgaggaggacttctaccagggcagcatggagtgcgccgacgagccctgcgacgcctacgaggtggagcagaccccccagggcttcagaagcaccctgagagcccccagcctgctgtacaagcacatcgtgggcaagagaggcgacaccagaaagaagatcgagatggagaccaagaccagcatcagcatccccaagcccggccaggacggcgagatcgtgatcaccggccagcacagaaacggcgtgatcagcgccagaaccagaatcgacgtgctgctggacaccttcagaagaaagcagcccttcacccacttcctggccttcttcctgaacgaggtggaggtgcaggagggcttcctgagattccaggaggaggtgctggccaagtgcagcatggaccacggcgtggacagcagcatcttccagaaccccaagaagctgcacctgaccatcggcatgctggtgctgctgagcgaggaggagatccagcagacctgcgagatgctgcagcagtgcaaggaggagttcatcaacgacatcagcggcggcaagcccctggaggtggagatggccggcatcgagtacatgaacgacgaccccggcatggtggacgtgctgtacgccaaggtgcacatgaaggacggcagcaacagactgcaggagctggtggacagagtgctggagagattccaggccagcggcctgatcgtgaaggagtggaacagcgtgaagctgcacgccaccgtgatgaacaccctgttcagaaaggaccccaacgccgagggcagatacaacctgtacaccgccgagggcaagtacatcttcaaggagagagagagcttcgacggcagaaacatcctgaagctgttcgagaacttctacttcggcagcctgaagctgaacagcatccacatcagccagagattcaccgtggacagcttcggcaactacgccagctgcggccagatcgacttcagctag

SEQ ID NO: 71529 - DNA, 1074 bp, Artificial Sequence; identical to SEQ ID NO: 71528
  Description of Artificial Sequence: Synthetic coding sequence

SEQ ID NO: 71530 - DNA, 1203 bp, Artificial Sequence
  Description of Artificial Sequence: Synthetic coding sequence
atggaggtgctgagaccccagctgatcagaatcgacggcagaaactacagaaagaaccccgtgcaggagcagacctaccagcacgaggaggacgaggaggacttctaccagggcagcatggagtgcgccgacgagccctgcgacgcctacgaggtggagcagaccccccagggcttcagaagcaccctgagagcccccagcctgctgtacaacctgatccacctgaacaccagcaacgactgcggcttccagaagatcaccctggactgccagaacatctacacctggaagagcagacacatcgtgggcaagagaggcgacaccagaaagaagatcgagatggagaccaagaccagcatcagcatccccaagcccggccaggacggcgagatcgtgatcaccggccagcacagaaacggcgtgatcagcgccagaaccagaatcgacgtgctgctggacaccttcagaagaaagcagcccttcacccacttcctggccttcttcctgaacgaggtggaggtgcaggagggcttcctgagattccaggaggaggtgctggccaagtgcagcatggaccacggcgtggacagcagcatcttccagaaccccaagaagctgcacctgaccatcggcatgctggtgctgctgagcgaggaggagatccagcagacctgcgagatgctgcagcagtgcaaggaggagttcatcaacgacatcagcggcggcaagcccctggaggtggagatggccggcatcgagtacatgaacgacgaccccggcatggtggacgtgctgtacgccaaggtgcacatgaaggacggcagcaacagactgcaggagctggtggacagagtgctggagagattccaggccagcggcctgatcgtgaaggagtggaacagcgtgaagctgcacgccaccgtgatgaacaccctgttcagaaaggaccccaacgccgagggcagatacaacctgtacaccgccgagggcaagtacatcttcaaggagagagagagcttcgacggcagaaacatcctgaagagcttcgccctgctgcccagactggagtacaacgacgccatcagcgcccactgcaacctgtgcctgcccggcagcagcgacagccccgccagcgccagccaggtggccggcatcaccggcgtgagcgacgcctacagccagagcctgcccggcaagagctag

SEQ ID NO: 71531 - DNA, 1074 bp, Artificial Sequence; identical to SEQ ID NO: 71528
  Description of Artificial Sequence: Synthetic coding sequence

SEQ ID NO: 71532 - DNA, 1203 bp, Artificial Sequence; identical to SEQ ID NO: 71530
  Description of Artificial Sequence: Synthetic coding sequence

SEQ ID NO: 71533 - DNA, 1074 bp, Artificial Sequence; identical to SEQ ID NO: 71528
  Description of Artificial Sequence: Synthetic coding sequence

SEQ ID NO: 71534 - DNA, 879 bp, Artificial Sequence
  Description of Artificial Sequence: Synthetic coding sequence
tgatacaagcacatcgtgggcaagagaggcgacaccagaaagaagatcgagatggagaccaagaccagcatcagcatccccaagcccggccaggacggcgagatcgtgatcaccggccagcacagaaacggcgtgatcagcgccagaaccagaatcgacgtgctgctggacaccttcagaagaaagcagcccttcacccacttcctggccttcttcctgaacgaggtggaggtgcaggagggcttcctgagattccaggaggaggtgctggccaagtgcagcatggaccacggcgtggacagcagcatcttccagaaccccaagaagctgcacctgaccatcggcatgctggtgctgctgagcgaggaggagatccagcagacctgcgagatgctgcagcagtgcaaggaggagttcatcaacgacatcagcggcggcaagcccctggaggtggagatggccggcatcgagtacatgaacgacgaccccggcatggtggacgtgctgtacgccaaggtgcacatgaaggacggcagcaacagactgcaggagctggtggacagagtgctggagagattccaggccagcggcctgatcgtgaaggagtggaacagcgtgaagctgcacgccaccgtgatgaacaccctgttcagaaaggaccccaacgccgagggcagatacaacctgtacaccgccgagggcaagtacatcttcaaggagagagagagcttcgacggcagaaacatcctgaagagcttcgccctgctgcccagactggagtacaacgacgccatcagcgcccactgcaacctgtgcctgcccggcagcagcgacagccccgccagcgccagccaggtggccggcatcaccgtggtgtag

SEQ ID NO: 71535 - DNA, 828 bp, Artificial Sequence
  Description of Artificial Sequence: Synthetic coding sequence
atggagaccaagaccagcatcagcatccccaagcccggccaggacggcgagatcgtgatcaccggccagcacagaaacggcgtgatcagcgccagaaccagaatcgacgtgctgctggacaccttcagaagaaagcagcccttcacccacttcctggccttcttcctgaacgaggtggaggtgcaggagggcttcctgagattccaggaggaggtgctggccaagtgcagcatggaccacggcgtggacagcagcatcttccagaaccccaagaagctgcacctgaccatcggcatgctggtgctgctgagcgaggaggagatccagcagacctgcgagatgctgcagcagtgcaaggaggagttcatcaacgacatcagcggcggcaagcccctggaggtggagatggccggcatcgagtacatgaacgacgaccccggcatggtggacgtgctgtacgccaaggtgcacatgaaggacggcagcaacagactgcaggagctggtggacagagtgctggagagattccaggccagcggcctgatcgtgaaggagtggaacagcgtgaagctgcacgccaccgtgatgaacaccctgttcagaaaggaccccaacgccgagggcagatacaacctgtacaccgccgagggcaagtacatcttcaaggagagagagagcttcgacggcagaaacatcctgaagagcttcgccctgctgcccagactggagtacaacgacgccatcagcgcccactgcaacctgtgcctgcccggcagcagcgacagccccgccagcgccagccaggtggccggcatcaccgtggtgtag

SEQ ID NO: 71536 - DNA, 372 bp, Artificial Sequence
  Description of Artificial Sequence: Synthetic coding sequence
atggaggtgctgagaccccagctgatcagaatcgacggcagaaactacagaaagaaccccgtgcaggagcagacctaccagcacgaggaggacgaggaggacttctaccagggcagcatggagtgcgccgacgagccctgcgacgcctacgaggtggagcagaccccccagggcttcagaagcaccctgagagcccccagcctgctgtacaagcacatcgtgggcaagagaggcgacaccagaaagaagatcgagatggagaccaagaccagcatcagcatccccaagcccggccaggacggcgagatcgtgatcaccggccagcacagaaacggcgtgatcagcgccagaaccagaatcgacgtgctgtag

SEQ ID NO: 71537 - DNA, 312 bp, Artificial Sequence
  Description of Artificial Sequence: Synthetic coding sequence
atggaggtgctgagaccccagctgatcagaatcgacggcagaaactacagaaagaaccccgtgcaggagcagacctaccagcacgaggaggacgaggaggacttctaccagggcagcatggagtgcgccgacgagccctgcgacgcctacgaggtggagcagaccccccagggcttcagaagcaccctgagagcccccagcctgctgtacaagcacatcgtgggcaagagaggcgacaccagaaagaagatcgagatggagaccaagaccagcatcagcatccccaagcccggccaggacggcgagatctag

SEQ ID NO: 71538 - DNA, 459 bp, Artificial Sequence
  Description of Artificial Sequence: Synthetic coding sequence
atggaggtgctgagaccccagctgatcagaatcgacggcagaaactacagaaagaaccccgtgcaggagcagacctaccagcacgaggaggacgaggaggacttctaccagggcagcatggagtgcgccgacgagccctgcgacgcctacgaggtggagcagaccccccagggcttcagaagcaccctgagagcccccagcctgctgtacaagcacatcgtgggcaagagaggcgacaccagaaagaagatcgagatggagaccaagaccagcatcagcatccccaagcccggccaggacggcgagatcgtgatcaccggccagcacagaaacggcgtgatcagcgccagaaccagaatcgacgtgctgctggacaccttcagaagaaagcagcccttcacccacttcctggccttcttcctgaacgaggtggaggtgcaggagggcttcctgagatag

SEQ ID NO: 71539 - DNA, 171 bp, Artificial Sequence
  Description of Artificial Sequence: Synthetic coding sequence
atggaggtgctgagaccccagctgatcagaatcgacggcagaaactacagaaagaaccccgtgcaggagcagacctaccagcacgaggaggacgaggaggacttctaccagggcagcatggagtgcgccgacgagccctgcgacgcctacgaggtggagcagaccccctag

SEQ ID NO: 71540 - DNA, 1140 bp, Artificial Sequence
  Description of Artificial Sequence: Synthetic coding sequence
atgatgaagtaccccggcacctggccctgccagggcatcatcggcatcagcttcggcgagagcgtgatggaggtgctgagaccccagctgatcagaatcgacggcagaaactacagaaagaaccccgtgcaggagcagacctaccagcacgaggaggacgaggaggacttctaccagggcagcatggagtgcgccgacgagccctgcgacgcctacgaggtggagcagaccccccagggcttcagaagcaccctgagagcccccagcctgctgtacaagcacatcgtgggcaagagaggcgacaccagaaagaagatcgagatggagaccaagaccagcatcagcatccccaagcccggccaggacggcgagatcgtgatcaccggccagcacagaaacggcgtgatcagcgccagaaccagaatcgacgtgctgctggacaccttcagaagaaagcagcccttcacccacttcctggccttcttcctgaacgaggtggaggtgcaggagggcttcctgagattccaggaggaggtgctggccaagtgcagcatggaccacggcgtggacagcagcatcttccagaaccccaagaagctgcacctgaccatcggcatgctggtgctgctgagcgaggaggagatccagcagacctgcgagatgctgcagcagtgcaaggaggagttcatcaacgacatcagcggcggcaagcccctggaggtggagatggccggcatcgagtacatgaacgacgaccccggcatggtggacgtgctgtacgccaaggtgcacatgaaggacggcagcaacagactgcaggagctggtggacagagtgctggagagattccaggccagcggcctgatcgtgaaggagtggaacagcgtgaagctgcacgccaccgtgatgaacaccctgttcagaaaggaccccaacgccgagggcagatacaacctgtacaccgccgagggcaagtacatcttcaaggagagagagagcttcgacggcagaaacatcctgaagctgttcgagaacttctacttcggcagcctgaagctgaacagcatccacatcagccagagattcaccgtggacagcttcggcaactacgccagctgcggccagatcgacttcagctag

SEQ ID NO: 71541 - DNA, 2274 bp, Artificial Sequence
  Description of Artificial Sequence: Synthetic coding sequence
atgcccgccctgcccctggaccagctgcagatcacccacaaggaccccaagaccggcaagctgagaaccagccccgccctgcaccccgagcagaaggccgacagatacttcgtgctgtacaagcccccccccaaggacaacatccccgccctggtggaggagtacctggagagagccaccttcgtggccaacgacctggactggctgctggccctgccccacgacaagttctggtgccaggtgatcttcgacgagaccctgcagaagtgcctggacagctacctgagatacgtgcccagaaagttcgacgagggcgtggccagcgcccccgaggtggtggacatgcagaagagactgcacagaagcgtgttcctgaccttcctgagaatgagcacccacaaggagagcaaggaccacttcatcagccccagcgccttcggcgagatcctgtacaacaacttcctgttcgacatccccaagatcctggacctgtgcgtgctgttcggcaagggcaacagccccctgctgcagaagatgatcggcaacatcttcacccagcagcccagctactacagcgacctggacgagaccctgcccaccatcctgcaggtgttcagcaacatcctgcagcactgcggcctgcagggcgacggcgccaacaccaccccccagaagctggaggagagaggcagactgacccccagcgacatgcccctgctggagctgaaggacatcgtgctgtacctgtgcgacacctgcaccaccctgtgggccttcctggacatcttccccctggcctgccagaccttccagaagcacgacttctgctacagactggccagcttctacgaggccgccatccccgagatggagagcgccatcaagaagagaagactggaggacagcaagctgctgggcgacctgtggcagagactgagccacagcagaaagaagctgatggagatcttccacatcatcctgaaccagatctgcctgctgcccatcctggagagcagctgcgacaacatccagggcttcatcgaggagttcctgcagatcttcagcagcctgctgcaggagaagagattcctgagagactacgacgccctgttccccgtggccgaggacatcagcctgctgcagcaggccagcagcgtgctggacgagaccagaaccgcctacatcctgcaggccgtggagagcgcctgggagggcgtggacagaagaaaggccaccgacgccaaggaccccagcgtgatcgaggagcccaacggcgagcccaacggcgtgaccgtgaccgccgaggccgtgagccaggccagcagccaccccgagaacagcgaggaggaggagtgcatgggcgccgccgccgccgtgggccccgccatgtgcggcgtggagctggacagcctgatcagccaggtgaaggacctgctgcccgacctgggcgagggcttcatcctggcctgcctggagtactaccactacgaccccgagcaggtgatcaacaacatcctggaggagagactggcccccaccctgagccagctggacagaaacctggacagagagatgaagcccgaccccacccccctgctgaccagcagacacaacgtgttccagaacgacgagttcgacgtgttcagcagagacagcgtggacctgagcagagtgcacaagggcaagagcaccagaaaggaggagaacaccagaagcctgctgaacgacaagagagccgtggccgcccagagacagagatacgagcagtacagcgtggtggtggaggaggtgcccctgcagcccggcgagagcctgccctaccacagcgtgtactacgaggacgagtacgacgacacctacgacggcaaccaggtgggcgccaacgacgccgacagcgacgacgagctgatcagcagaagacccttcaccatcccccaggtgctgagaaccaaggtgcccagagagggccaggaggaggacgacgacgacgaggaggacgacgccgacgaggaggcccccaagcccgaccacttcgtgcaggaccccgccgtgctgagagagaaggccgaggccagaagaatggccttcctggccaagaagggctacagacacgacagcagcaccgccgtggccggcagccccagaggccacggccagagcagagagaccacccaggagagaagaaagaaggaggccaacaaggccaccagagccaaccacaacagaagaaccatggccgacagaaagagaagcaagggcatgatccccagctag

SEQ ID NO: 71542 - DNA, 2274 bp, Artificial Sequence; identical to SEQ ID NO: 71541
  Description of Artificial Sequence: Synthetic coding sequence

SEQ ID NO: 71543 - DNA, 723 bp, Artificial Sequence
  Description of Artificial Sequence: Synthetic coding sequence
atgcccgccctgcccctggaccagctgcagatcacccacaaggaccccaagaccggcaagctgagaaccagccccgccctgcaccccgagcagaaggccgacagatacttcgtgctgtacaagcccccccccaaggacaacatccccgccctggtggaggagtacctggagagagccaccttcgtggccaacgacctggactggctgctggccctgccccacgacaagttctggtgccaggtgatcttcgacgagaccctgcagaagtgcctggacagctacctgagatacgtgcccagaaagttcgacgagggcgtggccagcgcccccgaggtggtggacatgcagaagagactgcacagaagcgtgttcctgaccttcctgagaatgagcacccacaaggagagcaaggaccacttcatcagccccagcgccttcggcgagatcctgtacaacaacttcctgttcgacatccccaagatcctggacctgtgcgtgctgttcggcaagggcaacagccccctgctgcagaagatgatcggcaacatcttcacccagcagcccagctactacagcgacctggacgagaccctgcccaccatcctgcaggtgttcagcaacatcctgcagcactgcggcctgcagggcgacggcgccaacaccaccccccagaagctggaggagagaggcagactgacccccagcgacatgcccctgctgtag

SEQ ID NO: 71544 - DNA, 2046 bp, Artificial Sequence
  Description of Artificial Sequence: Synthetic coding sequence
atgcccgccctgcccctggaccagctgcagatcacccacaaggaccccaagaccggcaagctgagaaccagccccgccctggtgatcttcgacgagaccctgcagaagtgcctggacagctacctgagatacgtgcccagaaagttcgacgagggcgtggccagcgcccccgaggtggtggacatgcagaagagactgcacagaagcgtgttcctgaccttcctgagaatgagcacccacaaggagagcaagatcctggacctgtgcgtgctgttcggcaagggcaacagccccctgctgcagaagatgatcggcaacatcttcacccagcagcccagctactacagcgacctggacgagaccctgcccaccatcctgcaggtgttcagcaacatcctgcagcactgcggcctgcagggcgacggcgccaacaccaccccccagaagctggaggagagaggcagactgacccccagcgacatgcccctgctggagctgaaggacatcgtgctgtacctgtgcgacacctgcaccaccctgtgggccttcctggacatcttccccctggcctgccagaccttccagaagcacgacttctgctacagactggccagcttctacgaggccgccatccccgagatggagagcgccatcaagaagagaagactggaggacagcaagctgctgggcgacctgtggcagagactgagccacagcagaaagaagctgatggagatcttccacatcatcctgaaccagatctgcctgctgcccatcctggagagcagctgcgacaacatccagggcttcatcgaggagttcctgcagatcttcagcagcctgctgcaggagaagagattcctgagagactacgacgccctgttccccgtggccgaggacatcagcctgctgcagcaggccagcagcgtgctggacgagaccagaaccgcctacatcctgcaggccgtggagagcgcctgggagggcgtggacagaagaaaggccaccgacgccaaggaccccagcgtgatcgaggagcccaacggcgagcccaacggcgtgaccgtgaccgccgaggccgtgagccaggccagcagccaccccgagaacagcgaggaggaggagtgcatgggcgccgccgccgccgtgggccccgccatgtgcggcgtggagctggacagcctgatcagccaggtgaaggacctgctgcccgacctgggcgagggcttcatcctggcctgcctggagtactaccactacgaccccgagcaggtgatcaacaacatcctggaggagagactggcccccaccctgagccagctggacagaaacctggacagagagatgaagcccgaccccacccccctgctgaccagcagacacaacgtgttccagaacgacgagttcgacgtgttcagcagagacagcgtggacctgagcagagtgcacaagggcaagagcaccagaaaggaggagaacaccagaagcctgctgaacgacaagagagccgtggccgcccagagacagagatacgagcagtacagcgtggtggtggaggaggtgcccctgcagcccggcgagagcctgccctaccacagcgtgtactacgaggacgagtacgacgacacctacgacggcaaccaggtgggcgccaacgacgccgacagcgacgacgagctgatcagcagaagacccttcaccatcccccaggtgctgagaaccaaggtgcccagagagggccaggaggaggacgacgacgacgaggaggacgacgccgacgaggaggcccccaagcccgaccacttcgtgcaggaccccgccgtgctgagagagaaggccgaggccagaagaatggccttcctggccaagaagggctacagacacgacagcagcaccgccgtggccggcagccccagaggccacggccagagcagagagaccacccaggagagaagaaagaaggaggccaacaaggccaccagagccaaccacaacagaagaaccatggccgacagaaagagaagcaagggcatgatccccagctag

SEQ ID NO: 71545 - DNA, 531 bp, Artificial Sequence
  Description of Artificial Sequence: Synthetic coding sequence
atggccctgcccagactgaccggcgccctgagaagcttcagcaacgtgaccaagcaggacaactacaacgaggaggtggccgacctgaagatcaagagaagcaagctgcacgagcaggtgctggacctgggcctgacctggaagaagatcatcaagttcctgaacgagaagctggagaagagcaagatgcagagcatcaacgaggacctgaaggacatcctgcacgccgccaagcagatcgtgggcaccgacaacggcagagaggccatcgagagcggcgccgccttcctgttcatgaccttccacctgaaggacagcgtgggccacaaggagaccaaggccatcaagcagatgttcggccccttccccagcagcagcgccaccgccgcctgcaacgccaccaacagaatcatcagccacttcagccaggacgacctgaccgccctggtgcagatgaccgagaaggagcacggcgacagagtgttcttcggcaagaacctggccttcagcttcgacatgcacgacctgtag

SEQ ID NO: 71546 - DNA, 336 bp, Artificial Sequence
  Description of Artificial Sequence: Synthetic coding sequence
atggccctgcccagactgaccggcgccctgagaagcttcagcaacgtgaccaagcaggacaactacaacgaggaggtggccgacctgaagatcaagagaagcaagctgcacgagcaggtgctggacctgggcctgacctggaagaagatcatcaagttcctgaacgagaagctggagaagagcaagatgcagagcatcaacgaggacctgaaggacatcctgcacgccgccaagcagatcgaggtgaactgccccttccagaagagaagactggacggcaaggaggaggacgagaagatgagcagagccagcgacagattcagaggcctgagatag

SEQ ID NO: 71547 - DNA, 6609 bp, Artificial Sequence
  Description of Artificial Sequence: Synthetic coding sequence
atggccctgcccagactgaccggcgccctgagaagcttcagcaacgtgaccaagcaggacaactacaacgaggaggtggccgacctgaagatcaagagaagcaagctgcacgagcaggtgctggacctgggcctgacctggaagaagatcatcaagttcctgaacgagaagctggagaagagcaagatgcagagcatcaacgaggacctgaaggacatcctgcacgccgccaagcagatcgtgggcaccgacaacggcagagaggccatcgagagcggcgccgccttcctgttcatgaccttccacctgaaggacagcgtgggccacaaggagaccaaggccatcaagcagatgttcggccccttccccagcagcagcgccaccgccgcctgcaacgccaccaacagaatcatcagccacttcagccaggacgacctgaccgccctggtgcagatgaccgagaaggagcacggcgacagagtgttcttcggcaagaacctggccttcagcttcgacatgcacgacctggaccacttcgacgagctgcccatcaacggcgagacccagaagaccatcagcctggactacaagaagttcctgaacgagcacctgcaggaggcctgcacccccgagctgaagcccgtggagaagaccaacggcagcttcctgtggtgcgaggtggagaagtacctgaacagcaccctgaaggagatgaccgaggtgcccagagtggaggacctgtgctgcaccctgtacgacatgctggccagcatcaagagcggcgacgagctgcaggacgagctgttcgagctgctgggccccgagggcctggagctgatcgagaagctgctgcagaacagaatcaccatcgtggacagattcctgaacagcagcaacgaccacagattccaggccctgcaggacaactgcaagaagatcctgggcgagaacgccaagcccaactacggctgccaggtgaccatccagagcgagcaggagaagcagctgatgaagcagtacagaagagaggagaagagaatcgccagaagagagaagaaggccggcgaggacctggaggtgagcgagggcctgatgtgcttcgaccccaaggagctgagaatccagagagagcaggccctgctgaacgccagaagcgtgcccatcctgagcagacagagagacgccgacgtggagaagatccactacccccacgtgtacgacagccaggccgaggccatgaagaccagcgccttcatcgccggcgccaagatgatcctgcccgagggcatccagagagagaacaacaagctgtacgaggaggtgagaatcccctacagcgagcccatgcccctgagcttcgaggagaagcccgtgtacatccaggacctggacgagatcggccagctggccttcaagggcatgaagagactgaacagaatccagagcatcgtgttcgagaccgcctacaacaccaacgagaacatgctgatctgcgcccccaccggcgccggcaagaccaacatcgccatgctgaccgtgctgcacgagatcagacagcacttccagcagggcgtgatcaagaagaacgagttcaagatcgtgtacgtggcccccatgaaggccctggccgccgagatgaccgactacttcagcagaagactggagcccctgggcatcatcgtgaaggagctgaccggcgacatgcagctgagcaagagcgagatcctgagaacccagatgctggtgaccacccccgagaagtgggacgtggtgaccagaaagagcgtgggcgacgtggccctgagccagatcgtgagactgctgatcctggacgaggtgcacctgctgcacgaggacagaggccccgtgctggagagcatcgtggccagaaccctgagacaggtggagagcacccagagcatgatcagaatcctgggcctgagcgccaccctgcccaactacctggacgtggccaccttcctgcacgtgaacccctacatcggcctgttcttcttcgacggcagattcagacccgtgcccctgggccagaccttcctgggcatcaagtgcgccaacaagatgcagcagctgaacaacatggacgaggtgtgctacgagaacgtgctgaagcaggtgaaggccggccaccaggtgatggtgttcgtgcacgccagaaacgccaccgtgagaaccgccatgagcctgatcgagagagccaagaactgcggccacatccccttcttcttccccacccagggccacgactacgtgctggccgagaagcaggtgcagagaagcagaaacaagcaggtgagagagctgttccccgacggcttcagcatccaccacgccggcatgctgagacaggacagaaacctggtggagaacctgttcagcaacggccacatcaaggtgctggtgtgcaccgccaccctggcctggggcgtgaacctgcccgcccacgccgtgatcatcaagggcacccagatctacgccgccaagagaggcagcttcgtggacctgggcatcctggacgtgatgcagatcttcggcagagccggcagaccccagttcgacaagttcggcgagggcatcatcatcaccacccacgacaagctgagccactacctgaccctgctgacccagagaaaccccatcgagagccagttcctggagagcctggccgacaacctgaacgccgagatcgccctgggcaccgtgaccaacgtggaggaggccgtgaagtggatcagctacacctacctgtacgtgagaatgagagccaaccccctggcctacggcatcagccacaaggcctaccagatcgaccccaccctgagaaagcacagagagcagctggtgatcgaggtgggcagaaagctggacaaggcccagatgatcagattcgaggagagaaccggctacttcagcagcaccgacctgggcagaaccgccagccactactacatcaagtacaacaccatcgagaccttcaacgagctgttcgacgcccacaagaccgagggcgacatcttcgccatcgtgagcaaggccgaggagttcgaccagatcaaggtgagagaggaggagatcgaggagctggacaccctgctgagcaacttctgcgagctgagcacccccggcggcgtggagaacagctacggcaagatcaacatcctgctgcagacctacatcagcagaggcgagatggacagcttcagcctgatcagcgacagcgcctacgtggcccagaacgccgccagaatcgtgagagccctgttcgagatcgccctgagaaagagatggcccaccatgacctacagactgctgaacctgagcaaggtgatcgacaagagactgtggggctgggccagccccctgagacagttcagcatcctgcccccccacatcctgaccagactggaggagaagaagctgaccgtggacaagctgaaggacatgagaaaggacgagatcggccacatcctgcaccacgtgaacatcggcctgaaggtgaagcagtgcgtgcaccagatccccagcgtgatgatggaggccagcatccagcccatcaccagaaccgtgctgagagtgaccctgagcatctacgccgacttcacctggaacgaccaggtgcacggcaccgtgggcgagccctggtggatctgggtggaggaccccaccaacgaccacatctaccacagcgagtacttcctggccctgaagaagcaggtgatcagcaaggaggcccagctgctggtgttcaccatccccatcttcgagcccctgcccagccagtactacatcagagccgtgagcgacagatggctgggcgccgaggccgtgtgcatcatcaacttccagcacctgatcctgcccgagagacaccccccccacaccgagctgctggacctgcagcccctgcccatcaccgccctgggctgcaaggcctacgaggccctgtacaacttcagccacttcaaccccgtgcagacccagatcttccacaccctgtaccacaccgactgcaacgtgctgctgggcgcccccaccggcagcggcaagaccgtggccgccgagctggccatcttcagagtgttcaacaagtaccccaccagcaaggccgtgtacatcgcccccctgaaggccctggtgagagagagaatggacgactggaaggtgagaatcgaggagaagctgggcaagaaggtgatcgagctgaccggcgacgtgacccccgacatgaagagcatcgccaaggccgacctgatcgtgaccacccccgagaagtgggacggcgtgagcagaagctggcagaacagaaactacgtgcagcaggtgaccatcctgatcatcgacgagatccacctgctgggcgaggagagaggccccgtgctggaggtgatcgtgagcagaaccaacttcatcagcagccacaccgagaagcccgtgagaatcgtgggcctgagcaccgccctggccaacgccagagacctggccgactggctgaacatcaagcagatgggcctgttcaacttcagacccagcgtgagacccgtgcccctggaggtgcacatccagggcttccccggccagcactactgccccagaatggccagcatgaacaagcccgccttccaggccatcagaagccacagccccgccaagcccgtgctgatcttcgtgagcagcagaagacagaccagactgaccgccctggagctgatcgccttcctggccaccgaggaggaccccaagcagtggctgaacatggacgagagagagatggagaacatcatcgccaccgtgagagacagcaacctgaagctgaccctggccttcggcatcggcatgcaccacgccggcctgcacgagagagacagaaagaccgtggaggagctgttcgtgaactgcaaggtgcaggtgctgatcgccaccagcaccctggcctggggcgtgaacttccccgcccacctggtgatcatcaagggcaccgagtactacgacggcaagaccagaagatacgtggacttccccatcaccgacgtgctgcagatgatgggcagagccggcagaccccagttcgacgaccagggcaaggccgtgatcctggtgcacgacatcaagaaggacttctacaagaagttcctgtacgagcccttccccgtggagagcagcctgctgggcgtgctgagcgaccacctgaacgccgagatcgccggcggcaccatcaccagcaagcaggacgccctggactacatcacctggacctacttcttcagaagactgatcatgaaccccagctactacaacctgggcgacgtgagccacgacagcgtgaacaagttcctgagccacctgatcgagaagagcctgatcgagctggagctgagctactgcatcgagatcggcgaggacaacagaagcatcgagcccctgacctacggcagaatcgccagctactactacctgaagcaccagaccgtgaagatgttcaaggacagactgaagcccgagtgcagcaccgaggagctgctgagcatcctgagcgacgccgaggagtacaccgacctgcccgtgagacacaacgaggaccacatgaacagcgagctggccaagtgcctgcccatcgagagcaacccccacagcttcgacagcccccacaccaaggcccacctgctgctgcaggcccacctgagcagagccatgctgccctgccccgactacgacaccgacaccaagaccgtgctggaccaggccctgagagtgtgccaggccatgctggacgtggccgccaaccagggctggctggtgaccgtgctgaacatcaccaacctgatccagatggtgatccagggcagatggctgaaggacagcagcctgctgaccctgcccaacatcgagaaccaccacctgcacctgttcaagaagtggaagcccatcatgaagggcccccacgccagaggcagaaccagcatcgagagcctgcccgagctgatccacgcctgcggcggcaaggaccacgtgttcagcagcatggtggagagcgagctgcacgccgccaagaccaagcaggcctggaacttcctgagccacctgcccgtgatcaacgtgggcatcagcgtgaagggcagctgggacgacctggtggagggccacaacgagctgagcgtgagcaccctgaccgccgacaagagagacgacaacaagtggatcaagctgcacgccgaccaggagtacgtgctgcaggtgagcctgcagagagtgcacttcggcttccacaagggcaagcccgagagctgcgccgtgacccccagattccccaagagcaaggacgagggctggttcctgatcctgggcgaggtggacaagagagagctgatcgccctgaagagagtgggctacatcagaaaccaccacgtggccagcctgagcttctacacccccgagatccccggcagatacatctacaccctgtacttcatgagcgactgctacctgggcctggaccagcagtacgacatctacctgaacgtgacccaggccagcctgagcgcccaggtgaacaccaaggtgagcgacagcctgaccgacctggccctgaagtag

SEQ ID NO: 71548 - DNA, 816 bp, Artificial Sequence
  Description of Artificial Sequence: Synthetic coding sequence
atggaggacagccacaagagcaccaccagcgagaccgccccccagcccggcagcgccgtgcagggcgcccacatcagccacatcgcccagcaggtgagcagcctgagcgagagcgaggagagccaggacagcagcgacagcatcggcagcagccagaaggcccacggcatcctggccagaagacccagctacagaaagatcctgaaggacctgagcagcgaggacaccagaggcagaaagggcgacggcgagaacagcggcgtgagcgccgccgtgaccagcatgagcgtgcccacccccatctaccagaccagcagcggccagtacatcgccatcgcccccaacggcgccctgcagctggccagccccggcaccgacggcgtgcagggcctgcagaccctgaccatgaccaacagcggcagcacccagcagggcaccaccatcctgcagtacgcccagaccagcgacggccagcagatcctggtgcccagcaaccaggtggtggtgcagaccgccagcggcgacatgcagacctaccagatcagaaccacccccagcgccaccagcctgccccagaccgtggtgatgaccagccccgtgaccctgaccagccagaccaccaagaccgacgacccccagctgaagagagagatcagactgatgaagaacagagaggccgccagagagtgcagaagaaagaagaaggagtacgtgaagtgcctggagaacagagtggccgtgctggagaaccagaacaagaccctgatcgaggagctgaagaccctgaaggacctgtacagcaacaagagcgtgtag

SEQ ID NO: 71549 - DNA, 411 bp, Artificial Sequence
  Description of Artificial Sequence: Synthetic coding sequence
atgaccaacagcggcagcacccagcagggcaccaccatcctgcagtacgcccagaccagcgacggccagcagatcctggtgcccagcaaccaggtggtggtgcagaccgccagcggcgacatgcagacctaccagatcagaaccacccccagcgccaccagcctgccccagaccgtggtgatgaccagccccgtgaccctgaccagccagaccaccaagaccgacgacccccagctgaagagagagatcagactgatgaagaacagagaggccgccagagagtgcagaagaaagaagaaggagtacgtgaagtgcctggagaacagagtggccgtgctggagaaccagaacaagaccctgatcgaggagctgaagaccctgaaggacctgtacagcaacaagagcgtgtag

SEQ ID NO: 71550 - DNA, 603 bp, Artificial Sequence
  Description of Artificial Sequence: Synthetic coding sequence
atggaggacagccacaagagcaccaccagcgagaccgccccccagcccggcagcgccgtgcagggcgcccacatcagccacatcgcccagcaggtgagcagcctgagcgagagcgaggagagccaggacagcagcgacagcatcggcagcagccagaaggcccacggcatcctggccagaagacccagctacagaaagatcctgaaggacctgagcagcgaggacaccagaggcagaaagggcgacggcgagaacagcggcgtgagcgccgccgtgaccagcatgagcgtgcccacccccatctaccagaccagcagcggccagtacatcgccatcgcccccaacggcgccctgcagctggccagccccggcaccgacggcgtgcagggcctgcagaccctgaccatgaccaacagcggcagcacccagcagggcaccaccatcctgcagtacgcccagaccagcgacggccagcagatcctggtgcccagcaaccaggtggtggtgcagaccgccagcggcgacatgcagacctaccagatcagaaccacccccagcgccaccagcctgccccagaccgtggtgatgaccagccccgtgtag

SEQ ID NO: 71551 - DNA, 513 bp, Artificial Sequence
  Description of Artificial Sequence: Synthetic coding sequence
atggaggacagccacaagagcaccaccagcgagaccgccccccagcccggcagcgccgtgcagggcgcccacatcagccacatcgcccagcaggtgagcagcctgagcgagagcgaggagagccaggacagcagcgacagcatcggcagcagccagaaggcccacggcatcctggccagaagacccagctacagaaagatcctgaaggacctgagcagcgaggacaccagaggcagaaagggcgacggcgagaacagcggcgtgagcgccgccgtgaccagcatgagcgtgcccacccccatctaccagaccagcagcggccagtacatcgccatcgcccccaacggcgccctgcagctggccagccccggcaccgacggcgtgcagggcctgcagaccctgaccatgaccaacagcggcagcacccagcagggcaccaccatcctgcagtacgcccagaccagcgacggccagcagatcctggtgcccagcaaccaggtggtggtgcagtag

SEQ ID NO: 71552 - DNA, 321 bp, Artificial Sequence
  Description of Artificial Sequence: Synthetic coding sequence
atgatgctgcagcaccccggccaggtgagcgccagcgaggaggagctgagattcgccatccagaacaagcacctgtgccacagaatgagcagcgccctggagagcgtgaccgtgagcgacagacccctgggcgtgagcatcaccaaggccgaggtggcccccgaggaggacgagagaaagaagagaagaagagagagaaacaagatcgccgccgccaagtgcagaaacaagaagaaggagaagaccgagtgcctgcagaagctgcccagacccttctgggtgcagaagacctgcatctgggccgtggacagctgcaagtag

SEQ ID NO: 71553 - DNA, 546 bp, Artificial Sequence
  Description of Artificial Sequence: Synthetic coding sequence
atgatgctgcagcaccccggccaggtgagcgccagcgaggtgagcgccagcgccatcgtgccctgcctgagcccccccggcagcctggtgttcgaggacttcgccaacctgacccccttcgtgaaggaggagctgagattcgccatccagaacaagcacctgtgccacagaatgagcagcgccctggagagcgtgaccgtgagcgacagacccctgggcgtgagcatcaccaaggccgaggtggcccccgaggaggacgagagaaagaagagaagaagagagagaaacaagatcgccgccgccaagtgcagaaacaagaagaaggagaagaccgagtgcctgcagaaggagagcgagaagctggagagcgtgaacgccgagctgaaggcccagatcgaggagctgaagaacgagaagcagcacctgatctacatgctgaacctgcacagacccacctgcatcgtgagagcccagaacggcagaacccccgaggacgagagaaacctgttcatccagcagatcaaggagggcaccctgcagagctag

SEQ ID NO: 71554 - DNA, 528 bp, Artificial Sequence
  Description of Artificial Sequence: Synthetic coding sequence
atgatgctgcagcaccccggccaggtgagcgccagcgaggtgagcgccagcgccatcgtgccctgcctgagcccccccggcagcctggtgttcgaggacttcgccaacctgacccccttcgtgaaggaggagctgagattcgccatccagaacaagcacctgtgccacagaatgagcagcgccctggagagcgtgaccgtgagcgacagacccctgggcgtgagcatcaccaaggccgaggtggcccccgaggaggacgagagaaagaagagaagaagagagagaaacaagatcgccgccgccaagtgcagaaacaagaagaaggagaagaccgagtgcctgcagaaggagagcgagaagctggagagcgtgaacgccgagctgaaggcccagatcgaggagctgaagaacgagaagcagcacctgatctacatgctgaacctgcacagacccacctgcatcgtgagagcccagaacggcagaacccccgaggacgagagaaacctgttcatccagcagatcaagtag

SEQ ID NO: 71555 - DNA, 408 bp, Artificial Sequence
  Description of Artificial Sequence: Synthetic coding sequence
atgatgctgcagcaccccggccaggtgagcgccagcgaggtgagcgccagcgccatcgtgccctgcctgagcccccccggcagcctggtgttcgaggacttcgccaacctgacccccttcgtgaaggaggagctgagattcgccatccagaacaagcacctgtgccacagaatgagcagcgccctggagagcgtgaccgtgagcgacagacccctgggcgtgagcatcaccaaggccgaggtggcccccgaggaggacgagagaaagaagagaagaagagagagaaacaagatcgccgccgccaagtgcagaaacaagaagaaggagaagaccgagtgcctgcagaagctgcccagacccttctgggtgcagaagacctgcatctgggccgtggacagctgcaagtag

SEQ ID NO: 71556 - DNA, 375 bp, Artificial Sequence
  Description of Artificial Sequence: Synthetic coding sequence
atgagcagcgccctggagagcgtgaccgtgagcgacagacccctgggcgtgagcatcaccaaggccgaggtggcccccgaggaggacgagagaaagaagagaagaagagagagaaacaagatcgccgccgccaagtgcagaaacaagaagaaggagaagaccgagtgcctgcagaaggagagcgagaagctggagagcgtgaacgccgagctgaaggcccagatcgaggagctgaagaacgagaagcagcacctgatctacatgctgaacctgcacagacccacctgcatcgtgagagcccagaacggcagaacccccgaggacgagagaaacctgttcatccagcagatcaaggagggcaccctgcagagctag

SEQ ID NO: 71557 - DNA, 546 bp, Artificial Sequence; identical to SEQ ID NO: 71553
  Description of Artificial Sequence: Synthetic coding sequence

SEQ ID NO: 71558 - DNA, 408 bp, Artificial Sequence; identical to SEQ ID NO: 71555
  Description of Artificial Sequence: Synthetic coding sequence

SEQ ID NO: 71559 - DNA, 1056 bp, Artificial Sequence
  Description of Artificial Sequence: Synthetic coding sequence
atgaccgagatgagcttcctgagcagcgaggtgctggtgggcgacctgatgagccccttcgaccagagcggcctgggcgccgaggagagcctgggcctgctggacgactacctggaggtggccaagcacttcaagccccacggcttcagcagcgacaaggccaaggccggcagcagcgagtggctggccgtggacggcctggtgagccccagcaacaacagcaaggaggacgccttcagcggcaccgactggatgctggagaagatggacctgaaggagttcgacctggacgccctgctgggcatcgacgacctggagaccatgcccgacgacctgctgaccaccctggacgacacctgcgacctgttcgcccccctggtgcaggagaccaacaagcagcccccccagaccgtgaaccccatcggccacctgcccgagagcctgaccaagcccgaccaggtggcccccttcaccttcctgcagcccctgcccctgagccccggcgtgctgagcagcacccccgaccacagcttcagcctggagctgggcagcgaggtggacatcaccgagggcgacagaaagcccgactacaccgcctacgtggccatgatcccccagtgcatcaaggaggaggacacccccagcgacaacgacagcggcatctgcatgagccccgagagctacctgggcagcccccagcacagccccagcaccagaggcagccccaacagaagcctgcccagccccggcgtgctgtgcggcagcgccagacccaagccctacgacccccccggcgagaagatggtggccgccaaggtgaagggcgagaagctggacaagaagctgaagaagatggagcagaacaagaccgccgccaccagatacagacagaagaagagagccgagcaggaggccctgaccggcgagtgcaaggagctggagaagaagaacgaggccctgaaggagagagccgacagcctggccaaggagatccagtacctgaaggacctgatcgaggaggtgagaaaggccagaggcaagaagagagtgccctag

SEQ ID NO: 71560 - DNA, 1056 bp, Artificial Sequence; identical to SEQ ID NO: 71559
  Description of Artificial Sequence: Synthetic coding sequence

SEQ ID NO: 71561 - DNA, 1056 bp, Artificial Sequence; identical to SEQ ID NO: 71559
  Description of Artificial Sequence: Synthetic coding sequence

SEQ ID NO: 71562 - DNA, 849 bp, Artificial Sequence
  Description of Artificial Sequence: Synthetic coding sequence
atgagcctgctggccaccctgggcctggagctggacagagccctgctgcccgccagcggcctgggctggctggtggactacggcaagctgccccccgcccccgcccccctggccccctacgaggtgctgggcggcgccctggagggcggcctgcccgtgggcggcgagcccctggccggcgacggcttcagcgactggatgaccgagagagtggacttcaccgccctgctgcccctggagccccccctgccccccggcaccctgccccagcccagccccaccccccccgacctggaggccatggccagcctgctgaagaaggagctggagcagatggaggacttcttcctggacgccccccccctgcccccccccagccccccccccctgccccccccccccctgccccccgcccccagcctgcccctgagcctgcccagcttcgacctgccccagccccccgtgctggacaccctggacctgctggccatctactgcagaaacgaggccggccaggaggaggtgggcatgccccccctgccccccccccagcagccccccccccccagccccccccagcccagcagactggccccctacccccaccccgccaccaccagaggcgacagaaagcagaagaagagagaccagaacaagagcgccgccctgagatacagacagagaaagagagccgagggcgaggccctggagggcgagtgccagggcctggaggccagaaacagagagctgaaggagagagccgagagcgtggagagagagatccagtacgtgaaggacctgctgatcgaggtgtacaaggccagaagccagagaaccagaagctgctag

SEQ ID NO: 71563 - DNA, 2013 bp, Artificial Sequence
  Description of Artificial Sequence: Synthetic coding sequence
atgggcgagcccgccggcgtggccggcaccatggagagccccttcagccccggcctgttccacagactggacgaggactgggacagcgccctgttcgccgagctgggctacttcaccgacaccgacgagctgcagctggaggccgccaacgagacctacgagaacaacttcgacaacctggacttcgacctggacctgatgccctgggagagcgacatctgggacatcaacaaccagatctgcaccgtgaaggacatcaaggccgagccccagcccctgagccccgccagcagcagctacagcgtgagcagccccagaagcgtggacagctacagcagcacccagcacgtgcccgaggagctggacctgagcagcagcagccagatgagccccctgagcctgtacggcgagaacagcaacagcctgagcagcgccgagcccctgaaggaggacaagcccgtgaccggccccagaaacaagaccgagaacggcctgacccccaagaagaagatccaggtgaacagcaagcccagcatccagcccaagcccctgctgctgcccgccgcccccaagacccagaccaacagcagcgtgcccgccaagaccatcatcatccagaccgtgcccaccctgatgcccctggccaagcagcagcccatcatcagcctgcagcccgcccccaccaagggccagaccgtgctgctgagccagcccaccgtggtgcagctgcaggcccccggcgtgctgcccagcgcccagcccgtgctggccgtggccggcggcgtgacccagctgcccaaccacgtggtgaacgtggtgcccgcccccagcgccaacagccccgtgaacggcaagctgagcgtgaccaagcccgtgctgcagagcaccatgagaaacgtgggcagcgacatcgccgtgctgagaagacagcagagaatgatcaagaacagagagagcgcctgccagagcagaaagaagaagaaggagtacatgctgggcctggaggccagactgaaggccgccctgagcgagaacgagcagctgaagaaggagaacggcaccctgaagagacagctggacgaggtggtgagcgagaaccagagactgaaggtgcccagccccaagagaagagtggtgtgcgtgatgatcgtgctggccttcatcatcctgaactacggccccatgagcatgctggagcaggacagcagaagaatgaaccccagcgtgagccccgccaaccagagaagacacctgctgggcttcagcgccaaggaggcccaggacaccagcgacggcatcatccagaagaacagctacagatacgaccacagcgtgagcaacgacaaggccctgatggtgctgaccgaggagcccctgctgtacatccccccccccccctgccagcccctgatcaacaccaccgagagcctgagactgaaccacgagctgagaggctgggtgcacagacacgaggtggagagaaccaagagcagaagaatgaccaacaaccagcagaagaccagaatcctgcagggcgccctggagcagggcagcaacagccagctgatggccgtgcagtacaccgagaccaccagcagcatcagcagaaacagcggcagcgagctgcaggtgtactacgccagccccagaagctaccaggacttcttcgaggccatcagaagaagaggcgacaccttctacgtggtgagcttcagaagagaccacctgctgctgcccgccaccacccacaacaagaccaccagacccaagatgagcatcgtgctgcccgccatcaacatcaacgagaacgtgatcaacggccaggactacgaggtgatgatgcagatcgactgccaggtgatggacaccagaatcctgcacatcaagagcagcagcgtgcccccctacctgagagaccagcagagaaaccagaccaacaccttcttcggcagcccccccgccgccaccgaggccacccacgtggtgagcaccatccccgagagcctgcagtag

SEQ ID NO: 71564 - DNA, 2112 bp, Artificial Sequence
  Description of Artificial Sequence: Synthetic coding sequence
atggccgagctgatgctgctgagcgagatcgccgaccccaccagattcttcaccgacaacctgctgagccccgaggactggggcctgcagaacagcaccctgtacagcggcctggacgaggtggccgaggagcagacccagctgttcagatgccccgagcaggacgtgcccttcgacggcagcagcctggacgtgggcatggacgtgagccccagcgagcccccctgggagctgctgcccatcttccccgacctgcaggtgaagagcgagcccagcagcccctgcagcagcagcagcctgagcagcgagagcagcagactgagcaccgagcccagcagcgaggccctgggcgtgggcgaggtgctgcacgtgaagaccgagagcctggccccccccctgtgcctgctgggcgacgaccccaccagcagcttcgagaccgtgcagatcaacgtgatccccaccagcgacgacagcagcgacgtgcagaccaagatcgagcccgtgagcccctgcagcagcgtgaacagcgaggccagcctgctgagcgccgacagcagcagccaggccttcatcggcgaggaggtgctggaggtgaagaccgagagcctgagccccagcggctgcctgctgtgggacgtgcccgcccccagcctgggcgccgtgcagatcagcatgggccccagcctggacggcagcagcggcaaggccctgcccaccagaaagccccccctgcagcccaagcccgtggtgctgaccaccgtgcccatgcccagcagagccgtgccccccagcaccaccgtgctgctgcagagcctggtgcagcccccccccgtgagccccgtggtgctgatccagggcgccatcagagtgcagcccgagggccccgcccccagcctgcccagacccgagagaaagagcatcgtgcccgcccccatgcccggcaacagctgcccccccgaggtggacgccaagctgctgaagagacagcagagaatgatcaagaacagagagagcgcctgccagagcagaagaaagaagaaggagtacctgcagggcctggaggccagactgcaggccgtgctggccgacaaccagcagctgagaagagagaacgccgccctgagaagaagactggaggccctgctggccgagaacagcgagctgaagctgggcagcggcaacagaaaggtggtgtgcatcatggtgttcctgctgttcatcgccttcaacttcggccccgtgagcatcagcgagccccccagcgcccccatcagccccagaatgaacaagggcgagccccagcccagaagacacctgctgggcttcagcgagcaggagcccgtgcagggcgtggagcccctgcagggcagcagccagggccccaaggagccccagcccagccccaccgaccagcccagcttcagcaacctgaccgccttccccggcggcgccaaggagctgctgctgagagacctggaccagctgttcctgagcagcgactgcagacacttcaacagaaccgagagcctgagactggccgacgagctgagcggctgggtgcagagacaccagagaggcagaagaaagatcccccagagagcccaggagagacagaagagccagcccagaaagaagagcccccccgtgaaggccgtgcccatccagccccccggcccccccgagagagacagcgtgggccagctgcagctgtacagacaccccgacagaagccagcccgccttcctggacgccatcgacagaagagaggacaccttctacgtggtgagcttcagaagagaccacctgctgctgcccgccatcagccacaacaagaccagcagacccaagatgagcctggtgatgcccgccatggcccccaacgagaccctgagcggcagaggcgcccccggcgactacgaggagatgatgcagatcgagtgcgaggtgatggacaccagagtgatccacatcaagaccagcaccgtgccccccagcctgagaaagcagcccagccccacccccggcaacgccaccggcggccccctgcccgtgagcgccgccagccaggcccaccaggccagccaccagcccctgtacctgaaccacccctag

SEQ ID NO: 71565 - DNA, 669 bp, Artificial Sequence
  Description of Artificial Sequence: Synthetic coding sequence
atggccgagctgatgctgctgagcgagatcgccgaccccaccagattcttcaccgacaacctgctgagccccgaggactggggcctgcagaacagcaccctgtacagcggcctggacgaggtggccgaggagcagacccagctgttcagatgccccgagcaggacgtgcccttcgacggcagcagcctggacgtgggcatggacgtgagccccaccgaccagcccagcttcagcaacctgaccgccttccccggcggcgccaaggagctgctgctgagagacctggaccagctgttcctgagcagcgactgcagacacttcaacagaaccgagagcctgagactggccgacgagctgagcggctgggtgcagagacaccagagaggcagaagaaagatcccccagagagcccaggagagacagaagagccagcccagaaagaagagcccccccgtgaaggccgtgcccatccagccccccggcccccccgagagagacagcgtgggccagctgcagctgtacagacaccccgacagaagccagcccgccttcctggacgccatcgacagaagagaggacaccttctacgtggtgagcttcagaagaaccacctgctgcagccagcccagcgccaccaccagaccccccggccccagatgcccctggtag

SEQ ID NO: 71566 - DNA, 2103 bp, Artificial Sequence
  Description of Artificial Sequence: Synthetic coding sequence
atggccgagctgatgctgctgagcgagatcgccgaccccaccagattcttcaccgacaacctgctgagccccgaggactgggacagcaccctgtacagcggcctggacgaggtggccgaggagcagacccagctgttcagatgccccgagcaggacgtgcccttcgacggcagcagcctggacgtgggcatggacgtgagccccagcgagcccccctgggagctgctgcccatcttccccgacctgcaggtgaagagcgagcccagcagcccctgcagcagcagcagcctgagcagcgagagcagcagactgagcaccgagcccagcagcgaggccctgggcgtgggcgaggtgctgcacgtgaagaccgagagcctggccccccccctgtgcctgctgggcgacgaccccaccagcagcttcgagaccgtgcagatcaacgtgatccccaccagcgacgacagcagcgacgtgcagaccaagatcgagcccgtgagcccctgcagcagcgtgaacagcgaggccagcctgctgagcgccgacagcagcagccaggccttcatcggcgaggaggtgctggaggtgaagaccgagagcctgagccccagcggctgcctgctgtgggacgtgcccgcccccagcctgggcgccgtgcagatcagcatgggccccagcctggacggcagcagcggcaaggccctgcccaccagaaagccccccctgcagcccaagcccgtggtgctgaccaccgtgcccatgcccagcagagccgtgccccccagcaccaccgtgctgctgcagagcctggtgcagcccccccccgtgagccccgtggtgctgatccagggcgccatcagagtgcagcccgagggccccgcccccagcctgcccagacccgagagaaagagcatcgtgcccgcccccatgcccggcaacagctgcccccccgaggtggacgccaagctgctgaagagacagcagagaatgatcaagaacagagagagcgcctgccagagcagaagaaagaagaaggagtacctgcagggcctggaggccagactgcaggccgtgctggccgacaaccagcagctgagaagagagaacgccgccctgagaagaagactggaggccctgctggccgagaacagcgagctgaagctgggcagcggcaacagaaaggtggtgtgcatcatggtgttcctgctgttcatcgccttcaacttcggccccgtgagcatcagcgagccccccagcgcccccatcagccccagaatgaacaagggcgagccccagcccagaagacacctgctgggcttcagcgagcaggagcccgtgcagggcgtggagcccctgcagggcagcagccagggccccaaggagccccagcccagccccaccgaccagcccagcttcagcaacctgaccgccttccccggcggcgccaaggagctgctgctgagagacctggaccagctgttcctgagcagcgactgcagacacttcaacagaaccgagagcctgagactggccgacgagctgagcggctgggtgcagagacaccagagaggcagaagaaagatcccccagagagcccaggagagacagaagagccagcccagaaagaagagcccccccgtgaaggccgtgcccatccagccccccggcccccccgagagagacagcgtgggccagctgcagctgtacagacaccccgacagaagccagcccgccttcctggacgccatcgacagaagagaggacaccttctacgtggtgagcttcagaagagaccacctgctgctgcccgccatcagccacaacaagaccagcagacccaagatgagcctggtgatgcccgccatggcccccaacgagaccctgagcggcagaggcgcccccggcgactacgaggagatgatgcagatcgagtgcgaggtgatggacaccagagtgatccacatcaagaccagcaccgtgccccccagcctgagaaagcagcccagccccacccccggcaacgccaccggcggccccctgcccgtgagcgccgccagccaggcccaccaggccagccaccagcccctgtacctgaaccacccctag

SEQ ID NO: 71567 - DNA, 2112 bp, Artificial Sequence; identical to SEQ ID NO: 71564
  Description of Artificial Sequence: Synthetic coding sequence

SEQ ID NO: 71568 - DNA, 2103 bp, Artificial Sequence; identical to SEQ ID NO: 71566
  Description of Artificial Sequence: Synthetic coding sequence

SEQ ID NO: 71569 - DNA, 429 bp, Artificial Sequence
  Description of Artificial Sequence: Synthetic coding sequence
tgacagcccagccccaccgaccagcccagcttcagcaacctgaccgccttccccggcggcgccaaggagctgctgctgagagacctggaccagctgttcctgagcagcgactgcagacacttcaacagaaccgagagcctgagactggccgacgagctgagcggctgggtgcagagacaccagagaggcagaagaaagatcccccagagagcccaggagagacagagcctggacaccagccccagcagaagcctgagccacggcagaagccacctgcagctgagacagagccccagcaaccccctggacccccagaagggcatcctgtgggccagctgcaactacatcgccacccagaccgtgagaagccagcacagctggatgcagctgaccgacggcaagacccacttcatgctgagcctgagctag

SEQ ID NO: 71570 - DNA, 429 bp, Artificial Sequence; identical to SEQ ID NO: 71569
  Description of Artificial Sequence: Synthetic coding sequence

SEQ ID NO: 71571 - DNA, 2112 bp, Artificial Sequence; identical to SEQ ID NO: 71564
  Description of Artificial Sequence: Synthetic coding sequence

SEQ ID NO: 71572 - DNA, 2112 bp, Artificial Sequence; identical to SEQ ID NO: 71564
  Description of Artificial Sequence: Synthetic coding sequence

SEQ ID NO: 71573 - DNA, 2103 bp, Artificial Sequence; identical to SEQ ID NO: 71566
  Description of Artificial Sequence: Synthetic coding sequence

SEQ ID NO: 71574 - DNA, 429 bp, Artificial Sequence; identical to SEQ ID NO: 71569
  Description of Artificial Sequence: Synthetic coding sequence

SEQ ID NO: 71575 - DNA, 2103 bp, Artificial Sequence; identical to SEQ ID NO: 71566
  Description of Artificial Sequence: Synthetic coding sequence

SEQ ID NO: 71576 - DNA, 429 bp, Artificial Sequence; identical to SEQ ID NO: 71569
  Description of Artificial Sequence: Synthetic coding sequence

SEQ ID NO: 71577 - DNA, 669 bp, Artificial Sequence; identical to SEQ ID NO: 71565
  Description of Artificial Sequence: Synthetic coding sequence

SEQ ID NO: 71578 - DNA, 669 bp, Artificial Sequence; identical to SEQ ID NO: 71565
  Description of Artificial Sequence: Synthetic coding sequence

SEQ ID NO: 71579 - DNA, 669 bp, Artificial Sequence; identical to SEQ ID NO: 71565
  Description of Artificial Sequence: Synthetic coding sequence

SEQ ID NO: 71580 - DNA, 924 bp, Artificial Sequence
  Description of Artificial Sequence: Synthetic coding sequence
atgggcgacgacagacccttcgtgtgcaacgcccccggctgcggccagagattcaccaacgaggaccacctggccgtgcacaagcacaagcacgagatgaccctgaagttcggccccgccagaaccgacagcgtgatcatcgccgaccagacccccacccccaccagattcctgaagaactgcgaggaggtgggcctgttcaacgagctggccagcagcttcgagcacgagttcaagaaggccgccgacgaggacgagaagaaggccgccgccggccccctggacatgagcctgcccagcacccccgacatcaagatcaaggaggaggagcccgtggaggtggacagcagcccccccgacagccccgccagcagcccctgcagcccccccctgaaggagaagagccccgcccagcccacccccagcaccggcggcagaagaagaagaaccgtggacgaggaccccgacgagagaagacagagattcctggagagaaacagagccgccgccagcagatgcagacagaagagaaagctgtgggtgagcagcctggagaagaaggccgaggagctgaccagccagaacatccagctgagcaacgaggtgaccctgctgagaaacgaggtggcccagctgaagcagctgctgctggcccacaaggactgccccgtgaccgccctgcagaagaagacccagggctacctggagagccccaaggagagcagcgagcccaccggcagccccgcccccgtgatccagcacagcagcgccaccgcccccagcaacggcctgagcgtgagaagcgccgccgaggccgtggccaccagcgtgctgacccagatggccagccagagaaccgagctgagcatgcccatccagagccacgtgatcatgaccccccagagccagagcgccggcagatag

SEQ ID NO: 71581 - DNA, 1485 bp, Artificial Sequence
  Description of Artificial Sequence: Synthetic coding sequence
atgggcgacgacagacccttcgtgtgcaacgcccccggctgcggccagagattcaccaacgaggaccacctggccgtgcacaagcacaagcacgagatgaccctgaagttcggccccgccagaaccgacagcgtgatcatcgccgaccagacccccacccccaccagattcctgaagaactgcgaggaggtgggcctgttcaacgagctggccagcagcttcgagcacgagttcaagaaggccgccgacgaggacgagaagaaggccagaagcagaaccgtggccaagaagctggtggccgccgccggccccctggacatgagcctgcccagcacccccgacatcaagatcaaggaggaggagcccgtggaggtggacagcagcccccccgacagccccgccagcagcccctgcagcccccccctgaaggagaaggaggtgacccccaagcccgtgctgatcagcacccccacccccaccatcgtgagacccggcagcctgcccctgcacctgggctacgaccccctgcaccccaccctgcccagccccaccagcgtgatcacccaggccccccccagcaacagacagatgggcagccccaccggcagcctgcccctggtgatgcacctggccaacggccagaccatgcccgtgctgcccggcccccccgtgcagatgcccagcgtgatcagcctggccagacccgtgagcatggtgcccaacatccccggcatccccggcccccccgtgaacagcagcggcagcatcagccccagcggccaccccatccccagcgaggccaagatgagactgaaggccaccctgacccaccaggtgagcagcatcaacggcggctgcggcatggtggtgggcaccgccagcaccatggtgaccgccagacccgagcagagccagatcctgatccagcaccccgacgcccccagccccgcccagccccaggtgagccccgcccagcccacccccagcaccggcggcagaagaagaagaaccgtggacgaggaccccgacgagagaagacagagattcctggagagaaacagagccgccgccagcagatgcagacagaagagaaagctgtgggtgagcagcctggagaagaaggccgaggagctgaccagccagaacatccagctgagcaacgaggtgaccctgctgagaaacgaggtggcccagctgaagcagctgctgctggcccacaaggactgccccgtgaccgccctgcagaagaagacccagggctacctggagagccccaaggagagcagcgagcccaccggcagccccgcccccgtgatccagcacagcagcgccaccgcccccagcaacggcctgagcgtgagaagcgccgccgaggccgtggccaccagcgtgctgacccagatggccagccagagaaccgagctgagcatgcccatccagagccacgtgatcatgaccccccagagccagagcgccggcagatag

SEQ ID NO: 71582 - DNA, 1389 bp, Artificial Sequence
  Description of Artificial Sequence: Synthetic coding sequence
atgggcgacgacagacccttcgtgtgcaacgcccccggctgcggccagagattcaccaacgaggaccacctggccgtgcacaagcacaagcacgagatgaccctgaagttcggccccgccagaaccgacagcgtgatcatcgccgaccagacccccacccccaccagattcctgaagaactgcgaggaggtgggcctgttcaacgagctggccagcagcttcgagcacgagttcaagaaggccgccgacgaggacgagaagaaggccgccgccggccccctggacatgagcctgcccagcacccccgacatcaagatcaaggaggaggagcccgtggaggaggtgacccccaagcccgtgctgatcagcacccccacccccaccatcgtgagacccggcagcctgcccctgcacctgggctacgaccccctgcaccccaccctgcccagccccaccagcgtgatcacccaggccccccccagcaacagacagatgggcagccccaccggcagcctgcccctggtgatgcacctggccaacggccagaccatgcccgtgctgcccggcccccccgtgcagatgcccagcgtgatcagcctggccagacccgtgagcatggtgcccaacatccccggcatccccggcccccccgtgaacagcagcggcagcatcagccccagcggccaccccatccccagcgaggccaagatgagactgaaggccaccctgacccaccaggtgagcagcatcaacggcggctgcggcatggtggtgggcaccgccagcaccatggtgaccgccagacccgagcagagccagatcctgatccagcaccccgacgcccccagccccgcccagccccaggtgagccccgcccagcccacccccagcaccggcggcagaagaagaagaaccgtggacgaggaccccgacgagagaagacagagattcctggagagaaacagagccgccgccagcagatgcagacagaagagaaagctgtgggtgagcagcctggagaagaaggccgaggagctgaccagccagaacatccagctgagcaacgaggtgaccctgctgagaaacgaggtggcccagctgaagcagctgctgctggcccacaaggactgccccgtgaccgccctgcagaagaagacccagggctacctggagagccccaaggagagcagcgagcccaccggcagccccgcccccgtgatccagcacagcagcgccaccgcccccagcaacggcctgagcgtgagaagcgccgccgaggccgtggccaccagcgtgctgacccagatggccagccagagaaccgagctgagcatgcccatccagagccacgtgatcatgaccccccagagccagagcgccggcagatag

SEQ ID NO: 71583 - DNA, 1452 bp, Artificial Sequence
  Description of Artificial Sequence: Synthetic coding sequence
atgggcgacgacagacccttcgtgtgcaacgcccccggctgcggccagagattcaccaacgaggaccacctggccgtgcacaagcacaagcacgagatgaccctgaagttcggccccgccagaaccgacagcgtgatcatcgccgaccagacccccacccccaccagattcctgaagaactgcgaggaggtgggcctgttcaacgagctggccagcagcttcgagcacgagttcaagaaggccgccgacgaggacgagaagaaggccgccgccggccccctggacatgagcctgcccagcacccccgacatcaagatcaaggaggaggagcccgtggaggtggacagcagcccccccgacagccccgccagcagcccctgcagcccccccctgaaggagaaggaggtgacccccaagcccgtgctgatcagcacccccacccccaccatcgtgagacccggcagcctgcccctgcacctgggctacgaccccctgcaccccaccctgcccagccccaccagcgtgatcacccaggccccccccagcaacagacagatgggcagccccaccggcagcctgcccctggtgatgcacctggccaacggccagaccatgcccgtgctgcccggcccccccgtgcagatgcccagcgtgatcagcctggccagacccgtgagcatggtgcccaacatccccggcatccccggcccccccgtgaacagcagcggcagcatcagccccagcggccaccccatccccagcgaggccaagatgagactgaaggccaccctgacccaccaggtgagcagcatcaacggcggctgcggcatggtggtgggcaccgccagcaccatggtgaccgccagacccgagcagagccagatcctgatccagcaccccgacgcccccagccccgcccagccccaggtgagccccgcccagcccacccccagcaccggcggcagaagaagaagaaccgtggacgaggaccccgacgagagaagacagagattcctggagagaaacagagccgccgccagcagatgcagacagaagagaaagctgtgggtgagcagcctggagaagaaggccgaggagctgaccagccagaacatccagctgagcaacgaggtgaccctgctgagaaacgaggtggcccagctgaagcagctgctgctggcccacaaggactgccccgtgaccgccctgcagaagaagacccagggctacctggagagccccaaggagagcagcgagcccaccggcagccccgcccccgtgatccagcacagcagcgccaccgcccccagcaacggcctgagcgtgagaagcgccgccgaggccgtggccaccagcgtgctgacccagatggccagccagagaaccgagctgagcatgcccatccagagccacgtgatcatgaccccccagagccagagcgccggcagatag

SEQ ID NO: 71584 - DNA, 1452 bp, Artificial Sequence; identical to SEQ ID NO: 71583
  Description of Artificial Sequence: Synthetic coding sequence

SEQ ID NO: 71585 - DNA, 1485 bp, Artificial Sequence; identical to SEQ ID NO: 71581
  Description of Artificial Sequence: Synthetic coding sequence

SEQ ID NO: 71586 - DNA, 354 bp, Artificial Sequence
  Description of Artificial Sequence: Synthetic coding sequence
atgggcgacgacagacccttcgtgtgcaacgcccccggctgcggccagagattcaccaacgaggaccacctggccgtgcacaagcacaagcacgagatgaccctgaagttcggccccgccagaaccgacagcgtgatcatcgccgaccagacccccacccccaccagattcctgaagaactgcgaggaggtgggcctgttcaacgagctggccagcagcttcgagcacgagttcaagaaggccgccgacgaggacgagaagaaggccagaagcagaaccgtggccaagaagctggtggtgttcagacccagactgttcctgctgtgcttcggcatcatcttcctgatcggctag

SEQ ID NO: 71587 - DNA, 354 bp, Artificial Sequence; identical to SEQ ID NO: 71586
  Description of Artificial Sequence: Synthetic coding sequence

SEQ ID NO: 71588 - DNA, 3813 bp, Artificial Sequence
  Description of Artificial Sequence: Synthetic coding sequence
atggacagcctggaggagccccagaagaaggtgttcaaggccagaaagaccatgagagtgagcgacagacagcagctggaggccgtgtacaaggtgaaggaggagctgctgaagaccgacgtgaagctgctgaacggcaaccacgagaacggcgacctggaccccaccagccccctggagaacatggactacatcaaggacaaggaggaggtgaacggcatcgaggagatctgcttcgaccccgagggcagcaaggccgagtggaaggagaccccctgcatcctgagcgtgaacgtgaagaacaagcaggacgacgacctgaactgcgagcccctgagcccccacaacatcacccccgagcccgtgagcaagctgcccgccgagcccgtgagcggcgaccccgcccccggcgacctggacgccggcgaccccgccagcggcgtgctggccagcggcgacagcaccagcggcgaccccaccagcagcgagcccagcagcagcgacgccgccagcggcgacgccaccagcggcgacgcccccagcggcgacgtgagccccggcgacgccaccagcggcgacgccaccgccgacgacctgagcagcggcgaccccaccagcagcgaccccatccccggcgagcccgtgcccgtggagcccatcagcggcgactgcgccgccgacgacatcgccagcagcgagatcaccagcgtggacctggccagcggcgcccccgccagcaccgaccccgccagcgacgacctggccagcggcgacctgagcagcagcgagctggccagcgacgacctggccaccggcgagctggccagcgacgagctgaccagcgagagcaccttcgacagaaccttcgagcccaagagcgtgcccgtgtgcgagcccgtgcccgagatcgacaacatcgagcccagcagcaacaaggacgacgacttcctggagaagaacggcgccgacgagaagctggagcagatccagagcaaggacagcctggacgagaagaacaaggccgacaacaacatcgacgccaacgaggagaccctggagaccgacgacaccaccatctgcagcgacagaccccccgagaacgagaagaaggtggaggaggacatcatcaccgagctggccctgggcgaggacgccatcagcagcagcatggagatcgaccagggcgagaagaacgaggacgagaccagcgccgacctggtggagaccatcaacgagaacgtgatcgaggacaacaagagcgagaacatcctggagaacaccgacagcatggagaccgacgagatcatccccatcctggagaagctggcccccagcgaggacgagctgacctgcttcagcaagaccagcctgctgcccatcgacgagaccaaccccgacctggaggagaagatggagagcagcttcggcagccccagcaagcaggagagcagcgagagcctgcccaaggaggccttcctggtgctgagcgacgaggaggacatcagcggcgagaaggacgagagcgaggtgatcagccagaacgagacctgcagccccgccgaggtggagagcaacgagaaggacaacaagcccgaggaggaggagcaggtgatccacgaggacgacgagagacccagcgagaagaacgagttcagcagaagaaagagaagcaagagcgaggacatggacaacgtgcagagcaagagaagaagatacatggaggaggagtacgaggccgagttccaggtgaagatcaccgccaagggcgacatcaaccagaagctgcagaaggtgatccagtggctgctggaggagaagctgtgcgccctgcagtgcgccgtgttcgacaagaccctggccgagctgaagaccagagtggagaagatcgagtgcaacaagagacacaagaccgtgctgaccgagctgcaggccaagatcgccagactgaccaagagattcgaggccgccaaggaggacctgaagaagagacacgagcacccccccaacccccccgtgagccccggcaagaccgtgaacgacgtgaacagcaacaacaacatgagctacagaaacgccggcaccgtgagacagatgctggagagcaagagaaacgtgagcgagagcgccccccccagcttccagacccccgtgaacaccgtgagcagcaccaacctggtgaccccccccgccgtggtgagcagccagcccaagctgcagacccccgtgaccagcggcagcctgaccgccaccagcgtgctgcccgcccccaacaccgccaccgtggtggccaccacccaggtgcccagcggcaacccccagcccaccatcagcctgcagcccctgcccgtgatcctgcacgtgcccgtggccgtgagcagccagccccagctgctgcagagccaccccggcaccctggtgaccaaccagcccagcggcaacgtggagttcatcagcgtgcagagcccccccaccgtgagcggcctgaccaagaaccccgtgagcctgcccagcctgcccaaccccaccaagcccaacaacgtgcccagcgtgcccagccccagcatccagagaaaccccaccgccagcgccgcccccctgggcaccaccctggccgtgcaggccgtgcccaccgcccacagcatcgtgcaggccaccagaaccagcctgcccaccgtgggccccagcggcctgtacagccccagcaccaacagaggccccatccagatgaagatccccatcagcgccttcagcaccagcagcgccgccgagcagaacagcaacaccacccccagaatcgagaaccagaccaacaagaccatcgacgccagcgtgagcaagaaggccgccgacagcaccagccagtgcggcaaggccaccggcagcgacagcagcggcgtgatcgacctgaccatggacgacgaggagagcggcgccagccaggaccccaagaagctgaaccacacccccgtgagcaccatgagcagcagccagcccgtgagcagacccctgcagcccatccagcccgccccccccctgcagcccagcggcgtgcccaccagcggccccagccagaccaccatccacctgctgcccaccgcccccaccaccgtgaacgtgacccacagacccgtgacccaggtgaccaccagactgcccgtgcccagagcccccgccaaccaccaggtggtgtacaccaccctgcccgccccccccgcccaggcccccctgagaggcaccgtgatgcaggcccccgccgtgagacaggtgaacccccagaacagcgtgaccgtgagagtgccccagaccaccacctacgtggtgaacaacggcctgaccctgggcagcaccggcccccagctgaccgtgcaccacagacccccccaggtgcacaccgagccccccagacccgtgcaccccgcccccctgcccgaggccccccagccccagagactgccccccgaggccgccagcaccagcctgccccagaagccccacctgaagctggccagagtgcagagccagaacggcatcgtgctgagctggagcgtgctggaggtggacagaagctgcgccaccgtggacagctaccacctgtacgcctaccacgaggagcccagcgccaccgtgcccagccagtggaagaagatcggcgaggtgaaggccctgcccctgcccatggcctgcaccctgacccagttcgtgagcggcagcaagtactacttcgccgtgagagccaaggacatctacggcagattcggccccttctgcgacccccagagcaccgacgtgatcagcagcacccagagcagctag

SEQ ID NO: 71589 - DNA, 1548 bp, Artificial Sequence
  Description of Artificial Sequence: Synthetic coding sequence
atggacagcctggaggagccccagaagaaggtgttcaaggccagaaagaccatgagagtgagcgacagacagcagctggaggccgtgtacaaggtgaaggaggagctgctgaagaccgacgtgaagctgctgaacggcaaccacgagaacggcgacctggaccccaccagccccctggagaacatggactacatcaaggacaaggaggaggtgaacggcatcgaggagatctgcttcgaccccgagggcagcaaggccgagtggaaggagaccccctgcatcctgagcgtgaacgtgaagaacaagcaggacgacgacctgaactgcgagcccctgagcccccacaacatcacccccgagcccgtgagcaagctgcccgccgagcccgtgagcggcgaccccgcccccggcgacctggacgccggcgaccccgccagcggcgtgctggccagcggcgacagcaccagcggcgaccccaccagcagcgagcccagcagcagcgacgccgccagcggcgacgccaccagcggcgacgcccccagcggcgacgtgagccccggcgacgccaccagcggcgacgccaccgccgacgacctgagcagcggcgaccccaccagcagcgaccccatccccggcgagcccgtgcccgtggagcccatcagcggcgactgcgccgccgacgacatcgccagcagcgagatcaccagcgtggacctggccagcggcgcccccgccagcaccgaccccgccagcgacgacctggccagcggcgacctgagcagcagcgagctggccagcgacgacctggccaccggcgagctggccagcgacgagctgaccagcgagagcaccttcgacagaaccttcgagcccaagagcgtgcccgtgtgcgagcccgtgcccgagatcgacaacatcgagcccagcagcaacaaggacgacgacttcctggagaagaacggcgccgacgagaagctggagcagatccagagcaaggacagcctggacgagaagaacaaggccgacaacaacatcgacgccaacgaggagaccctggagaccgacgacaccaccatctgcagcgacagaccccccgagaacgagaagaaggtggaggaggacatcatcaccgagctggccctgggcgaggacgccatcagcagcagcatggagatcgaccagggcgagaagaacgaggacgagaccagcgccgacctggtggagaccatcaacgagaacgtgatcgaggacaacaagagcgagaacatcctggagaacaccgacagcatggagaccgacgagatcatccccatcctggagaagctggcccccagcgaggacgagctgacctgcttcagcaagaccagcctgctgcccatcgacgagaccaaccccgacctggaggagaagatggagagcagcttcggcagccccagcaagcaggagagcagcgagagcctgcccaaggaggccttcctggtgctgagcgacgaggaggacatcagcggcgagaaggacgagagcgaggtgatcagccagaacgagtag

SEQ ID NO: 71590 - DNA, 378 bp, Artificial Sequence
  Description of Artificial Sequence: Synthetic coding sequence
atggacagcctggaggagccccagaagaaggtgttcaaggccagaaagaccatgagagtgagcgacagacagcagctggaggccgtgtacaaggtgaaggaggagctgctgaagaccgacgtgaagctgctgaacggcaaccacgagaacggcgacctggaccccaccagccccctggagaacatggactacatcaaggacaaggaggaggtgaacggcatcgaggagatctgcttcgaccccgagggcagcaaggccgagtggaaggagaccccctgcatcctgagcgtgaacgtgaagaacaagcaggacgacgacctgaactgcgagcccctgagcccccacaacatcacccccgagcccgtgagcaagctgtag

SEQ ID NO: 71591 - DNA, 459 bp, Artificial Sequence
  Description of Artificial Sequence: Synthetic coding sequence
atggacagcctggaggagccccagaagaaggtgttcaaggccagaaagaccatgagagtgagcgacagacagcagctggaggccgtgtacaaggtgaaggaggagctgctgaagaccgacgtgaagctgctgaacggcaaccacgagaacggcgacctggaccccaccagccccctggagaacatggactacatcaaggacaaggaggaggtgaacggcatcgaggagatctgcttcgaccccgagggcagcaaggccgagtggaaggagaccccctgcatcctgagcgtgaacgtgaagaacaagcaggacgacgacctgaactgcgagcccctgagcccccacaacatcacccccgagcccgtgagcaagctgcccgccgagcccgtgagcggcgaccccgcccccggcgacctggacgccggcgaccccgccagcggcgtgctggccagcggctag

SEQ ID NO: 71592 - DNA, 312 bp, Artificial Sequence
  Description of Artificial Sequence: Synthetic coding sequence
atggacagcctggaggagccccagaagaaggtgttcaaggccagaaagaccatgagagtgagcgacagacagcagctggaggccgtgtacaaggtgaaggaggagctgctgaagaccgacgtgaagctgctgaacggcaaccacgagaacggcgacctggaccccaccagccccctggagaacatggactacatcaaggacaaggaggaggtgaacggcatcgaggagatctgcttcgaccccgagggcagcaaggccgagtggaaggagaccccctgcatcctgagcgtgaacgtgaagaacaagcagtag

SEQ ID NO: 71593 - DNA, 270 bp, Artificial Sequence
  Description of Artificial Sequence: Synthetic coding sequence
atggacagcctggaggagccccagaagaaggtgttcaaggccagaaagaccatgagagtgagcgacagacagcagctggaggccgtgtacaaggtgaaggaggagctgctgaagaccgacgtgaagctgctgaacggcaaccacgagaacggcgacctggaccccaccagccccctggagaacatggactacatcaaggacaaggaggaggtgaacggcatcgaggagatctgcttcgaccccgagggcagcaaggccgagtggaagtag

SEQ ID NO: 71594 - DNA, 534 bp, Artificial Sequence
  Description of Artificial Sequence: Synthetic coding sequence
atggacagcctggaggagccccagaagaaggtgttcaaggccagaaagaccatgagagtgagcgacagacagcagctggaggccgtgtacaaggtgaaggaggagctgctgaagaccgacgtgaagctgctgaacggcaaccacgagaacggcgacctggaccccaccagccccctggagaacatggactacatcaaggacaaggaggaggtgaacggcatcgaggagatctgcttcgaccccgagggcagcaaggccgagtggaaggagaccccctgcatcctgagcgtgaacgtgaagaacaagcaggacgacgacctgaactgcgagcccctgagcccccacaacatcacccccgagcccgtgagcaagctgcccgccgagcccgtgagcggcgaccccgcccccggcgacctggacgccggcgaccccgccagcggcgtgctggccagcggcgacagcaccagcggcgaccccaccagcagcgagcccagcagcagcgacgccgccagcggcgacgccaccagcggctag

SEQ ID NO: 71595 - DNA, 3813 bp, Artificial Sequence; identical to SEQ ID NO: 71588
  Description of Artificial Sequence: Synthetic coding sequence

SEQ ID NO: 71596 - DNA, 510 bp, Artificial Sequence
  Description of Artificial Sequence: Synthetic coding sequence
atggacagcctggaggagccccagaagaaggtgttcaaggccagaaagaccatgagagtgagcgacagacagcagctggaggccgtgtacaaggtgaaggaggagctgctgaagaccgacgtgaagctgctgaacggcaaccacgagaacggcgacctggaccccaccagccccctggagaacatggactacatcaaggacaaggaggaggtgaacggcatcgaggagatctgcttcgaccccgagggcagcaaggccgagtggaaggagaccccctgcatcctgagcgtgaacgtgaagaacaagcaggacgacgacctgaactgcgagcccctgagcccccacaacatcacccccgagcccgtgagcaagctgcccgccgagcccgtgagcggcgaccccgcccccggcgacctggacgccggcgaccccgccagcggcgtgctggccagcggcgacagcaccagcggcgaccccaccagcagcgagcccagcagcagcgacgcctag

SEQ ID NO: 71597 - DNA, 99 bp, Artificial Sequence
  Description of Artificial Sequence: Synthetic coding sequence
atggacagcctggaggagccccagaagaaggtgttcaaggccagaaagaccatgagagtgagcgacagacagcagctggaggccgtgtacaaggtgtag

SEQ ID NO: 71598 - DNA, 399 bp, Artificial Sequence
  Description of Artificial Sequence: Synthetic coding sequence
atggacagcctggaggagccccagaagaaggtgttcaaggccagaaagaccatgagagtgagcgacagacagcagctggaggccgtgtacaaggtgaaggaggagctgctgaagaccgacgtgaagctgctgaacggcaaccacgagaacggcgacctggaccccaccagccccctggagaacatggactacatcaaggacaaggaggaggtgaacggcatcgaggagatctgcttcgaccccgagggcagcaaggccgagtggaaggagaccccctgcatcctgagcgtgaacgtgaagaacaagcaggacgacgacctgaactgcgagcccctgagcccccacaacatcacccccgagcccgtgagcaagctgcccgccgagcccgtgagcggctag

SEQ ID NO: 71599 - DNA, 531 bp, Artificial Sequence
  Description of Artificial Sequence: Synthetic coding sequence
atggacagcctggaggagccccagaagaaggtgttcaaggccagaaagaccatgagagtgagcgacagacagcagctggaggccgtgtacaaggtgaaggaggagctgctgaagaccgacgtgaagctgctgaacggcaaccacgagaacggcgacctggaccccaccagccccctggagaacatggactacatcaaggacaaggaggaggtgaacggcatcgaggagatctgcttcgaccccgagggcagcaaggccgagtggaaggagaccccctgcatcctgagcgtgaacgtgaagaacaagcaggacgacgacctgaactgcgagcccctgagcccccacaacatcacccccgagcccgtgagcaagctgcccgccgagcccgtgagcggcgaccccgcccccggcgacctggacgccggcgaccccgccagcggcgtgctggccagcggcgacagcaccagcggcgaccccaccagcagcgagcccagcagcagcgacgccgccagcggcgacgccaccagctag

SEQ ID NO: 71600 - DNA, 180 bp, Artificial Sequence
  Description of Artificial Sequence: Synthetic coding sequence
atggacagcctggaggagccccagaagaaggtgttcaaggccagaaagaccatgagagtgagcgacagacagcagctggaggccgtgtacaaggtgaaggaggagctgctgaagaccgacgtgaagctgctgaacggcaaccacgagaacggcgacctggaccccaccagccccctgtag

SEQ ID NO: 71601 - DNA, 3318 bp, Artificial Sequence
  Description of Artificial Sequence: Synthetic coding sequence
atggacagcctggaggagccccagaagaaggtgttcaaggccagaaagaccatgagagtgagcgacagacagcagctggaggccgtgtacaaggtgaaggaggagctgctgaagaccgacgtgaagctgctgaacggcaaccacgagaacggcgacctggaccccaccagccccctggagaacatggactacatcaaggacaaggaggaggtgaacggcatcgaggagatctgcttcgaccccgagggcagcaaggccgagtggaaggagaccccctgcatcctgagcgtgaacgtgaagaacaagcaggacgacgacctgaactgcgagcccctgagcccccacaacatcacccccgagcccgtgagcaagctgcccgccgagcccgtgagcggcgaccccgcccccggcgacctggacgccggcgaccccgccagcggcgtgctggccagcggcgacagcaccagcggcgaccccaccagcagcgagcccagcagcagcgacgccgccagcggcgacgccaccagcggcgacgcccccagcggcgacgtgagccccggcgacgccaccagcggcgacgccaccgccgacgacctgagcagcggcgaccccaccagcagcgaccccatccccggcgagcccgtgcccgtggagcccatcagcggcgactgcgccgccgacgacatcgccagcagcgagatcaccagcgtggacctggccagcggcgcccccgccagcaccgaccccgccagcgacgacctggccagcggcgacctgagcagcagcgagctggccagcgacgacctggccaccggcgagctggccagcgacgagctgaccagcgagagcaccttcgacagaaccttcgagcccaagagcgtgcccgtgtgcgagcccgtgcccgagatcgacaacatcgagcccagcagcaacaaggacgacgacttcctggagaagaacggcgccgacgagaagctggagcagatccagagcaaggacagcctggacgagaagaacaaggccgacaacaacatcgacgccaacgaggagaccctggagaccgacgacaccaccatctgcagcgacagaccccccgagaacgagaagaaggtggaggaggacatcatcaccgagctggccctgggcgaggacgccatcagcagcagcatggagatcgaccagggcgagaagaacgaggacgagaccagcgccgacctggtggagaccatcaacgagaacgtgatcgaggacaacaagagcgagaacatcctggagaacaccgacagcatggagaccgacgagatcatccccatcctggagaagctggcccccagcgaggacgagctgacctgcttcagcaagaccagcctgctgcccatcgacgagaccaaccccgacctggaggagaagatggagagcagcttcggcagccccagcaagcaggagagcagcgagagcctgcccaaggaggccttcctggtgctgagcgacgaggaggacatcagcggcgagaaggacgagagcgaggtgatcagccagaacgagacctgcagccccgaggtggagagcaacgagaaggacaacaagcccgaggaggaggagcaggtgatccacgaggacgacgagagacccagcgagaagaacgagttcagcagaagaaagagaagcaagagcgaggacatggacaacgtgcagagcaagagaagaagatacatggaggaggagtacgaggccgagttccaggtgaagatcaccgccaagggcgacatcaaccagaagctgcagaaggtgatccagtggctgctggaggagaagctgtgcgccctgcagtgcgccgtgttcgacaagaccctggccgagctgaagaccagagtggagaagatcgagtgcaacaagagacacaagaccgtgctgaccgagctgcaggccaagatcgccagactgaccaagagattcgaggccgccaaggaggacctgaagaagagacacgagcacccccccaacccccccgtgagccccggcaagaccgtgaacgacgtgaacagcaacaacaacatgagctacagaaacgccggcaccgtgagacagatgctggagagcaagagaaacgtgagcgagagcgccccccccagcttccagacccccgtgaacaccgtgagcagcaccaacctggtgaccccccccgccgtggtgagcagccagcccaagctgcagacccccgtgaccagcggcagcctgaccgccaccagcgtgctgcccgcccccaacaccgccaccgtggtggccaccacccaggtgcccagcggcaacccccagcccaccatcagcctgcagcccctgcccgtgatcctgcacgtgcccgtggccgtgagcagccagccccagctgctgcagagccaccccggcaccctggtgaccaaccagcccagcggcaacgtggagttcatcagcgtgcagagcccccccaccgtgagcggcctgaccaagaaccccgtgagcctgcccagcctgcccaaccccaccaagcccaacaacgtgcccagcgtgcccagccccagcatccagagaaaccccaccgccagcgccgcccccctgggcaccaccctggccgtgcaggccgtgcccaccgcccacagcatcgtgcaggccaccagaaccagcctgcccaccgtgggccccagcggcctgtacagccccagcaccaacagaggccccatccagatgaagatccccatcagcgccttcagcaccagcagcgccgccgagcagaacagcaacaccacccccagaatcgagaaccagaccaacaagaccatcgacgccagcgtgagcaagaaggccgccgacagcaccagccagtgcggcaaggccaccggcagcgacagcagcggcgtgatcgacctgaccatggacgacgaggagagcggcgccagccaggaccccaagaagctgaaccacacccccgtgagcaccatgagcagcagccagcccgtgagcagacccctgcagcccatccagcccgccccccccctgcagcccagcggcgtgcccaccagcggccccagccagaccaccatccacctgctgcccaccgcccccaccaccgtgaacgtgacccacagacccgtgacccaggtgaccaccagactgcccgtgcccagagcccccgccaaccaccaggtggtgtacaccaccctgcccgccccccccgcccaggcccccctgagaggcaccgtgatgcaggcccccgccgtgagacaggtgaacccccagaacagcaagagattcttcctgtacatggcccccagatacatgtag

SEQ ID NO: 71602 - DNA, 3837 bp, Artificial Sequence
  Description of Artificial Sequence: Synthetic coding sequence
atgcaccaggaccagagattcagaatggacagcctggaggagccccagaagaaggtgttcaaggccagaaagaccatgagagtgagcgacagacagcagctggaggccgtgtacaaggtgaaggaggagctgctgaagaccgacgtgaagctgctgaacggcaaccacgagaacggcgacctggaccccaccagccccctggagaacatggactacatcaaggacaaggaggaggtgaacggcatcgaggagatctgcttcgaccccgagggcagcaaggccgagtggaaggagaccccctgcatcctgagcgtgaacgtgaagaacaagcaggacgacgacctgaactgcgagcccctgagcccccacaacatcacccccgagcccgtgagcaagctgcccgccgagcccgtgagcggcgaccccgcccccggcgacctggacgccggcgaccccgccagcggcgtgctggccagcggcgacagcaccagcggcgaccccaccagcagcgagcccagcagcagcgacgccgccagcggcgacgccaccagcggcgacgcccccagcggcgacgtgagccccggcgacgccaccagcggcgacgccaccgccgacgacctgagcagcggcgaccccaccagcagcgaccccatccccggcgagcccgtgcccgtggagcccatcagcggcgactgcgccgccgacgacatcgccagcagcgagatcaccagcgtggacctggccagcggcgcccccgccagcaccgaccccgccagcgacgacctggccagcggcgacctgagcagcagcgagctggccagcgacgacctggccaccggcgagctggccagcgacgagctgaccagcgagagcaccttcgacagaaccttcgagcccaagagcgtgcccgtgtgcgagcccgtgcccgagatcgacaacatcgagcccagcagcaacaaggacgacgacttcctggagaagaacggcgccgacgagaagctggagcagatccagagcaaggacagcctggacgagaagaacaaggccgacaacaacatcgacgccaacgaggagaccctggagaccgacgacaccaccatctgcagcgacagaccccccgagaacgagaagaaggtggaggaggacatcatcaccgagctggccctgggcgaggacgccatcagcagcagcatggagatcgaccagggcgagaagaacgaggacgagaccagcgccgacctggtggagaccatcaacgagaacgtgatcgaggacaacaagagcgagaacatcctggagaacaccgacagcatggagaccgacgagatcatccccatcctggagaagctggcccccagcgaggacgagctgacctgcttcagcaagaccagcctgctgcccatcgacgagaccaaccccgacctggaggagaagatggagagcagcttcggcagccccagcaagcaggagagcagcgagagcctgcccaaggaggccttcctggtgctgagcgacgaggaggacatcagcggcgagaaggacgagagcgaggtgatcagccagaacgagacctgcagccccgccgaggtggagagcaacgagaaggacaacaagcccgaggaggaggagcaggtgatccacgaggacgacgagagacccagcgagaagaacgagttcagcagaagaaagagaagcaagagcgaggacatggacaacgtgcagagcaagagaagaagatacatggaggaggagtacgaggccgagttccaggtgaagatcaccgccaagggcgacatcaaccagaagctgcagaaggtgatccagtggctgctggaggagaagctgtgcgccctgcagtgcgccgtgttcgacaagaccctggccgagctgaagaccagagtggagaagatcgagtgcaacaagagacacaagaccgtgctgaccgagctgcaggccaagatcgccagactgaccaagagattcgaggccgccaaggaggacctgaagaagagacacgagcacccccccaacccccccgtgagccccggcaagaccgtgaacgacgtgaacagcaacaacaacatgagctacagaaacgccggcaccgtgagacagatgctggagagcaagagaaacgtgagcgagagcgccccccccagcttccagacccccgtgaacaccgtgagcagcaccaacctggtgaccccccccgccgtggtgagcagccagcccaagctgcagacccccgtgaccagcggcagcctgaccgccaccagcgtgctgcccgcccccaacaccgccaccgtggtggccaccacccaggtgcccagcggcaacccccagcccaccatcagcctgcagcccctgcccgtgatcctgcacgtgcccgtggccgtgagcagccagccccagctgctgcagagccaccccggcaccctggtgaccaaccagcccagcggcaacgtggagttcatcagcgtgcagagcccccccaccgtgagcggcctgaccaagaaccccgtgagcctgcccagcctgcccaaccccaccaagcccaacaacgtgcccagcgtgcccagccccagcatccagagaaaccccaccgccagcgccgcccccctgggcaccaccctggccgtgcaggccgtgcccaccgcccacagcatcgtgcaggccaccagaaccagcctgcccaccgtgggccccagcggcctgtacagccccagcaccaacagaggccccatccagatgaagatccccatcagcgccttcagcaccagcagcgccgccgagcagaacagcaacaccacccccagaatcgagaaccagaccaacaagaccatcgacgccagcgtgagcaagaaggccgccgacagcaccagccagtgcggcaaggccaccggcagcgacagcagcggcgtgatcgacctgaccatggacgacgaggagagcggcgccagccaggaccccaagaagctgaaccacacccccgtgagcaccatgagcagcagccagcccgtgagcagacccctgcagcccatccagcccgccccccccctgcagcccagcggcgtgcccaccagcggccccagccagaccaccatccacctgctgcccaccgcccccaccaccgtgaacgtgacccacagacccgtgacccaggtgaccaccagactgcccgtgcccagagcccccgccaaccaccaggtggtgtacaccaccctgcccgccccccccgcccaggcccccctgagaggcaccgtgatgcaggcccccgccgtgagacaggtgaacccccagaacagcgtgaccgtgagagtgccccagaccaccacctacgtggtgaacaacggcctgaccctgggcagcaccggcccccagctgaccgtgcaccacagacccccccaggtgcacaccgagccccccagacccgtgcaccccgcccccctgcccgaggccccccagccccagagactgccccccgaggccgccagcaccagcctgccccagaagccccacctgaagctggccagagtgcagagccagaacggcatcgtgctgagctggagcgtgctggaggtggacagaagctgcgccaccgtggacagctaccacctgtacgcctaccacgaggagcccagcgccaccgtgcccagccagtggaagaagatcggcgaggtgaaggccctgcccctgcccatggcctgcaccctgacccagttcgtgagcggcagcaagtactacttcgccgtgagagccaaggacatctacggcagattcggccccttctgcgacccccagagcaccgacgtgatcagcagcacccagagcagctag

SEQ ID NO: 71603 - DNA, 510 bp, Artificial Sequence; identical to SEQ ID NO: 71596
  Description of Artificial Sequence: Synthetic coding sequence

SEQ ID NO: 71604 - DNA, 1632 bp, Artificial Sequence
  Description of Artificial Sequence: Synthetic coding sequence
atggccagccccgacagaagcaagagaaagatcctgaaggccaagaagaccatgcccctgagctgcagaaagcaggtggagatgctgaacaagagcagaaacgtggaggccctgaagaccgccatcggcagcaacgtgcccagcggcaaccagagcttcagccccagcgtgatcaccagaaccaccgagatcaccaagtgcagccccagcgagaacggcgccagcagcctggacagcaacaagaacagcatcagcgagaagagcaaggtgttcagccagaactgcatcaagcccgtggaggagatcgtgcacagcgagaccaagctggagcaggtggtgtgcagctaccagaagcccagcagaaccaccgagagccccagcagagtgttcaccgaggaggccaaggacagcctgaacaccagcgagaacgacagcgagcaccagaccaacgtgaccagaagcctgttcgagcacgagggcgcctgcagcctgaagagcagctgctgcccccccagcgtgctgagcggcgtggtgcagatgcccgagagcaccgtgaccagcaccgtgggcgacaagaagaccgaccagatggtgttccacctggagaccaacagcaacagcgagagccacgacaagagacagagcgacaacatcctgtgcagcgaggacagcggcttcgtgcccgtggagaagacccccaacctggtgaacagcgtgaccagcaacaactgcgccgacgacatcctgaagaccgacgagtgcagcagaaccagcatcagcaactgcgagagcgccgacagcacctggcagagcagcctggacaccaacaacaacagccactaccagaagaagagaatgttcagcgagaacgaggagaacgtgaagagaatgaagaccagcgagcagatcaacgagaacatctgcgtgagcctggagagacagaccgccttcctggagcaggtgagacacctgatccagcaggagatctacagcatcaactacgagctgttcgacaagaagctgaaggagctgaaccagagaatcggcaagaccgagtgcagaaacaagcacgagggcatcgccgacaagctgctggccaagatcgccaagctgcagagaagaatcaagaccgtgctgctgttccagagaaactgcctgaagcccaacatgctgagcagcaacggcgccagcaaggtggccaacagcgaggccatgatcctggacaagaacctggagagcgtgaacagccccatcgagaagagcagcgtgaactacgagcccagcaaccccagcgagaagggcagcaagaagatcaacctgagcagcgaccagaacaagagcgtgagcgagagcaacaacgacgacgtgatgctgatcagcgtggagagccccaacctgaccacccccatcaccagcaaccccaccgacaccagaaagatcaccagcggcaacagcagcaacagccccaacgccgaggtgatgaaggtgcagtaccccccctggagccacatcagaaagctgctgcagacccagagaaagcagccccactggcacaagatgcagagcagattcctgagccccctgagcacctgccacctgagccagaaccaccagcaccactacctgaactag

SEQ ID NO: 71605 - DNA, 2049 bp, Artificial Sequence
  Description of Artificial Sequence: Synthetic coding sequence
atggccagccccgacagaagcaagagaaagatcctgaaggccaagaagaccatgcccctgagctgcagaaagcaggtggagatgctgaacaagagcagaaacgtggaggccctgaagaccgccatcggcagcaacgtgcccagcggcaaccagagcttcagccccagcgtgatcaccagaaccaccgagatcaccaagtgcagccccagcgagaacggcgccagcagcctggacagcaacaagaacagcatcagcgagaagagcaaggtgttcagccagaactgcatcaagcccgtggaggagatcgtgcacagcgagaccaagctggagcaggtggtgtgcagctaccagaagcccagcagaaccaccgagagccccagcagagtgttcaccgaggaggccaaggacagcctgaacaccagcgagaacgacagcgagcaccagaccaacgtgaccagaagcctgttcgagcacgagggcgcctgcagcctgaagagcagctgctgcccccccagcgtgctgagcggcgtggtgcagatgcccgagagcaccgtgaccagcaccgtgggcgacaagaagaccgaccagatggtgttccacctggagaccaacagcaacagcgagagccacgacaagagacagagcgacaacatcctgtgcagcgaggacagcggcttcgtgcccgtggagaagacccccaacctggtgaacagcgtgaccagcaacaactgcgccgacgacatcctgaagaccgacgagtgcagcagaaccagcatcagcaactgcgagagcgccgacagcacctggcagagcagcctggacaccaacaacaacagccactaccagaagaagagaatgttcagcgagaacgaggagaacgtgaagagaatgaagaccagcgagcagatcaacgagaacatctgcgtgagcctggagagacagaccgccttcctggagcaggtgagacacctgatccagcaggagatctacagcatcaactacgagctgttcgacaagaagctgaaggagctgaaccagagaatcggcaagaccgagtgcagaaacaagcacgagggcatcgccgacaagctgctggccaagatcgccaagctgcagagaagaatcaagaccgtgctgctgttccagagaaactgcctgaagcccaacatgctgagcagcaacggcgccagcaaggtggccaacagcgaggccatgatcctggacaagaacctggagagcgtgaacagccccatcgagaagagcagcgtgaactacgagcccagcaaccccagcgagaagggcagcaagaagatcaacctgagcagcgaccagaacaagagcgtgagcgagagcaacaacgacgacgtgatgctgatcagcgtggagagccccaacctgaccacccccatcaccagcaaccccaccgacaccagaaagatcaccagcggcaacagcagcaacagccccaacgccgaggtgatggccgtgcagaagaagctggacagcatcatcgacctgaccaaggagggcctgagcaactgcaacaccgagagccccgtgagccccctggagagccacagcaaggccgccagcaacagcaaggagaccacccccctggcccagaacgccgtgcaggtgcccgagagcttcgagcacctgccccccctgcccgagccccccgcccccctgcccgagctggtggacaagaccagagacaccctgcccccccagaagcccgagctgaaggtgaagagagtgttcagacccaacggcatcgccctgacctggaacatcaccaagatcaaccccaagtgcgcccccgtggagagctaccacctgttcctgtgccacgagaacagcaacaacaagctgatctggaagaagatcggcgagatcaaggccctgcccctgcccatggcctgcaccctgagccagttcctggccagcaacagatactacttcaccgtgcagagcaaggacatcttcggcagatacggccccttctgcgacatcaagagcatccccggcttcagcgagaacctgacctag

SEQ ID NO: 71606 - DNA, 1632 bp, Artificial Sequence; identical to SEQ ID NO: 71604
  Description of Artificial Sequence: Synthetic coding sequence

SEQ ID NO: 71607 - DNA, 2049 bp, Artificial Sequence; identical to SEQ ID NO: 71605
  Description of Artificial Sequence: Synthetic coding sequence

SEQ ID NO: 71608 - DNA, 1278 bp, Artificial Sequence
  Description of Artificial Sequence: Synthetic coding sequence
atggccagccccgacagaagcaagagaaagatcctgaaggccaagaagaccatgcccctgagctgcagaaagcaggtggagatgctgaacaagagcagaaacgtggaggccctgaagaccgccatcggcagcaacgtgcccagcggcaaccagagcttcagccccagcgtgatcaccagaaccaccgagatcaccaagtgcagccccagcgagaacggcgccagcagcctggacagcaacaagaacagcatcagcgagaagagcaaggtgttcagccagaactgcatcaagcccgtggaggagatcgtgcacagcgagaccaagctggagcaggtggtgtgcagctaccagaagcccagcagaaccaccgagagccccagcagagtgttcaccgaggaggccaaggacagcctgaacaccagcgagaacgacagcgagcaccagaccaacgtgaccagaagcctgttcgagcacgagggcgcctgcagcctgaagagcagctgctgcccccccagcgtgctgagcggcgtggtgcagatgcccgagagcaccgtgaccagcaccgtgggcgacaagaagaccgaccagatggtgttccacctggagaccaacagcaacagcgagagccacgacaagagacagagcgacaacatcctgtgcagcgaggacagcggcttcgtgcccgtggagaagacccccaacctggtgaacagcgtgaccagcaacaactgcgccgacgacatcctgaagaccgacgagtgcagcagaaccagcatcagcaactgcgagagcgccgacagcacctggcagagcagcctggacaccaacaacaacagccactaccagaagaagagaatgttcagcgagaacgaggagaacgtgaagagaatgaagaccagcgagcagatcaacgagaacatctgcgtgagcctggagagacagaccgccttcctggagcaggtgagacacctgatccagcaggagatctacagcatcaactacgagctgttcgacaagaagctgaaggagctgaaccagagaatcggcaagaccgagtgcagaaacaagcacgagggcatcgccgacaagctgctggccaagatcgccaagctgcagagaagaatcaagaccgtgctgctgttccagagaaactgcctgaagcccaacatgctgagcagcaacggcgccagcaagatccccgagaagctgcaccaggagatcctggccatcctgcccatgctgaagctgtggctgtacagaagaaacctgatcctgtag

SEQ ID NO: 71609 - DNA, 681 bp, Artificial Sequence
  Description of Artificial Sequence: Synthetic coding sequence
atgctgatcagcgtggagagccccaacctgaccacccccatcaccagcaaccccaccgacaccagaaagatcaccagcggcaacagcagcaacagccccaacgccgaggtgatggccgtgcagaagaagctggacagcatcatcgacctgaccaaggagggcctgagcaactgcaacaccgagagccccgtgagccccctggagagccacagcaaggccgccagcaacagcaaggagaccacccccctggcccagaacgccgtgcaggtgcccgagagcttcgagcacctgccccccctgcccgagccccccgcccccctgcccgagctggtggacaagaccagagacaccctgcccccccagaagcccgagctgaaggtgaagagagtgttcagacccaacggcatcgccctgacctggaacatcaccaagatcaaccccaagtgcgcccccgtggagagctaccacctgttcctgtgccacgagaacagcaacaacaagctgatctggaagaagatcggcgagatcaaggccctgcccctgcccatggcctgcaccctgagccagttcctggccagcaacagatactacttcaccgtgcagagcaaggacatcttcggcagatacggccccttctgcgacatcaagagcatccccggcttcagcgagaacctgacctag

SEQ ID NO: 71610 - DNA, 714 bp, Artificial Sequence
  Description of Artificial Sequence: Synthetic coding sequence
atgaccagcgagatcacctacgccgaggtgagattcaagaacgagttcaagagcagcggcatcaacaccgccagcagcgccgccagcaaggagagaaccgccccccacaagagcaacaccggcttccccaagctgctgtgcgccagcctgctgatcttcttcctgctgctggccatcagcttcttcatcgccttcgtgatcttcttccagaagtacagccagctgctggagaagaagaccaccaaggagctggtgcacaccaccctggagtgcgtgaagaagaacatgcccgtggaggagaccgcctggagctgctgccccaagaactggaagagcttcagcagcaactgctacttcatcagcaccgagagcgccagctggcaggacagcgagaaggactgcgccagaatggaggcccacctgctggtgatcaacacccaggaggagcaggacttcatcttccagaacctgcaggaggagagcgcctacttcgtgggcctgagcgaccccgagggccagagacactggcagtgggtggaccagaccccctacaacgagagcagcaccttctggcaccccagagagcccagcgaccccaacgagagatgcgtggtgctgaacttcagaaagagccccaagagatggggctggaacgacgtgaactgcctgggcccccagagaagcgtgtgcgagatgatgaagatccacctgtag

SEQ ID NO: 71611 - DNA, 2469 bp, Artificial Sequence
  Description of Artificial Sequence: Synthetic coding sequence
atggaggaggaggaggaggccatcggcctgctggacaaggtgctggaggacgaggacgtgttcctgctggaggagtgcgagctgggcacccccaccagccccggcagcggcagccccttcctggtggccgtgaaggtggaggccggcaagggcctggagatgagaaagctggtgctgagcggcttcctggccagcgaggagatctacatcaaccagctggaggccctgctgctgcccatgaagcccctgaaggccaccgccaccaccagccagcccgtgctgaccatccagcagatcgagaccatcttctacaagatccaggacatctacgagatccacaaggagttctacgacaacctgtgccccaaggtgcagcagtgggacagccaggtgaccatgggccacctgttccagaagctggccagccagctgggcgtgtacaaggccttcgtggacaactacaaggtggccctggagaccgccgagaagtgcagccagagcaacaaccagttccagaagatcagcgaggagctgaaggtgaagggccccaaggacagcaaggacagccacaccagcgtgaccatggaggccctgctgtacaagcccatcgacagagtgaccagaagcaccctggtgctgcacgacctgctgaagcacacccccgtggaccaccccgactaccccctgctgcaggacgccctgagaatcagccagaacttcctgagcagcatcaacgaggacatcgaccccagaagaaccgccgtgaccacccccaagggcgagaccagacagctggtgaaggacggcttcctggtggaggtgagcgagagcagcagaaagctgagacacgtgttcctgttcaccgacgtgctgctgtgcgccaagctgaagaagaccagcgccggcaagcaccagcagtacgactgcaagtggtacatccccctggccgacctggtgttccccagccccgaggagagcgaggccagcccccaggtgcaccccttccccgaccacgagctggaggacatgaagatgaagatcagcgccctgaagagcgagatccagaaggagaaggccaacaagggccagagcagagccatcgagagactgaagaagaagatgttcgagaacgagttcctgctgctgctgaacagccccaccatccccttcagaatccacaacagaaacggcaagagctacctgttcctgctgagcagcgactacgagagaagcgagtggagagaggccatccagaagctgcagaagaaggacctgcaggccttcgtgctgagcagcgtggagctgcaggtgctgaccggcagctgcttcaagctgagaaccgtgcacaacatccccgtgaccagcaacaaggacgacgacgagagccccggcctgtacggcttcctgcacgtgatcgtgcacagcgccaagggcttcaagcagagcgccaacctgtactgcaccctggaggtggacagcttcggctacttcgtgagcaaggccaagaccagagtgttcagagacaccgccgagcccaagtgggacgaggagttcgagatcgagctggagggcagccagagcctgagaatcctgtgctacgagaagtgctacgacaagaccaaggtgaacaaggacaacaacgagatcgtggacaagatcatgggcaagggccagatccagctggacccccagaccgtggagaccaagaactggcacaccgacgtgatcgagatgaacggcatcaaggtggagttcagcatgaagttcaccagcagagacatgagcctgaagagaacccccagcaagaagcagaccggcgtgttcggcgtgaagatcagcgtggtgaccaagagagagagaagcaaggtgccctacatcgtgagacagtgcgtggaggaggtggagaagagaggcatcgaggaggtgggcatctacagaatcagcggcgtggccaccgacatccaggccctgaaggccgtgttcgacgccaacaacaaggacatcctgctgatgctgagcgacatggacatcaacgccatcgccggcaccctgaagctgtacttcagagagctgcccgagcccctgctgaccgacagactgtaccccgccttcatggagggcatcgccctgagcgaccccgccgccaaggagaactgcatgatgcacctgctgagaagcctgcccgaccccaacctgatcaccttcctgttcctgctggagcacctgaagagagtggccgagaaggagcccatcaacaagatgagcctgcacaacctggccaccgtgttcggccccaccctgctgagacccagcgaggtggagagcaaggcccacctgaccagcgccgccgacatctggagccacgacgtgatggcccaggtgcaggtgctgctgtactacctgcagcacccccccatcagcttcgccgagctgaagagaaacaccctgtacttcagcaccgacgtgtag

SEQ ID NO: 71612 - DNA, 2580 bp, Artificial Sequence
  Description of Artificial Sequence: Synthetic coding sequence
atggagcccctgagccacagaggcctgcccagactgagctggatcgacaccctgtacagcaacttcagctacggcaccgacgagtacgacggcgagggcaacgaggagcagaagggcccccccgagggcagcgagaccatgccctacatcgacgagagccccaccatgagcccccagctgagcgccagaagccagggcggcggcgacggcgtgagccccaccccccccgagggcctggcccccggcgtggaggccggcaagggcctggagatgagaaagctggtgctgagcggcttcctggccagcgaggagatctacatcaaccagctggaggccctgctgctgcccatgaagcccctgaaggccaccgccaccaccagccagcccgtgctgaccatccagcagatcgagaccatcttctacaagatccaggacatctacgagatccacaaggagttctacgacaacctgtgccccaaggtgcagcagtgggacagccaggtgaccatgggccacctgttccagaagctggccagccagctgggcgtgtacaaggccttcgtggacaactacaaggtggccctggagaccgccgagaagtgcagccagagcaacaaccagttccagaagatcagcgaggagctgaaggtgaagggccccaaggacagcaaggacagccacaccagcgtgaccatggaggccctgctgtacaagcccatcgacagagtgaccagaagcaccctggtgctgcacgacctgctgaagcacacccccgtggaccaccccgactaccccctgctgcaggacgccctgagaatcagccagaacttcctgagcagcatcaacgaggacatcgaccccagaagaaccgccgtgaccacccccaagggcgagaccagacagctggtgaaggacggcttcctggtggaggtgagcgagagcagcagaaagctgagacacgtgttcctgttcaccgacgtgctgctgtgcgccaagctgaagaagaccagcgccggcaagcaccagcagtacgactgcaagtggtacatccccctggccgacctggtgttccccagccccgaggagagcgaggccagcccccaggtgcaccccttccccgaccacgagctggaggacatgaagatgaagatcagcgccctgaagagcgagatccagaaggagaaggccaacaagggccagagcagagccatcgagagactgaagaagaagatgttcgagaacgagttcctgctgctgctgaacagccccaccatccccttcagaatccacaacagaaacggcaagagctacctgttcctgctgagcagcgactacgagagaagcgagtggagagaggccatccagaagctgcagaagaaggacctgcaggccttcgtgctgagcagcgtggagctgcaggtgctgaccggcagctgcttcaagctgagaaccgtgcacaacatccccgtgaccagcaacaaggacgacgacgagagccccggcctgtacggcttcctgcacgtgatcgtgcacagcgccaagggcttcaagcagagcgccaacctgtactgcaccctggaggtggacagcttcggctacttcgtgagcaaggccaagaccagagtgttcagagacaccgccgagcccaagtgggacgaggagttcgagatcgagctggagggcagccagagcctgagaatcctgtgctacgagaagtgctacgacaagaccaaggtgaacaaggacaacaacgagatcgtggacaagatcatgggcaagggccagatccagctggacccccagaccgtggagaccaagaactggcacaccgacgtgatcgagatgaacggcatcaaggtggagttcagcatgaagttcaccagcagagacatgagcctgaagagaacccccagcaagaagcagaccggcgtgttcggcgtgaagatcagcgtggtgaccaagagagagagaagcaaggtgccctacatcgtgagacagtgcgtggaggaggtggagaagagaggcatcgaggaggtgggcatctacagaatcagcggcgtggccaccgacatccaggccctgaaggccgtgttcgacgccaacaacaaggacatcctgctgatgctgagcgacatggacatcaacgccatcgccggcaccctgaagctgtacttcagagagctgcccgagcccctgctgaccgacagactgtaccccgccttcatggagggcatcgccctgagcgaccccgccgccaaggagaactgcatgatgcacctgctgagaagcctgcccgaccccaacctgatcaccttcctgttcctgctggagcacctgaagagagtggccgagaaggagcccatcaacaagatgagcctgcacaacctggccaccgtgttcggccccaccctgctgagacccagcgaggtggagagcaaggcccacctgaccagcgccgccgacatctggagccacgacgtgatggcccaggtgcaggtgctgctgtactacctgcagcacccccccatcagcttcgccgagctgaagagaaacaccctgtacttcagcaccgacgtgtag

SEQ ID NO: 71613 - DNA, 1092 bp, Artificial Sequence
  Description of Artificial Sequence: Synthetic coding sequence
atgaagcccctgaaggccaccgccaccaccagccagcccgtgctgaccatccagcagatcgagaccatcttctacaagatccaggacatctacgagatccacaaggagttctacgacaacctgtgccccaaggtgcagcagtgggacagccaggtgaccatgggccacctgttccagaagctggccagccagctgggcgtgtacaaggccttcgtggacaactacaaggtggccctggagaccgccgagaagtgcagccagagcaacaaccagttccagaagatcagcgaggagctgaaggtgaagggccccaaggacagcaaggacagccacaccagcgtgaccatggaggccctgctgtacaagcccatcgacagagtgaccagaagcaccctggtgctgcacgacctgctgaagcacacccccgtggaccaccccgactaccccctgctgcaggacgccctgagaatcagccagaacttcctgagcagcatcaacgaggacatcgaccccagaagaaccgccgtgaccacccccaagggcgagaccagacagctggtgaaggacggcttcctggtggaggtgagcgagagcagcagaaagctgagacacgtgttcctgttcaccgacgtgctgctgtgcgccaagctgaagaagaccagcgccggcaagcaccagcagtacgactgcaagtggtacatccccctggccgacctggtgttccccagccccgaggagagcgaggccagcccccaggtgcaccccttccccgaccacgagctggaggacatgaagatgaagatcagcgccctgaagagcgagatccagaaggaggaggtggagaagagaggcatcgaggaggtgggcatctacagaatcagcggcgtggccaccgacatccaggccctgaaggccgtgttcgacgccaacaacaaggacatcctgctgatgctgagcgacatggacatcaacgccatcgccggcaccctgaagctgtacttcagagagctgcccgagcccctgctgaccgacagactgagcccctgccccacccccaccagcagccccagcagcagctgctggaacacctag

SEQ ID NO: 71614 - DNA, 1926 bp, Artificial Sequence
  Description of Artificial Sequence: Synthetic coding sequence
atggagatcctgctgatcatcagattctgctgcaactgcacctacgccctgctgtacaagcccatcgacagagtgaccagaagcaccctggtgctgcacgacctgctgaagcacacccccgtggaccaccccgactaccccctgctgcaggacgccctgagaatcagccagaacttcctgagcagcatcaacgaggacatcgaccccagaagaaccgccgtgaccacccccaagggcgagaccagacagctggtgaaggacggcttcctggtggaggtgagcgagagcagcagaaagctgagacacgtgttcctgttcaccgacgtgctgctgtgcgccaagctgaagaagaccagcgccggcaagcaccagcagtacgactgcaagtggtacatccccctggccgacctggtgttccccagccccgaggagagcgaggccagcccccaggtgcaccccttccccgaccacgagctggaggacatgaagatgaagatcagcgccctgaagagcgagatccagaaggagaaggccaacaagggccagagcagagccatcgagagactgaagaagaagatgttcgagaacgagttcctgctgctgctgaacagccccaccatccccttcagaatccacaacagaaacggcaagagctacctgttcctgctgagcagcgactacgagagaagcgagtggagagaggccatccagaagctgcagaagaaggacctgcaggccttcgtgctgagcagcgtggagctgcaggtgctgaccggcagctgcttcaagctgagaaccgtgcacaacatccccgtgaccagcaacaaggacgacgacgagagccccggcctgtacggcttcctgcacgtgatcgtgcacagcgccaagggcttcaagcagagcgccaacctgtactgcaccctggaggtggacagcttcggctacttcgtgagcaaggccaagaccagagtgttcagagacaccgccgagcccaagtgggacgaggagttcgagatcgagctggagggcagccagagcctgagaatcctgtgctacgagaagtgctacgacaagaccaaggtgaacaaggacaacaacgagatcgtggacaagatcatgggcaagggccagatccagctggacccccagaccgtggagaccaagaactggcacaccgacgtgatcgagatgaacggcatcaaggtggagttcagcatgaagttcaccagcagagacatgagcctgaagagaacccccagcaagaagcagaccggcgtgttcggcgtgaagatcagcgtggtgaccaagagagagagaagcaaggtgccctacatcgtgagacagtgcgtggaggaggtggagaagagaggcatcgaggaggtgggcatctacagaatcagcggcgtggccaccgacatccaggccctgaaggccgtgttcgacgccaacaacaaggacatcctgctgatgctgagcgacatggacatcaacgccatcgccggcaccctgaagctgtacttcagagagctgcccgagcccctgctgaccgacagactgtaccccgccttcatggagggcatcgccctgagcgaccccgccgccaaggagaactgcatgatgcacctgctgagaagcctgcccgaccccaacctgatcaccttcctgttcctgctggagcacctgaagagagtggccgagaaggagcccatcaacaagatgagcctgcacaacctggccaccgtgttcggccccaccctgctgagacccagcgaggtggagagcaaggcccacctgaccagcgccgccgacatctggagccacgacgtgatggcccaggtgcaggtgctgctgtactacctgcagcacccccccatcagcttcgccgagctgaagagaaacaccctgtacttcagcaccgacgtgtag

SEQ ID NO: 71615 - DNA, 933 bp, Artificial Sequence
  Description of Artificial Sequence: Synthetic coding sequence
atgaccgacgtgctgccccagcccgactgcagccccaaggccggcagagagcccctggccctggaggagagcggcagcaagagaccccccaacaccggcgccagactgtggggcagagtgagaaacaagctgctgagaaacaagctggacccccagaccgtggagaccaagaactggcacaccgacgtgatcgagatgaacggcatcaaggtggagttcagcatgaagttcaccagcagagacatgagcctgaagagaacccccagcaagaagcagaccggcgtgttcggcgtgaagatcagcgtggtgaccaagagagagagaagcaaggtgccctacatcgtgagacagtgcgtggaggaggtggagaagagaggcatcgaggaggtgggcatctacagaatcagcggcgtggccaccgacatccaggccctgaaggccgtgttcgacgccaacaacaaggacatcctgctgatgctgagcgacatggacatcaacgccatcgccggcaccctgaagctgtacttcagagagctgcccgagcccctgctgaccgacagactgtaccccgccttcatggagggcatcgccctgagcgaccccgccgccaaggagaactgcatgatgcacctgctgagaagcctgcccgaccccaacctgatcaccttcctgttcctgctggagcacctgaagagagtggccgagaaggagcccatcaacaagatgagcctgcacaacctggccaccgtgttcggccccaccctgctgagacccagcgaggtggagagcaaggcccacctgaccagcgccgccgacatctggagccacgacgtgatggcccaggtgcaggtgctgctgtactacctgcagcacccccccatcagcttcgccgagctgaagagaaacaccctgtacttcagcaccgacgtgtag

SEQ ID NO: 71616 - DNA, 2442 bp, Artificial Sequence
  Description of Artificial Sequence: Synthetic coding sequence
atgccctacatcgacgagagccccaccatgagcccccagctgagcgccagaagccagggcggcggcgacggcgtgagccccaccccccccgagggcctggcccccggcgtggaggccggcaagggcctggagatgagaaagctggtgctgagcggcttcctggccagcgaggagatctacatcaaccagctggaggccctgctgctgcccatgaagcccctgaaggccaccgccaccaccagccagcccgtgctgaccatccagcagatcgagaccatcttctacaagatccaggacatctacgagatccacaaggagttctacgacaacctgtgccccaaggtgcagcagtgggacagccaggtgaccatgggccacctgttccagaagctggccagccagctgggcgtgtacaaggccttcgtggacaactacaaggtggccctggagaccgccgagaagtgcagccagagcaacaaccagttccagaagatcagcgaggagctgaaggtgaagggccccaaggacagcaaggacagccacaccagcgtgaccatggaggccctgctgtacaagcccatcgacagagtgaccagaagcaccctggtgctgcacgacctgctgaagcacacccccgtggaccaccccgactaccccctgctgcaggacgccctgagaatcagccagaacttcctgagcagcatcaacgaggacatcgaccccagaagaaccgccgtgaccacccccaagggcgagaccagacagctggtgaaggacggcttcctggtggaggtgagcgagagcagcagaaagctgagacacgtgttcctgttcaccgacgtgctgctgtgcgccaagctgaagaagaccagcgccggcaagcaccagcagtacgactgcaagtggtacatccccctggccgacctggtgttccccagccccgaggagagcgaggccagcccccaggtgcaccccttccccgaccacgagctggaggacatgaagatgaagatcagcgccctgaagagcgagatccagaaggagaaggccaacaagggccagagcagagccatcgagagactgaagaagaagatgttcgagaacgagttcctgctgctgctgaacagccccaccatccccttcagaatccacaacagaaacggcaagagctacctgttcctgctgagcagcgactacgagagaagcgagtggagagaggccatccagaagctgcagaagaaggacctgcaggccttcgtgctgagcagcgtggagctgcaggtgctgaccggcagctgcttcaagctgagaaccgtgcacaacatccccgtgaccagcaacaaggacgacgacgagagccccggcctgtacggcttcctgcacgtgatcgtgcacagcgccaagggcttcaagcagagcgccaacctgtactgcaccctggaggtggacagcttcggctacttcgtgagcaaggccaagaccagagtgttcagagacaccgccgagcccaagtgggacgaggagttcgagatcgagctggagggcagccagagcctgagaatcctgtgctacgagaagtgctacgacaagaccaaggtgaacaaggacaacaacgagatcgtggacaagatcatgggcaagggccagatccagctggacccccagaccgtggagaccaagaactggcacaccgacgtgatcgagatgaacggcatcaaggtggagttcagcatgaagttcaccagcagagacatgagcctgaagagaacccccagcaagaagcagaccggcgtgttcggcgtgaagatcagcgtggtgaccaagagagagagaagcaaggtgccctacatcgtgagacagtgcgtggaggaggtggagaagagaggcatcgaggaggtgggcatctacagaatcagcggcgtggccaccgacatccaggccctgaaggccgtgttcgacgccaacaacaaggacatcctgctgatgctgagcgacatggacatcaacgccatcgccggcaccctgaagctgtacttcagagagctgcccgagcccctgctgaccgacagactgtaccccgccttcatggagggcatcgccctgagcgaccccgccgccaaggagaactgcatgatgcacctgctgagaagcctgcccgaccccaacctgatcaccttcctgttcctgctggagcacctgaagagagtggccgagaaggagcccatcaacaagatgagcctgcacaacctggccaccgtgttcggccccaccctgctgagacccagcgaggtggagagcaaggcccacctgaccagcgccgccgacatctggagccacgacgtgatggcccaggtgcaggtgctgctgtactacctgcagcacccccccatcagcttcgccgagctgaagagaaacaccctgtacttcagcaccgacgtgtag

SEQ ID NO: 71617 - DNA, 1332 bp, Artificial Sequence
  Description of Artificial Sequence: Synthetic coding sequence
atgctgaccaacggcaaggagcaggtgatcaagagctgcgtgagcctgcccgagctgaacgcccaggtgttctgccacagcagcaacaacgtgaccaagaccgagtgctgcttcaccgacttctgcaacaacatcaccctgcacctgcccaccgccagccccaacgcccccaagctgggccccatggagctggccatcatcatcaccgtgcccgtgtgcctgctgagcatcgccgccatgctgaccgtgtgggcctgccagggcagacagtgcagctacagaaagaagaagagacccaacgtggaggagcccctgagcgagtgcaacctggtgaacgccggcaagaccctgaaggacctgatctacgacgtgaccgccagcggcagcggcagcggcctgcccctgctggtgcagagaaccatcgccagaaccatcgtgctgcaggagatcgtgggcaagggcagattcggcgaggtgtggcacggcagatggtgcggcgaggacgtggccgtgaagatcttcagcagcagagacgagagaagctggttcagagaggccgagatctaccagaccgtgatgctgagacacgagaacatcctgggcttcatcgccgccgacaacaaggacaacggcacctggacccagctgtggctggtgagcgagtaccacgagcagggcagcctgtacgactacctgaacagaaacatcgtgaccgtggccggcatgatcaagctggccctgagcatcgccagcggcctggcccacctgcacatggagatcgtgggcacccagggcaagcccgccatcgcccacagagacatcaagagcaagaacatcctggtgaagaagtgcgagacctgcgccatcgccgacctgggcctggccgtgaagcacgacagcatcctgaacaccatcgacatcccccagaaccccaaggtgggcaccaagagatacatggcccccgagatgctggacgacaccatgaacgtgaacatcttcgagagcttcaagagagccgacatctacagcgtgggcctggtgtactgggagatcgccagaagatgcagcgtgggcggcatcgtggaggagtaccagctgccctactacgacatggtgcccagcgaccccagcatcgaggagatgagaaaggtggtgtgcgaccagaagttcagacccagcatccccaaccagtggcagagctgcgaggccctgagagtgatgggcagaatcatgagagagtgctggtacgccaacggcgccgccagactgaccgccctgagaatcaagaagaccatcagccagctgtgcgtgaaggaggactgcaaggcctag

SEQ ID NO: 71618 - DNA, 1512 bp, Artificial Sequence
  Description of Artificial Sequence: Synthetic coding sequence
atgaccctgggcagccccagaaagggcctgctgatgctgctgatggccctggtgacccagggcgaccccgtgaagcccagcagaggccccctggtgacctgcacctgcgagagcccccactgcaagggccccacctgcagaggcgcctggtgcaccgtggtgctggtgagagaggagggcagacacccccaggagcacagaggctgcggcaacctgcacagagagctgtgcagaggcagacccaccgagttcgtgaaccactactgctgcgacagccacctgtgcaaccacaacgtgagcctggtgctggaggccacccagccccccagcgagcagcccggcaccgacggccagctggccctgatcctgggccccgtgctggccctgctggccctggtggccctgggcgtgctgggcctgtggcacgtgagaagaagacaggagaagcagagaggcctgcacagcgagctgggcgagagcagcctgatcctgaaggccagcgagcagggcgacagcatgctgggcgacctgctggacagcgactgcaccaccggcagcggcagcggcctgcccttcctggtgcagagaaccgtggccagacaggtggccctggtggagtgcgtgggcaagggcagatacggcgaggtgtggagaggcctgtggcacggcgagagcgtggccgtgaagatcttcagcagcagagacgagcagagctggttcagagagaccgagatctacaacaccgtgctgctgagacacgacaacatcctgggcttcatcgccagcgacatgaccagcagaaacagcagcacccagctgtggctgatcacccactaccacgagcacggcagcctgtacgacttcctgcagagacagaccctggagccccacctggccctgagactggccgtgagcgccgcctgcggcctggcccacctgcacgtggagatcttcggcacccagggcaagcccgccatcgcccacagagacttcaagagcagaaacgtgctggtgaagagcaacctgcagtgctgcatcgccgacctgggcctggccgtgatgcacagccagggcagcgactacctggacatcggcaacaaccccagagtgggcaccaagagatacatggcccccgaggtgctggacgagcagatcagaaccgactgcttcgagagctacaagtggaccgacatctgggccttcggcctggtgctgtgggagatcgccagaagaaccatcgtgaacggcatcgtggaggactacagaccccccttctacgacgtggtgcccaacgaccccagcttcgaggacatgaagaaggtggtgtgcgtggaccagcagacccccaccatccccaacagactggccgccgaccccgtgctgagcggcctggcccagatgatgagagagtgctggtaccccaaccccagcgccagactgaccgccctgagaatcaagaagaccctgcagaagatcagcaacagccccgagaagcccaaggtgatccagtag

SEQ ID NO: 71619 - DNA, 1512 bp, Artificial Sequence; identical to SEQ ID NO: 71618
  Description of Artificial Sequence: Synthetic coding sequence

SEQ ID NO: 71620 - DNA, 990 bp, Artificial Sequence
  Description of Artificial Sequence: Synthetic coding sequence
atggccctgaccccccccctgctgctgctgagcgccggcaccatgaccctgggcagccccagaaagggcctgctgatgctgctgatggccctggtgacccagggcaagggcagatacggcgaggtgtggagaggcctgtggcacggcgagagcgtggccgtgaagatcttcagcagcagagacgagcagagctggttcagagagaccgagatctacaacaccgtgctgctgagacacgacaacatcctgggcttcatcgccagcgacatgaccagcagaaacagcagcacccagctgtggctgatcacccactaccacgagcacggcagcctgtacgacttcctgcagagacagaccctggagccccacctggccctgagactggccgtgagcgccgcctgcggcctggcccacctgcacgtggagatcttcggcacccagggcaagcccgccatcgcccacagagacttcaagagcagaaacgtgctggtgaagagcaacctgcagtgctgcatcgccgacctgggcctggccgtgatgcacagccagggcagcgactacctggacatcggcaacaaccccagagtgggcaccaagagatacatggcccccgaggtgctggacgagcagatcagaaccgactgcttcgagagctacaagtggaccgacatctgggccttcggcctggtgctgtgggagatcgccagaagaaccatcgtgaacggcatcgtggaggactacagaccccccttctacgacgtggtgcccaacgaccccagcttcgaggacatgaagaaggtggtgtgcgtggaccagcagacccccaccatccccaacagactggccgccgaccccgtgctgagcggcctggcccagatgatgagagagtgctggtaccccaaccccagcgccagactgaccgccctgagaatcaagaagaccctgcagaagatcagcaacagccccgagaagcccaaggtgatccagtag

SEQ ID NO: 71621 - DNA, 480 bp, Artificial Sequence
  Description of Artificial Sequence: Synthetic coding sequence
atggccctgaccccccccctgctgctgctgagcgccggcaccatgaccctgggcagccccagaaagggcctgctgatgctgctgatggccctggtgacccagggcgaccccgtgaagcccagcagaggccccctggtgacctgcacctgcgagagcccccactgcaagggccccacctgcagaggcgcctggtgcaccgtggtgctggtgagagaggagggcagacacccccaggagcacagaggctgcggcaacctgcacagagagctgtgcagaggcagacccaccgagttcgtgaaccactactgctgcgacagccacctgtgcaaccacaacgtgagcctggtgctggagggcaagggcagatacggcgaggtgtggagaggcctgtggcacggcgagagcgtggccgtgaagatcttcagcagcagagacgagcagagctggttcagagagaccgagatctacaacaccgtgtag

SEQ ID NO: 71622 - DNA, 1554 bp, Artificial Sequence
  Description of Artificial Sequence: Synthetic coding sequence
atggccctgaccccccccctgctgctgctgagcgccggcaccatgaccctgggcagccccagaaagggcctgctgatgctgctgatggccctggtgacccagggcgaccccgtgaagcccagcagaggccccctggtgacctgcacctgcgagagcccccactgcaagggccccacctgcagaggcgcctggtgcaccgtggtgctggtgagagaggagggcagacacccccaggagcacagaggctgcggcaacctgcacagagagctgtgcagaggcagacccaccgagttcgtgaaccactactgctgcgacagccacctgtgcaaccacaacgtgagcctggtgctggaggccacccagccccccagcgagcagcccggcaccgacggccagctggccctgatcctgggccccgtgctggccctgctggccctggtggccctgggcgtgctgggcctgtggcacgtgagaagaagacaggagaagcagagaggcctgcacagcgagctgggcgagagcagcctgatcctgaaggccagcgagcagggcgacagcatgctgggcgacctgctggacagcgactgcaccaccggcagcggcagcggcctgcccttcctggtgcagagaaccgtggccagacaggtggccctggtggagtgcgtgggcaagggcagatacggcgaggtgtggagaggcctgtggcacggcgagagcgtggccgtgaagatcttcagcagcagagacgagcagagctggttcagagagaccgagatctacaacaccgtgctgctgagacacgacaacatcctgggcttcatcgccagcgacatgaccagcagaaacagcagcacccagctgtggctgatcacccactaccacgagcacggcagcctgtacgacttcctgcagagacagaccctggagccccacctggccctgagactggccgtgagcgccgcctgcggcctggcccacctgcacgtggagatcttcggcacccagggcaagcccgccatcgcccacagagacttcaagagcagaaacgtgctggtgaagagcaacctgcagtgctgcatcgccgacctgggcctggccgtgatgcacagccagggcagcgactacctggacatcggcaacaaccccagagtgggcaccaagagatacatggcccccgaggtgctggacgagcagatcagaaccgactgcttcgagagctacaagtggaccgacatctgggccttcggcctggtgctgtgggagatcgccagaagaaccatcgtgaacggcatcgtggaggactacagaccccccttctacgacgtggtgcccaacgaccccagcttcgaggacatgaagaaggtggtgtgcgtggaccagcagacccccaccatccccaacagactggccgccgaccccgtgctgagcggcctggcccagatgatgagagagtgctggtaccccaaccccagcgccagactgaccgccctgagaatcaagaagaccctgcagaagatcagcaacagccccgagaagcccaaggtgatccagtag

SEQ ID NO: 71623 - DNA, 1530 bp, Artificial Sequence
  Description of Artificial Sequence: Synthetic coding sequence
atggtggacggcgtgatgatcctgcccgtgctgatcatgatcgccctgcccagccccagcatggaggacgagaagcccaaggtgaaccccaagctgtacatgtgcgtgtgcgagggcctgagctgcggcaacgaggaccactgcgagggccagcagtgcttcagcagcctgagcatcaacgacggcttccacgtgtaccagaagggctgcttccaggtgtacgagcagggcaagatgacctgcaagaccccccccagccccggccaggccgtggagtgctgccagggcgactggtgcaacagaaacatcaccgcccagctgcccaccaagggcaagagcttccccggcacccagaacttccacctggaggtgggcctgatcatcctgagcgtggtgttcgccgtgtgcctgctggcctgcctgctgggcgtggccctgagaaagttcaagagaagaaaccaggagagactgaaccccagagacgtggagtacggcaccatcgagggcctgatcaccaccaacgtgggcgacagcaccctggccgacctgctggaccacagctgcaccagcggcagcggcagcggcctgcccttcctggtgcagagaaccgtggccagacagatcaccctgctggagtgcgtgggcaagggcagatacggcgaggtgtggagaggcagctggcagggcgagaacgtggccgtgaagatcttcagcagcagagacgagaagagctggttcagagagaccgagctgtacaacaccgtgatgctgagacacgagaacatcctgggcttcatcgccagcgacatgaccagcagacacagcagcacccagctgtggctgatcacccactaccacgagatgggcagcctgtacgactacctgcagctgaccaccctggacaccgtgagctgcctgagaatcgtgctgagcatcgccagcggcctggcccacctgcacatcgagatcttcggcacccagggcaagcccgccatcgcccacagagacctgaagagcaagaacatcctggtgaagaagaacggccagtgctgcatcgccgacctgggcctggccgtgatgcacagccagagcaccaaccagctggacgtgggcaacaaccccagagtgggcaccaagagatacatggcccccgaggtgctggacgagaccatccaggtggactgcttcgacagctacaagagagtggacatctgggccttcggcctggtgctgtgggaggtggccagaagaatggtgagcaacggcatcgtggaggactacaagccccccttctacgacgtggtgcccaacgaccccagcttcgaggacatgagaaaggtggtgtgcgtggaccagcagagacccaacatccccaacagatggttcagcgaccccaccctgaccagcctggccaagctgatgaaggagtgctggtaccagaaccccagcgccagactgaccgccctgagaatcaagaagaccctgaccaagatcgacaacagcctggacaagctgaagaccgactgctag

SEQ ID NO: 71624 - DNA, 1530 bp, Artificial Sequence; identical to SEQ ID NO: 71623
  Description of Artificial Sequence: Synthetic coding sequence

SEQ ID NO: 71625 - DNA, 1530 bp, Artificial Sequence; identical to SEQ ID NO: 71623
  Description of Artificial Sequence: Synthetic coding sequence

SEQ ID NO: 71626 - DNA, 264 bp, Artificial Sequence
  Description of Artificial Sequence: Synthetic coding sequence
atggtggacggcgtgatgatcctgcccgtgctgatcatgatcgccctgcccagccccagcatggaggacgagaagcccaaggtgaaccccaagctgtacatgtgcgtgtgcgagggcctgagctgcggcaacgaggaccactgcgagggccagcagtgcttcagcagcctgagcatcaacgacggcttccacgtgtaccagaagggctgcttccaggtgtacgagcagggcaagatgacctgcaagaccccccccagcccctag

SEQ ID NO: 71627 - DNA, 66 bp, Artificial Sequence
  Description of Artificial Sequence: Synthetic coding sequence
atggtggacggcgtgatgatcctgcccgtgctgatcatgatcgccctgcccagccccagcatgtag

SEQ ID NO: 71628 - DNA, 216 bp, Artificial Sequence
  Description of Artificial Sequence: Synthetic coding sequence
atggtggacggcgtgatgatcctgcccgtgctgatcatgatcgccctgcccagccccagcatggaggacgagaagcccaaggtgaaccccaagctgtacatgtgcgtgtgcgagggcctgagctgcggcaacgaggaccactgcgagggccagcagtgcttcagcagcctgagcatcaacgacggcttccacgtgtaccagaagggctgcttctag

SEQ ID NO: 71629 - DNA, 1530 bp, Artificial Sequence; identical to SEQ ID NO: 71623
  Description of Artificial Sequence: Synthetic coding sequence

SEQ ID NO: 71630 - DNA, 264 bp, Artificial Sequence; identical to SEQ ID NO: 71626
  Description of Artificial Sequence: Synthetic coding sequence

SEQ ID NO: 71631 - DNA, 222 bp, Artificial Sequence
  Description of Artificial Sequence: Synthetic coding sequence
atggtggacggcgtgatgatcctgcccgtgctgatcatgatcgccctgcccagccccagcatggaggacgagaagcccaaggtgaaccccaagctgtacatgtgcgtgtgcgagggcctgagctgcggcaacgaggaccactgcgagggccagcagtgcttcagcagcctgagcatcaacgacggcttccacgtgtaccagaagggctgcttccaggtgtag

SEQ ID NO: 71632 - DNA, 1518 bp, Artificial Sequence
  Description of Artificial Sequence: Synthetic coding sequence
atggccgagagcgccggcgccagcagcttcttccccctggtggtgctgctgctggccggcagcggcggcagcggccccagaggcgtgcaggccctgctgtgcgcctgcaccagctgcctgcaggccaactacacctgcgagaccgacggcgcctgcatggtgagcatcttcaacctggacggcatggagcaccacgtgagaacctgcatccccaaggtggagctggtgcccgccggcaagcccttctactgcctgagcagcgaggacctgagaaacacccactgctgctacaccgactactgcaacagaatcgacctgagagtgcccagcggccacctgaaggagcccgagcaccccagcatgtggggccccgtggagctggtgggcatcatcgccggccccgtgttcctgctgttcctgatcatcatcatcgtgttcctggtgatcaactaccaccagagagtgtaccacaacagacagagactggacatggaggaccccagctgcgagatgtgcctgagcaaggacaagaccctgcaggacctggtgtacgacctgagcaccagcggcagcggcagcggcctgcccctgttcgtgcagagaaccgtggccagaaccatcgtgctgcaggagatcatcggcaagggcagattcggcgaggtgtggagaggcagatggagaggcggcgacgtggccgtgaagatcttcagcagcagagaggagagaagctggttcagagaggccgagatctaccagaccgtgatgctgagacacgagaacatcctgggcttcatcgccgccgacaacaaggacaacggcacctggacccagctgtggctggtgagcgactaccacgagcacggcagcctgttcgactacctgaacagatacaccgtgaccatcgagggcatgatcaagctggccctgagcgccgccagcggcctggcccacctgcacatggagatcgtgggcacccagggcaagcccggcatcgcccacagagacctgaagagcaagaacatcctggtgaagaagaacggcatgtgcgccatcgccgacctgggcctggccgtgagacacgacgccgtgaccgacaccatcgacatcgcccccaaccagagagtgggcaccaagagatacatggcccccgaggtgctggacgagaccatcaacatgaagcacttcgacagcttcaagtgcgccgacatctacgccctgggcctggtgtactgggagatcgccagaagatgcaacagcggcggcgtgcacgaggagtaccagctgccctactacgacctggtgcccagcgaccccagcatcgaggagatgagaaaggtggtgtgcgaccagaagctgagacccaacatccccaactggtggcagagctacgaggccctgagagtgatgggcaagatgatgagagagtgctggtacgccaacggcgccgccagactgaccgccctgagaatcaagaagaccctgagccagctgagcgtgcaggaggacgtgaagatctag

SEQ ID NO: 71633 - DNA, 1464 bp, Artificial Sequence
  Description of Artificial Sequence: Synthetic coding sequence
atggccgagagcgccggcgccagcagcttcttccccctggtggtgctgctgctggccggcagcggcggcagcggccccagaggcgtgcaggccctgctgtgcgcctgcaccagctgcctgcaggccaactacacctgcgagaccgacggcgcctgcatggtgagcatcttcaacctggacggcatggagcaccacgtgagaacctgcatccccaaggtggagctggtgcccgccggcaagcccttctactgcctgagcagcgaggacctgagaaacacccactgctgctacaccgactactgcaacagaatcgacctgagagtgcccagcggccacctgaaggagcccgagcaccccagcatgtggggccccgtggagctggtgggcatcatcgccggccccgtgttcctgctgttcctgatcatcatcatcgtgttcctggtgatcaactaccaccagagagtgtaccacaacagacagagactggacatggaggaccccagctgcgagatgtgcctgagcaaggacaagaccctgcaggacctggtgtacgacctgagcaccagcggcagcggcagcggcctgcccctgttcgtgcagagaaccgtggccagaaccatcgtgctgcaggagatcatcggcaagggcagattcggcgaggtgtggagaggcagatggagaggcggcgacgtggccgtgaagatcttcagcagcagagaggagagaagctggttcagagaggccgagatctaccagaccgtgatgctgagacacgagaacatcctgggcttcatcgccgccgacaacaaggacaacggcacctggacccagctgtggctggtgagcgactaccacgagcacggcagcctgttcgactacctgaacagatacaccgtgaccatcgagggcatgatcaagctggccctgagcgccgccagcggcctggcccacctgcacatggagatcgtgggcacccagggcaagcccggcatcgcccacagagacctgaagagcaagaacatcctggtgaagaagaacggcatgtgcgccatcgccgacctgggcctggccgtgagacacgacgccgtgaccgacaccatcgacatcgcccccaaccagagagtgggcaccaagagatacatggcccccgaggtgctggacgagaccatcaacatgaagcacttcgacagcttcaagtgcgccgacatctacgccctgggcctggtgtactgggagatcgccagaagatgcaacagcggcggcaccttcctgttctgcctgtgcagctacctgcccttccaggacgccggcagccccaaggccgtgctgctgccccccttcttcctgcagcccgtgggctgcctgctgcccgagcccgagagcagcttcaaggtggccatcaagggcgtggaggtggccgtgctgagagtgagactgttcttcagagaccagttcgtggagtag

SEQ ID NO: 71634 - DNA, 1431 bp, Artificial Sequence
  Description of Artificial Sequence: Synthetic coding sequence
atggccgagagcgccggcgccagcagcttcttccccctggtggtgctgctgctggccggcagcggcggcagcggccccagaggcgtgcaggccctgctgtgcgcctgcaccagctgcctgcaggccaactacacctgcgagaccgacggcgcctgcatggtgagcatcttcaacctggacggcatggagcaccacgtgagaacctgcatccccaaggtggagctggtgcccgccggcaagcccttctactgcctgagcagcgaggacctgagaaacacccactgctgctacaccgactactgcaacagaatcgacctgagagtgcccagcggccacctgaaggagcccgagcaccccagcatgtggggccccgtggagctggtgggcatcatcgccggccccgtgttcctgctgttcctgatcatcatcatcgtgttcctggtgatcaactaccaccagagagtgtaccacaacagacagagactggacatggaggaccccagctgcgagatgtgcctgagcaaggacaagaccctgcaggacctggtgtacgacctgagcaccagcggcagcggcagcggcctgcccctgttcgtgcagagaaccgtggccagaaccatcgtgctgcaggagatcatcggcaagggcagattcggcgaggtgtggagaggcagatggagaggcggcgacgtggccgtgaagatcttcagcagcagagaggagagaagctggttcagagaggccgagatctaccagaccgtgatgctgagacacgagaacatcctgggcttcatcgccgccgacaacaaggacaacggcacctggacccagctgtggctggtgagcgactaccacgagcacggcagcctgttcgactacctgaacagatacaccgtgaccatcgagggcatgatcaagctggccctgagcgccgccagcggcctggcccacctgcacatggagatcgtgggcacccagggcaagcccggcatcgcccacagagacctgaagagcaagaacatcctggtgaagaagaacggcatgtgcgccatcgccgacctgggcctggccgtgagacacgacgccgtgaccgacaccatcgacatcgcccccaaccagagagtgggcaccaagagatacatggcccccgaggtgctggacgagaccatcaacatgaagcacttcgacagcttcaagtgcgccgacatctacgccctgggcctggtgtactgggagatcgccagaagatgcaacagcggcggcgtgcacgaggagtaccagctgccctactacgacctggtgcccagcgaccccagcatcgaggagatgagaaaggtggtgtgcgaccagaagctgagacccaacatccccaactggtggcagagctacgaggtgagaagctggccccccgccgccttccccagcgcctag

SEQ ID NO: 71635 - DNA, 1641 bp, Artificial Sequence
  Description of Artificial Sequence: Synthetic coding sequence
atggccgagagcgccggcgccagcagcttcttccccctggtggtgctgctgctggccggcagcggcggcagcggccccagaggcgtgcaggccctgctgtgcgcctgcaccagctgcctgcaggccaactacacctgcgagaccgacggcgcctgcatggtgagcatcttcaacctggacggcatggagcaccacgtgagaacctgcatccccaaggtggagctggtgcccgccggcaagcccttctactgcctgagcagcgaggacctgagaaacacccactgctgctacaccgactactgcaacagaatcgacctgagagtgcccagcggccacctgaaggagcccgagcaccccagcatgtggggccccgtggagctggtgggcatcatcgccggccccgtgttcctgctgttcctgatcatcatcatcgtgttcctggtgatcaactaccaccagagagtgtaccacaacagacagagactggacatggaggaccccagctgcgagatgtgcctgagcaaggacaagaccctgcaggacctggtgtacgacctgagcaccagcggcagcggcagcggcctgcccctgttcgtgcagagaaccgtggccagaaccatcgtgctgcaggagatcatcggcaagggcagattcggcgaggtgtggagaggcagatggagaggcggcgacgtggccgtgaagatcttcagcagcagagaggagagaagctggttcagagaggccgagatctaccagaccgtgatgctgagacacgagaacatcctgggcttcatcgccgccgacaacaaggccgactgcagcttcctgaccctgccctgggaggtggtgatggtgagcgccgcccccaagctgagaagcctgagactgcagtacaagggcggcagaggcagagccagattcctgttccccctgaacaacggcacctggacccagctgtggctggtgagcgactaccacgagcacggcagcctgttcgactacctgaacagatacaccgtgaccatcgagggcatgatcaagctggccctgagcgccgccagcggcctggcccacctgcacatggagatcgtgggcacccagggcaagcccggcatcgcccacagagacctgaagagcaagaacatcctggtgaagaagaacggcatgtgcgccatcgccgacctgggcctggccgtgagacacgacgccgtgaccgacaccatcgacatcgcccccaaccagagagtgggcaccaagagatacatggcccccgaggtgctggacgagaccatcaacatgaagcacttcgacagcttcaagtgcgccgacatctacgccctgggcctggtgtactgggagatcgccagaagatgcaacagcggcggcgtgcacgaggagtaccagctgccctactacgacctggtgcccagcgaccccagcatcgaggagatgagaaaggtggtgtgcgaccagaagctgagacccaacatccccaactggtggcagagctacgaggccctgagagtgatgggcaagatgatgagagagtgctggtacgccaacggcgccgccagactgaccgccctgagaatcaagaagaccctgagccagctgagcgtgcaggaggacgtgaagatctag

SEQ ID NO: 71636 - DNA, 1362 bp, Artificial Sequence
  Description of Artificial Sequence: Synthetic coding sequence
atggtgagcatcttcaacctggacggcatggagcaccacgtgagaacctgcatccccaaggtggagctggtgcccgccggcaagcccttctactgcctgagcagcgaggacctgagaaacacccactgctgctacaccgactactgcaacagaatcgacctgagagtgcccagcggccacctgaaggagcccgagcaccccagcatgtggggccccgtggagctggtgggcatcatcgccggccccgtgttcctgctgttcctgatcatcatcatcgtgttcctggtgatcaactaccaccagagagtgtaccacaacagacagagactggacatggaggaccccagctgcgagatgtgcctgagcaaggacaagaccctgcaggacctggtgtacgacctgagcaccagcggcagcggcagcggcctgcccctgttcgtgcagagaaccgtggccagaaccatcgtgctgcaggagatcatcggcaagggcagattcggcgaggtgtggagaggcagatggagaggcggcgacgtggccgtgaagatcttcagcagcagagaggagagaagctggttcagagaggccgagatctaccagaccgtgatgctgagacacgagaacatcctgggcttcatcgccgccgacaacaaggacaacggcacctggacccagctgtggctggtgagcgactaccacgagcacggcagcctgttcgactacctgaacagatacaccgtgaccatcgagggcatgatcaagctggccctgagcgccgccagcggcctggcccacctgcacatggagatcgtgggcacccagggcaagcccggcatcgcccacagagacctgaagagcaagaacatcctggtgaagaagaacggcatgtgcgccatcgccgacctgggcctggccgtgagacacgacgccgtgaccgacaccatcgacatcgcccccaaccagagagtgggcaccaagagatacatggcccccgaggtgctggacgagaccatcaacatgaagcacttcgacagcttcaagtgcgccgacatctacgccctgggcctggtgtactgggagatcgccagaagatgcaacagcggcggcgtgcacgaggagtaccagctgccctactacgacctggtgcccagcgaccccagcatcgaggagatgagaaaggtggtgtgcgaccagaagctgagacccaacatccccaactggtggcagagctacgaggccctgagagtgatgggcaagatgatgagagagtgctggtacgccaacggcgccgccagactgaccgccctgagaatcaagaagaccctgagccagctgagcgtgcaggaggacgtgaagatctag

SEQ ID NO: 71637 - DNA, 1482 bp, Artificial Sequence
  Description of Artificial Sequence: Synthetic coding sequence
atgaccagagccctgtgcagcgccctgagacaggccctgctgctgctggccgccgccgccgagctgagccccggcctgaagtgcgtgtgcctgctgtgcgacagcagcaacttcacctgccagaccgagggcgcctgctgggccagcgtgatgctgaccaacggcaaggagcaggtgatcaagagctgcgtgagcctgcccgagctgaacgcccaggtgttctgccacagcagcaacaacgtgaccaagaccgagtgctgcttcaccgacttctgcaacaacatcaccctgcacctgcccaccgccagccccaacgcccccaagctgggccccatggagctggccatcatcatcaccgtgcccgtgtgcctgctgagcatcgccgccatgctgaccgtgtgggcctgccagggcagacagtgcagctacagaaagaagaagagacccaacgtggaggagcccctgagcgagtgcaacctggtgaacgccggcaagaccctgaaggacctgatctacgacgtgaccgccagcggcagcggcagcggcctgcccctgctggtgcagagaaccatcgccagaaccatcgtgctgcaggagatcgtgggcaagggcagattcggcgaggtgtggcacggcagatggtgcggcgaggacgtggccgtgaagatcttcagcagcagagacgagagaagctggttcagagaggccgagatctaccagaccgtgatgctgagacacgagaacatcctgggcttcatcgccgccgacaacaaggacaacggcacctggacccagctgtggctggtgagcgagtaccacgagcagggcagcctgtacgactacctgaacagaaacatcgtgaccgtggccggcatgatcaagctggccctgagcatcgccagcggcctggcccacctgcacatggagatcgtgggcacccagggcaagcccgccatcgcccacagagacatcaagagcaagaacatcctggtgaagaagtgcgagacctgcgccatcgccgacctgggcctggccgtgaagcacgacagcatcctgaacaccatcgacatcccccagaaccccaaggtgggcaccaagagatacatggcccccgagatgctggacgacaccatgaacgtgaacatcttcgagagcttcaagagagccgacatctacagcgtgggcctggtgtactgggagatcgccagaagatgcagcgtgggcggcatcgtggaggagtaccagctgccctactacgacatggtgcccagcgaccccagcatcgaggagatgagaaaggtggtgtgcgaccagaagttcagacccagcatccccaaccagtggcagagctgcgaggccctgagagtgatgggcagaatcatgagagagtgctggtacgccaacggcgccgccagactgaccgccctgagaatcaagaagaccatcagccagctgtgcgtgaaggaggactgcaaggcctag

SEQ ID NO: 71638 - DNA, 1242 bp, Artificial Sequence
  Description of Artificial Sequence: Synthetic coding sequence
atgaccagagccctgtgcagcgccctgagacaggccctgctgctgctggccgccgccgccgagctgagccccggcctgaagtgcgtgtgcctgctgtgcgacagcagcaacttcacctgccagaccgagggcgcctgctgggccagcgtgatgctgaccaacggcaaggagcaggtgatcaagagctgcgtgagcctgcccgagctgaacgcccaggtgttctgccacagcagcaacaacgtgaccaagaccgagtgctgcttcaccgacttctgcaacaacatcaccctgcacctgcccaccggcctgcccctgctggtgcagagaaccatcgccagaaccatcgtgctgcaggagatcgtgggcaagggcagattcggcgaggtgtggcacggcagatggtgcggcgaggacgtggccgtgaagatcttcagcagcagagacgagagaagctggttcagagaggccgagatctaccagaccgtgatgctgagacacgagaacatcctgggcttcatcgccgccgacaacaaggacaacggcacctggacccagctgtggctggtgagcgagtaccacgagcagggcagcctgtacgactacctgaacagaaacatcgtgaccgtggccggcatgatcaagctggccctgagcatcgccagcggcctggcccacctgcacatggagatcgtgggcacccagggcaagcccgccatcgcccacagagacatcaagagcaagaacatcctggtgaagaagtgcgagacctgcgccatcgccgacctgggcctggccgtgaagcacgacagcatcctgaacaccatcgacatcccccagaaccccaaggtgggcaccaagagatacatggcccccgagatgctggacgacaccatgaacgtgaacatcttcgagagcttcaagagagccgacatctacagcgtgggcctggtgtactgggagatcgccagaagatgcagcgtgggcggcatcgtggaggagtaccagctgccctactacgacatggtgcccagcgaccccagcatcgaggagatgagaaaggtggtgtgcgaccagaagttcagacccagcatccccaaccagtggcagagctgcgaggccctgagagtgatgggcagaatcatgagagagtgctggtacgccaacggcgccgccagactgaccgccctgagaatcaagaagaccatcagccagctgtgcgtgaaggaggactgcaaggcctag

SEQ ID NO: 71639 - DNA, 1011 bp, Artificial Sequence
  Description of Artificial Sequence: Synthetic coding sequence
atgaccagagccctgtgcagcgccctgagacaggccctgctgctgctggccgccgccgccgagctgagccccggcctgaagtgcgtgtgcctgctgtgcgacagcagcaacttcacctgccagaccgagggcgcctgctgggccagcgtgatgctgaccaacggcaaggagcaggtgatcaagagctgcgtgagcctgcccgagctgaacgcccaggtgttctgccacagcagcaacaacgtgaccaagaccgagtgctgcttcaccgacttctgcaacaacatcaccctgcacctgcccaccgacaacggcacctggacccagctgtggctggtgagcgagtaccacgagcagggcagcctgtacgactacctgaacagaaacatcgtgaccgtggccggcatgatcaagctggccctgagcatcgccagcggcctggcccacctgcacatggagatcgtgggcacccagggcaagcccgccatcgcccacagagacatcaagagcaagaacatcctggtgaagaagtgcgagacctgcgccatcgccgacctgggcctggccgtgaagcacgacagcatcctgaacaccatcgacatcccccagaaccccaaggtgggcaccaagagatacatggcccccgagatgctggacgacaccatgaacgtgaacatcttcgagagcttcaagagagccgacatctacagcgtgggcctggtgtactgggagatcgccagaagatgcagcgtgggcggcatcgtggaggagtaccagctgccctactacgacatggtgcccagcgaccccagcatcgaggagatgagaaaggtggtgtgcgaccagaagttcagacccagcatccccaaccagtggcagagctgcgaggccctgagagtgatgggcagaatcatgagagagtgctggtacgccaacggcgccgccagactgaccgccctgagaatcaagaagaccatcagccagctgtgcgtgaaggaggactgcaaggcctag

SEQ ID NO: 71640 - DNA, 1542 bp, Artificial Sequence
  Description of Artificial Sequence: Synthetic coding sequence
atgggcgccgccgccaagctggccttcgccgtgttcctgatcagctgcagcagcggcgccatcctgggcagaagcgagacccaggagtgcctgttcttcaacgccaactgggagaaggacagaaccaaccagaccggcgtggagccctgctacggcgacaaggacaagagaagacactgcttcgccacctggaagaacatcagcggcagcatcgagatcgtgaagcagggctgctggctggacgacatcaactgctacgacagaaccgactgcgtggagaagaaggacagccccgaggtgtacttctgctgctgcgagggcaacatgtgcaacgagaagttcagctacttccccgagatggaggtgacccagcccaccagcaaccccgtgacccccaagcccccctactacaacatcctgctgtacagcctggtgcccctgatgctgatcgccggcatcgtgatctgcgccttctgggtgtacagacaccacaagatggcctacccccccgtgctggtgcccacccaggaccccggcccccccccccccagccccctgctgggcctgaagcccctgcagctgctggaggtgaaggccagaggcagattcggctgcgtgtggaaggcccagctgctgaacgagtacgtggccgtgaagatcttccccatccaggacaagcagagctggcagaacgagtacgaggtgtacagcctgcccggcatgaagcacgagaacatcctgcagttcatcggcgccgagaagagaggcaccagcgtggacgtggacctgtggctgatcaccgccttccacgagaagggcagcctgagcgacttcctgaaggccaacgtggtgagctggaacgagctgtgccacatcgccgagaccatggccagaggcctggcctacctgcacgaggacatccccggcctgaaggacggccacaagcccgccatcagccacagagacatcaagagcaagaacgtgctgctgaagaacaacctgaccgcctgcatcgccgacttcggcctggccctgaagttcgaggccggcaagagcgccggcgacacccacggccaggtgggcaccagaagatacatggcccccgaggtgctggagggcgccatcaacttccagagagacgccttcctgagaatcgacatgtacgccatgggcctggtgctgtgggagctggccagcagatgcaccgccgccgacggccccgtggacgagtacatgctgcccttcgaggaggagatcggccagcaccccagcctggaggacatgcaggaggtggtggtgcacaagaagaagagacccgtgctgagagactactggcagaagcacgccggcatggccatgctgtgcgagaccatcgaggagtgctgggaccacgacgccgaggccagactgagcgccggctgcgtgggcgagagaatcacccagatgcagagactgaccaacatcatcaccaccgaggacatcgtgaccgtggtgaccatggtgaccaacgtggacttcccccccaaggagagcagcctgtag

SEQ ID NO: 71641 - DNA, 1542 bp, Artificial Sequence; identical to SEQ ID NO: 71640
  Description of Artificial Sequence: Synthetic coding sequence

SEQ ID NO: 71642 - DNA, 1218 bp, Artificial Sequence
  Description of Artificial Sequence: Synthetic coding sequence
atgtgcaacgagaagttcagctacttccccgagatggaggtgacccagcccaccagcaaccccgtgacccccaagcccccctactacaacatcctgctgtacagcctggtgcccctgatgctgatcgccggcatcgtgatctgcgccttctgggtgtacagacaccacaagatggcctacccccccgtgctggtgcccacccaggaccccggcccccccccccccagccccctgctgggcctgaagcccctgcagctgctggaggtgaaggccagaggcagattcggctgcgtgtggaaggcccagctgctgaacgagtacgtggccgtgaagatcttccccatccaggacaagcagagctggcagaacgagtacgaggtgtacagcctgcccggcatgaagcacgagaacatcctgcagttcatcggcgccgagaagagaggcaccagcgtggacgtggacctgtggctgatcaccgccttccacgagaagggcagcctgagcgacttcctgaaggccaacgtggtgagctggaacgagctgtgccacatcgccgagaccatggccagaggcctggcctacctgcacgaggacatccccggcctgaaggacggccacaagcccgccatcagccacagagacatcaagagcaagaacgtgctgctgaagaacaacctgaccgcctgcatcgccgacttcggcctggccctgaagttcgaggccggcaagagcgccggcgacacccacggccaggtgggcaccagaagatacatggcccccgaggtgctggagggcgccatcaacttccagagagacgccttcctgagaatcgacatgtacgccatgggcctggtgctgtgggagctggccagcagatgcaccgccgccgacggccccgtggacgagtacatgctgcccttcgaggaggagatcggccagcaccccagcctggaggacatgcaggaggtggtggtgcacaagaagaagagacccgtgctgagagactactggcagaagcacgccggcatggccatgctgtgcgagaccatcgaggagtgctgggaccacgacgccgaggccagactgagcgccggctgcgtgggcgagagaatcacccagatgcagagactgaccaacatcatcaccaccgaggacatcgtgaccgtggtgaccatggtgaccaacgtggacttcccccccaaggagagcagcctgtag

SEQ ID NO: 71643 - DNA, 1539 bp, Artificial Sequence
  Description of Artificial Sequence: Synthetic coding sequence
atgaccgccccctgggtggccctggccctgctgtggggcagcctgtgcgccggcagcggcagaggcgaggccgagaccagagagtgcatctactacaacgccaactgggagctggagagaaccaaccagagcggcctggagagatgcgagggcgagcaggacaagagactgcactgctacgccagctggagaaacagcagcggcaccatcgagctggtgaagaagggctgctggctggacgacttcaactgctacgacagacaggagtgcgtggccaccgaggagaacccccaggtgtacttctgctgctgcgagggcaacttctgcaacgagagattcacccacctgcccgaggccggcggccccgaggtgacctacgagcccccccccaccgcccccaccctgctgaccgtgctggcctacagcctgctgcccatcggcggcctgagcctgatcgtgctgctggccttctggatgtacagacacagaaagcccccctacggccacgtggacatccacgaggaccccggcccccccccccccagccccctggtgggcctgaagcccctgcagctgctggagatcaaggccagaggcagattcggctgcgtgtggaaggcccagctgatgaacgacttcgtggccgtgaagatcttccccctgcaggacaagcagagctggcagagcgagagagagatcttcagcacccccggcatgaagcacgagaacctgctgcagttcatcgccgccgagaagagaggcagcaacctggaggtggagctgtggctgatcaccgccttccacgacaagggcagcctgaccgactacctgaagggcaacatcatcacctggaacgagctgtgccacgtggccgagaccatgagcagaggcctgagctacctgcacgaggacgtgccctggtgcagaggcgagggccacaagcccagcatcgcccacagagacttcaagagcaagaacgtgctgctgaagagcgacctgaccgccgtgctggccgacttcggcctggccgtgagattcgagcccggcaagccccccggcgacacccacggccaggtgggcaccagaagatacatggcccccgaggtgctggagggcgccatcaacttccagagagacgccttcctgagaatcgacatgtacgccatgggcctggtgctgtgggagctggtgagcagatgcaaggccgccgacggccccgtggacgagtacatgctgcccttcgaggaggagatcggccagcaccccagcctggaggagctgcaggaggtggtggtgcacaagaagatgagacccaccatcaaggaccactggctgaagcaccccggcctggcccagctgtgcgtgaccatcgaggagtgctgggaccacgacgccgaggccagactgagcgccggctgcgtggaggagagagtgagcctgatcagaagaagcgtgaacggcaccaccagcgactgcctggtgagcctggtgaccagcgtgaccaacgtggacctgccccccaaggagagcagcatctag

SEQ ID NO: 71644 - DNA, 1191 bp, Artificial Sequence
  Description of Artificial Sequence: Synthetic coding sequence
atggagctggaccacagaaccagcggcggcctgcacgcctaccccggccccagaggcggccaggtggccaagcccaacgtgatcctgcagatcggcaagtgcagagccgagatgctggagcacgtgagaagaacccacagacacctgctggccgaggtgagcaagcaggtggagagagagctgaagggcctgcacagaagcgtgggcaagctggagagcaacctggacggctacgtgcccaccagcgacagccagagatggaagaagagcatcaaggcctgcctgtgcagatgccaggagaccatcgccaacctggagagatgggtgaagagagagatgcacgtgtggagagaggtgttctacagactggagagatgggccgacagactggagagcaccggcggcaagtaccccgtgggcagcgagagcgccagacacaccgtgagcgtgggcgtgggcggccccgagagctactgccacgaggccgacggctacgactacaccgtgagcccctacgccatcacccccccccccgccgccggcgagctgcccggccaggagcccgccgaggcccagcagtaccagccctgggtgcccggcgaggacggccagcccagccccggcgtggacacccagatcttcgaggaccccagagagttcctgagccacctggaggagtacctgagacaggtgggcggcagcgaggagtactggctgagccagatccagaaccacatgaacggccccgccaagaagtggtgggagttcaagcagggcagcgtgaagaactgggtggagttcaagaaggagttcctgcagtacagcgagggcaccctgagcagagaggccatccagagagagctggacctgccccagaagcagggcgagcccctggaccagttcctgtggagaaagagagacctgtaccagaccctgtacgtggacgccgacgaggaggagatcatccagtacgtggtgggcaccctgcagcccaagctgaagagattcctgagacaccccctgcccaagaccctggagcagctgatccagagaggcatggaggtgcaggacgacctggagcaggccgccgagcccgccggcccccacctgcccgtggaggacgaggccgagaccctgacccccgcccccaacagcgagagcgtggccagcgacagaacccagcccgagtag

SEQ ID NO: 71645 - DNA, 1587 bp, Artificial Sequence
  Description of Artificial Sequence: Synthetic coding sequence
atggccgccgtgctgaacgccgagagactggaggtgagcgtggacggcctgaccctgagccccgaccccgaggagagacccggcgccgagggcgcccccctgctgcccccccccctgcccccccccagcccccccggcagcggcagaggccccggcgccagcggcgagcagcccgagcccggcgaggccgccgccggcggcgccgccgaggaggccagaagactggagcagagatggggcttcggcctggaggagctgtacggcctggccctgagattcttcaaggagaaggacggcaaggccttccaccccacctacgaggagaagctgaagctggtggccctgcacaagcaggtgctgatgggcccctacaaccccgacacctgccccgaggtgggcttcttcgacgtgctgggcaacgacagaagaagagagtgggccgccctgggcaacatgagcaaggaggacgccatggtggagttcgtgaagctgctgaacagatgctgccacctgttcagcacctacgtggccagccacaagatcgagaaggaggagcaggagaagaagagaaaggaggaggaggagagaagaagaagagaggaggaggagagagagagactgcagaaggaggaggagaagagaagaagagaggaggaggagagactgagaagagaggaggaggagagaagaagaatcgaggaggagagactgagactggagcagcagaagcagcagatcatggccgccctgaacagccagaccgccgtgcagttccagcagtacgccgcccagcagtaccccggcaactacgagcagcagcagatcctgatcagacagctgcaggagcagcactaccagcagtacatgcagcagctgtaccaggtgcagctggcccagcagcaggccgccctgcagaagcagcaggaggtggtggtggccggcagcagcctgcccaccagcagcaaggtgaacgccaccgtgcccagcaacatgatgagcgtgaacggccaggccaagacccacaccgacagcagcgagaaggagctggagcccgaggccgccgaggaggccctggagaacggccccaaggagagcctgcccgtgatcgccgcccccagcatgtggaccagaccccagatcaaggacttcaaggagaagatccagcaggacgccgacagcgtgatcaccgtgggcagaggcgaggtggtgaccgtgagagtgcccacccacgaggagggcagctacctgttctgggagttcgccaccgacaactacgacatcggcttcggcgtgtacttcgagtggaccgacagccccaacaccgccgtgagcgtgcacgtgagcgagagcagcgacgacgacgaggaggaggaggagaacatcggctgcgaggagaaggccaagaagaacgccaacaagcccctgctggacgagatcgtgcccgtgtacagaagagactgccacgaggaggtgtacgccggcagccaccagtaccccggcagaggcgtgtacctgctgaagttcgacaacagctacagcctgtggagaagcaagagcgtgtactacagagtgtactacaccagatag

SEQ ID NO: 71646 - DNA, 2343 bp, Artificial Sequence
  Description of Artificial Sequence: Synthetic coding sequence
atgaagcccggcgccaccggcgagagcgacctggccgaggtgctgccccagcacaagttcgacagcaagagcctggaggcctacctgaaccagcacctgagcggcttcggcgccgagagagaggccaccctgaccatcgcccagtacagagccggcaagagcaaccccaccttctacctgcagaagggcttccagacctacgtgctgagaaagaagccccccggcagcctgctgcccaaggcccaccagatcgacagagagttcaaggtgcagaaggccctgttcagcatcggcttccccgtgcccaagcccatcctgtactgcagcgacaccagcgtgatcggcaccgagttctacgtgatggagcacgtgcagggcagaatcttcagagacctgaccatccccggcctgagccccgccgagagaagcgccatctacgtggccaccgtggagaccctggcccagctgagaagcctgaacatccagagcctgcagctggagggctacggcatcggcgccggctactgcaagagacaggtgagcacctggaccaagcagtaccaggccgccgcccaccaggacatccccgccatgcagcagctgagcgagtggctgatgaagaacctgcccgacaacgacaacgaggagaacctgatccacggcgacttcagactggacaacatcgtgttccaccccaaggagtgcagagtgatcgccgtgctggactgggagctgagcaccatcggccaccccctgagcgacctggcccacttcagcctgttctacttctggcccagaaccgtgcccatgatcaaccagggcagctacagcgagaacagcggcatccccagcatggaggagctgatcagcatctactgcagatgcagaggcatcaacagcatcctgcccaactggaacttcttcctggccctgagctacttcaagatggccggcatcgcccagggcgtgtacagcagatacctgctgggcaacaacagcagcgaggacagcttcctgttcgccaacatcgtgcagcccctggccgagaccggcctgcagctgagcaagagaaccttcagcaccgtgctgccccagatcgacaccaccggccagctgttcgtgcagaccagaaagggccaggaggtgctgatcaaggtgaagcacttcatgaagcagcacatcctgcccgccgagaaggaggtgaccgagttctacgtgcagaacgagaacagcgtggacaagtggggcaagcccctggtgatcgacaagctgaaggagatggccaaggtggagggcctgtggaacctgttcctgcccgccgtgagcggcctgagccacgtggactacgccctgatcgccgaggagaccggcaagtgcttcttcgcccccgacgtgttcaactgccaggcccccgacaccggcaacatggaggtgctgcacctgtacggcagcgaggagcagaagaagcagtggctggagcccctgctgcagggcaacatcaccagctgcttctgcatgaccgagcccgacgtggccagcagcgacgccaccaacatcgagtgcagcatccagagagacgaggacagctacgtgatcaacggcaagaagtggtggagcagcggcgccggcaaccccaagtgcaagatcgccatcgtgctgggcagaacccagaacaccagcctgagcagacacaagcagcacagcatgatcctggtgcccatgaacacccccggcgtgaagatcatcagacccctgagcgtgttcggctacaccgacaacttccacggcggccacttcgagatccacttcaaccaggtgagagtgcccgccaccaacctgatcctgggcgagggcagaggcttcgagatcagccagggcagactgggccccggcagaatccaccactgcatgagaaccgtgggcctggccgagagagccctgcagatcatgtgcgagagagccacccagagaatcgccttcaagaagaagctgtacgcccacgaggtggtggcccactggatcgccgagagcagaatcgccatcgagaagatcagactgctgaccctgaaggccgcccacagcatggacaccctgggcagcgccggcgccaagaaggagatcgccatgatcaaggtggccgcccccagagccgtgagcaagatcgtggactgggccatccaggtgtgcggcggcgccggcgtgagccaggactaccccctggccaacatgtacgccatcaccagagtgctgagactggccgacggccccgacgaggtgcacctgagcgccatcgccaccatggagctgagagaccaggccaagagactgaccgccaagatctag

SEQ ID NO: 71647 - DNA, 2031 bp, Artificial Sequence
  Description of Artificial Sequence: Synthetic coding sequence
atgaagcccggcgccaccggcgagagcgacctggccgaggtgctgccccagcacaagttcgacagcaagagcctggaggcctacctgaaccagcacctgagcggcttcggcgccgagagagaggccaccctgaccatcgcccagtacagagccggcaagagcaaccccaccttctacctgcagaagggcttccagacctacgtgctgagaaagaagccccccggcagcctgctgcccaaggcccaccagatcgacagagagttcaaggtgcagaaggccctgttcagcatcggcttccccgtgcccaagcccatcctgtactgcagcgacaccagcgtgatcggcaccgagttctacgtgatggagcacgtgcagggcagaatcttcagagacctgaccatccccggcctgagccccgccgagagaagcgccatctacgtggccaccgtggagaccctggcccagctgagaagcctgaacatccagagcctgcagctggagggctacggcatcggcgccggctactgcaagagacaggtgagcacctggaccaagcagtaccaggccgccgcccaccaggacatccccgccatgcagcagctgagcgagtggctgatgaagaacctgcccgacaacgacaacgaggagaacctgatccacggcgacttcagactggacaacatcgtgttccaccccaaggagtgcagagtgatcgccgtgctggactgggagctgagcaccatcggccaccccctgagcgacctggcccacttcagcctgttctacttctggcccagaaccgtgcccatgatcaaccagggcagctacagcgagaacagcggcatccccagcatggaggagctgatcagcatctactgcagatgcagaggcatcaacagcatcctgcccaactggaacttcttcctggccctgagctacttcaagatggccggcatcgcccagggcgtgtacagcagatacctgctgggcaacaacagcagcgaggacagcttcctgttcgccaacatcgtgcagcccctggccgagaccggcctgcagctgagcaagagaaccttcagcaccgtgctgccccagatcgacaccaccggccagctgttcgtgcagaccagaaagggccaggaggtgctgatcaaggtgaagcacttcatgaagcagcacatcctgcccgccgagaaggaggtgaccgagttctacgtgcagaacgagaacagcgtggacaagtggggcaagcccctggtgatcgacaagctgaaggagatggccaaggtggagggcctgtggaacctgttcctgcccgccgtgagcggcctgagccacgtggactacgccctgatcgccgaggagaccggcaagtgcttcttcgcccccgacgtgttcaactgccaggcccccgacaccggcaacatggaggtgctgcacctgtacggcagcgaggagcagaagaagcagtggctggagcccctgctgcagggcaacatcaccagctgcttctgcatgaccgagcccgacgtggccagcagcgacgccaccaacatcgagtgcagcatccagagagacgaggacagctacgtgatcaacggcaagaagtggtggagcagcggcgccggcaaccccaagtgcaagatcgccatcgtgctgggcagaacccagaacaccagcctgagcagagaggtggtggcccactggatcgccgagagcagaatcgccatcgagaagatcagactgctgaccctgaaggccgcccacagcatggacaccctgggcagcgccggcgccaagaaggagatcgccatgatcaaggtggccgcccccagagccgtgagcaagatcgtggactgggccatccaggtgtgcggcggcgccggcgtgagccaggactaccccctggccaacatgtacgccatcaccagagtgctgagactggccgacggccccgacgaggtgcacctgagcgccatcgccaccatggagctgagagaccaggccaagagactgaccgccaagatctag

SEQ ID NO: 71648 - DNA, 918 bp, Artificial Sequence
  Description of Artificial Sequence: Synthetic coding sequence
atggaggtgctgcacctgtacggcagcgaggagcagaagaagcagtggctggagcccctgctgcagggcaacatcaccagctgcttctgcatgaccgagcccgacgtggccagcagcgacgccaccaacatcgagtgcagcatccagagagacgaggacagctacgtgatcaacggcaagaagtggtggagcagcggcgccggcaaccccaagtgcaagatcgccatcgtgctgggcagaacccagaacaccagcctgagcagacacaagcagcacagcatgatcctggtgcccatgaacacccccggcgtgaagatcatcagacccctgagcgtgttcggctacaccgacaacttccacggcggccacttcgagatccacttcaaccaggtgagagtgcccgccaccaacctgatcctgggcgagggcagaggcttcgagatcagccagggcagactgggccccggcagaatccaccactgcatgagaaccgtgggcctggccgagagagccctgcagatcatgtgcgagagagccacccagagaatcgccttcaagaagaagctgtacgcccacgaggtggtggcccactggatcgccgagagcagaatcgccatcgagaagatcagactgctgaccctgaaggccgcccacagcatggacaccctgggcagcgccggcgccaagaaggagatcgccatgatcaaggtggccgcccccagagccgtgagcaagatcgtggactgggccatccaggtgtgcggcggcgccggcgtgagccaggactaccccctggccaacatgtacgccatcaccagagtgctgagactggccgacggccccgacgaggtgcacctgagcgccatcgccaccatggagctgagagaccaggccaagagactgaccgccaagatctag

SEQ ID NO: 71649 - DNA, 1248 bp, Artificial Sequence
  Description of Artificial Sequence: Synthetic coding sequence
atgctgtggagcggctgcagaagattcggcgccagactgggctgcctgcccggcggcctgagagtgctggtgcagaccggccacagaagcctgaccagctgcatcgaccccagcatgggcctgaacgaggagcagaaggagttccagaaggtggccttcgacttcgccgccagagagatggcccccaacatggccgagtgggaccagaaggagctgttccccgtggacgtgatgagaaaggccgcccagctgggcttcggcggcgtgtacatccagaccgacgtgggcggcagcggcctgagcagactggacaccagcgtgatcttcgaggccctggccaccggctgcaccagcaccaccgcctacatcagcatccacaacatgtgcgcctggatgatcgacagcttcggcaacgaggagcagagacacaagttctgcccccccctgtgcaccatggagaagttcgccagctactgcctgaccgagcccggcagcggcagcgacgccgccagcctgctgaccagcgccaagaagcagggcgaccactacatcctgaacggcagcaaggccttcatcagcggcgccggcgagagcgacatctacgtggtgatgtgcagaaccggcggccccggccccaagggcatcagctgcatcgtggtggagaagggcacccccggcctgagcttcggcaagaaggagaagaaggtgggctggaacagccagcccaccagagccgtgatcttcgaggactgcgccgtgcccgtggccaacagaatcggcagcgagggccagggcttcctgatcgccgtgagaggcctgaacggcggcagaatcaacatcgccagctgcagcctgggcgccgcccacgccagcgtgatcctgaccagagaccacctgaacgtgagaaagcagttcggcgagcccctggccagcaaccagtacctgcagttcaccctggccgacatggccaccagactggtggccgccagactgatggtgagaaacgccgccgtggccctgcaggaggagagaaaggacgccgtggccctgtgcagcatggccaagctgttcgccaccgacgagtgcttcgccatctgcaaccaggccctgcagatgcacggcggctacggctacctgaaggactacgccgtgcagcagtacgtgagagacagcagagtgcaccagatcctggagggcagcaacgaggtgatgagaatcctgatcagcagaagcctgctgcaggagtag

SEQ ID NO: 71650 - DNA, 1074 bp, Artificial Sequence
  Description of Artificial Sequence: Synthetic coding sequence
atgagaaaggccgcccagctgggcttcggcggcgtgtacatccagaccgacgtgggcggcagcggcctgagcagactggacaccagcgtgatcttcgaggccctggccaccggctgcaccagcaccaccgcctacatcagcatccacaacatgtgcgcctggatgatcgacagcttcggcaacgaggagcagagacacaagttctgcccccccctgtgcaccatggagaagttcgccagctactgcctgaccgagcccggcagcggcagcgacgccgccagcctgctgaccagcgccaagaagcagggcgaccactacatcctgaacggcagcaaggccttcatcagcggcgccggcgagagcgacatctacgtggtgatgtgcagaaccggcggccccggccccaagggcatcagctgcatcgtggtggagaagggcacccccggcctgagcttcggcaagaaggagaagaaggtgggctggaacagccagcccaccagagccgtgatcttcgaggactgcgccgtgcccgtggccaacagaatcggcagcgagggccagggcttcctgatcgccgtgagaggcctgaacggcggcagaatcaacatcgccagctgcagcctgggcgccgcccacgccagcgtgatcctgaccagagaccacctgaacgtgagaaagcagttcggcgagcccctggccagcaaccagtacctgcagttcaccctggccgacatggccaccagactggtggccgccagactgatggtgagaaacgccgccgtggccctgcaggaggagagaaaggacgccgtggccctgtgcagcatggccaagctgttcgccaccgacgagtgcttcgccatctgcaaccaggccctgcagatgcacggcggctacggctacctgaaggactacgccgtgcagcagtacgtgagagacagcagagtgcaccagatcctggaggagctgttctggcagggccccggcgtgcagagcagaagcttcgtgcccttcggcggcccccagatcgccctgctgctgcccttcagcagcggcgacctgagagagggctag

SEQ ID NO: 71651 - DNA, 819 bp, Artificial Sequence
  Description of Artificial Sequence: Synthetic coding sequence
atgggcctgaacgaggagcagaaggagttccagaaggtggccttcgacttcgccgccagagagatggcccccaacatggccgagtgggaccagaaggagctgttccccgtggacgtgatgagaaaggccgcccagctgggcttcggcggcgtgtacatccagaccgacgtgggcggcagcggcctgagcagactggacaccagcgtgatcttcgaggccctggccaccggctgcaccagcaccaccgcctacatcagcatccacaacatgtgcgcctggatgatcgacagcttcggcaacgaggagcagagacacaagttctgcccccccctgtgcaccatggagaagttcgccagctactgcctgaccgagcccggcagcggcagcgacgccgccagcctgctgaccagcgccaagaagcagggcgaccactacatcctgaacggcagcaaggccttcatcagcggcgccggcgagagcgacatctacgtggtgatgtgcagaaccggcggccccggccccaagggcatcagctgcatcgtggtggagaagggcacccccggcctgagcttcggcaagaaggagaagaaggtgggctggaacagccagcccaccagagccgtgatcttcgaggactgcgccgtgcccgtggccaacagaatcggcagcgagggccagggcttcctgatcgccgtgagaggcctgaacggcggcagaatcaacatcgccagctgcagcctgggctgccccagactgtgccacccccaccccagacccccccagtgccccgaggccgtgtggagagccagcggccagtag

SEQ ID NO: 71652 - DNA, 681 bp, Artificial Sequence
  Description of Artificial Sequence: Synthetic coding sequence
atgaagagcagaaagaacttcaagaagtggcccctgaccctgctgcccgagagatggctgcagatctggcagagcggcaccagaagcatgtgcgcctggatgatcgacagcttcggcaacgaggagcagagacacaagttctgcccccccctgtgcaccatggagaagttcgccagctactgcctgaccgagcccggcagcggcagcgacgccgccagcctgctgaccagcgccaagaagcagggcgaccactacatcctgaacggcagcaaggccttcatcagcggcgccggcgagagcgacatctacgtggtgatgtgcagaaccggcggccccggccccaagggcatcagctgcatcgtggtggagaagggcacccccggcctgagcttcggcaagaaggagaagaaggtgggctggaacagccagcccaccagagccgtgatcttcgaggactgcgccgtgcccgtggccaacagaatcggcagcgagggccagggcttcctgatcgccgtgagaggcctgaacggcggcagaatcaacatcgccagctgcagcctgggcgccgcccacgccagcgtgatcctgaccagagaccacctgaacgtgagaaagcagttcggcgagcccctggccagcaaccagaagaagcaggagaccctgaagctgtggatcacctag

SEQ ID NO: 71653 - DNA, 1866 bp, Artificial Sequence
  Description of Artificial Sequence: Synthetic coding sequence
atgagcggctgcggcctgttcctgagaaccaccgccgccgccagagcctgcagaggcctggtggtgagcaccgccaacagaagactgctgagaaccagcccccccgtgagagccttcgccaaggagctgttcctgggcaagatcaagaagaaggaggtgttccccttccccgaggtgagccaggacgagctgaacgagatcaaccagttcctgggccccgtggagaagttcttcaccgaggaggtggacagcagaaagatcgaccaggagggcaagatccccgacgagaccctggagaagctgaagagcctgggcctgttcggcctgcaggtgcccgaggagtacggcggcctgggcttcagcaacaccatgtacagcagactgggcgagatcatcagcatggacggcagcatcaccgtgaccctggccgcccaccaggccatcggcctgaagggcatcatcctggccggcaccgaggagcagaaggccaagtacctgcccaagctggccagcggcgagcacatcgccgccttctgcctgaccgagcccgccagcggcagcgacgccgccagcatcagaagcagagccaccctgagcgaggacaagaagcactacatcctgaacggcagcaaggtgtggatcaccaacggcggcctggccaacatcttcaccgtgttcgccaagaccgaggtggtggacagcgacggcagcgtgaaggacaagatcaccgccttcatcgtggagagagacttcggcggcgtgaccaacggcaagcccgaggacaagctgggcatcagaggcagcaacacctgcgaggtgcacttcgagaacaccaagatccccgtggagaacatcctgggcgaggtgggcgacggcttcaaggtggccatgaacatcctgaacagcggcagattcagcatgggcagcgtggtggccggcctgctgaagagactgatcgagatgaccgccgagtacgcctgcaccagaaagcagttcaacaagagactgagcgagttcggcctgatccaggagaagttcgccctgatggcccagaaggcctacgtgatggagagcatgacctacctgaccgccggcatgctggaccagcccggcttccccgactgcagcatcgaggccgccatggtgaaggtgttcagcagcgaggccgcctggcagtgcgtgagcgaggccctgcagatcctgggcggcctgggctacaccagagactacccctacgagagaatcctgagagacaccagaatcctgctgatcttcgagggcaccaacgagatcctgagaatgtacatcgccctgaccggcctgcagcacgccggcagaatcctgaccaccagaatccacgagctgaagcaggccaaggtgagcaccgtgatggacaccgtgggcagaagactgagagacagcctgggcagaaccgtggacctgggcctgaccggcaaccacggcgtggtgcaccccagcctggccgacagcgccaacaagttcgaggagaacacctactgcttcggcagaaccgtggagaccctgctgctgagattcggcaagaccatcatggaggagcagctggtgctgaagagagtggccaacatcctgatcaacctgtacggcatgaccgccgtgctgagcagagccagcagaagcatcagaatcggcctgagaaaccacgaccacgaggtgctgctggccaacaccttctgcgtggaggcctacctgcagaacctgttcagcctgagccagctggacaagtacgcccccgagaacctggacgagcagatcaagaaggtgagccagcagatcctggagaagagagcctacatctgcgcccaccccctggacagaacctgctag

SEQ ID NO: 71654 - DNA, 1467 bp, Artificial Sequence
  Description of Artificial Sequence: Synthetic coding sequence
atggacggcagcatcaccgtgaccctggccgcccaccaggccatcggcctgaagggcatcatcctggccggcaccgaggagcagaaggccaagtacctgcccaagctggccagcggcgagcacatcgccgccttctgcctgaccgagcccgccagcggcagcgacgccgccagcatcagaagcagagccaccctgagcgaggacaagaagcactacatcctgaacggcagcaaggtgtggatcaccaacggcggcctggccaacatcttcaccgtgttcgccaagaccgaggtggtggacagcgacggcagcgtgaaggacaagatcaccgccttcatcgtggagagagacttcggcggcgtgaccaacggcaagcccgaggacaagctgggcatcagaggcagcaacacctgcgaggtgcacttcgagaacaccaagatccccgtggagaacatcctgggcgaggtgggcgacggcttcaaggtggccatgaacatcctgaacagcggcagattcagcatgggcagcgtggtggccggcctgctgaagagactgatcgagatgaccgccgagtacgcctgcaccagaaagcagttcaacaagagactgagcgagttcggcctgatccaggagaagttcgccctgatggcccagaaggcctacgtgatggagagcatgacctacctgaccgccggcatgctggaccagcccggcttccccgactgcagcatcgaggccgccatggtgaaggtgttcagcagcgaggccgcctggcagtgcgtgagcgaggccctgcagatcctgggcggcctgggctacaccagagactacccctacgagagaatcctgagagacaccagaatcctgctgatcttcgagggcaccaacgagatcctgagaatgtacatcgccctgaccggcctgcagcacgccggcagaatcctgaccaccagaatccacgagctgaagcaggccaaggtgagcaccgtgatggacaccgtgggcagaagactgagagacagcctgggcagaaccgtggacctgggcctgaccggcaaccacggcgtggtgcaccccagcctggccgacagcgccaacaagttcgaggagaacacctactgcttcggcagaaccgtggagaccctgctgctgagattcggcaagaccatcatggaggagcagctggtgctgaagagagtggccaacatcctgatcaacctgtacggcatgaccgccgtgctgagcagagccagcagaagcatcagaatcggcctgagaaaccacgaccacgaggtgctgctggccaacaccttctgcgtggaggcctacctgcagaacctgttcagcctgagccagctggacaagtacgcccccgagaacctggacgagcagatcaagaaggtgagccagcagatcctggagaagagagcctacatctgcgcccaccccctggacagaacctgctag

SEQ ID NO: 71655 - DNA, 507 bp, Artificial Sequence
  Description of Artificial Sequence: Synthetic coding sequence
atggaggagcagctggtgctgaagggcggccagcacccccaccagcccgtgtggcacgacggcagagccgtggccggccagcccctgcacccccactgggccccccagcccagacccagaggcagcctgggccagcacctgctgagaggcagcctgctggccgagagcctgcagcccctgagcgccggccaggtgtgcagcagaaagcccagaagcagactgagaaagtgccccagcagaagcctgagaagcgagcccatcagcgtgcccaccctgtggaccggccacgccgagagaggccagtgccccctgctgccccccgcccccacccacggccccctgctggacgactgctacagcttcttcagaagactgggcctgagccaggtgaagcccttcgtgcccagactgcacctgaagggctgcagactggcctgggagagcctgttccaggtgctgacctgcagacagtgcagcctgaccggccccagccagctgctgaactag

SEQ ID NO: 71656 - DNA, 1239 bp, Artificial Sequence
  Description of Artificial Sequence: Synthetic coding sequence
atggccgccgccctgctggccagagccagcggccccgccagaagagccctgtgccccagagcctggagacagctgcacaccatctaccagagcgtggagctgcccgagacccaccagatgctgctgcagacctgcagagacttcgccgagaaggagctgttccccatcgccgcccaggtggacaaggagcacctgttccccgccgcccaggtgaagaagatgggcggcctgggcctgctggccatggacgtgcccgaggagctgggcggcgccggcctggactacctggcctacgccatcgccatggaggagatcagcagaggctgcgccagcaccggcgtgatcatgagcgtgaacaacagcctgtacctgggccccatcctgaagttcggcagcaaggagcagaagcaggcctgggtgacccccttcaccagcggcgacaagatcggctgcttcgccctgagcgagcccggcaacggcagcgacgccggcgccgccagcaccaccgccagagccgagggcgacagctgggtgctgaacggcaccaaggcctggatcaccaacgcctgggaggccagcgccgccgtggtgttcgccagcaccgacagagccctgcagaacaagggcatcagcgccttcctggtgcccatgcccacccccggcctgaccctgggcaagaaggaggacaagctgggcatcagaggcagcagcaccgccaacctgatcttcgaggactgcagaatccccaaggacagcatcctgggcgagcccggcatgggcttcaagatcgccatgcagaccctggacatgggcagaatcggcatcgccagccaggccctgggcatcgcccagaccgccctggactgcgccgtgaactacgccgagaacagaatggccttcggcgcccccctgaccaagctgcaggtgatccagttcaagctggccgacatggccctggccctggagagcgccagactgctgacctggagagccgccatgctgaaggacaacaagaagcccttcatcaaggaggccgccatggccaagctggccgccagcgaggccgccaccgccatcagccaccaggccatccagatcctgggcggcatgggctacgtgaccgagatgcccgccgagagacactacagagacgccagaatcaccgagatctacgagggcaccagcgagatccagagactggtgatcgccggccacctgctgagaagctacagaagctag

SEQ ID NO: 71657 - DNA, 1365 bp, Artificial Sequence
  Description of Artificial Sequence: Synthetic coding sequence
atggccgccggcttcggcagatgctgcagagtgctgagaagcatcagcagattccactggagaagccagcacaccaaggccaacagacagagagagcccggcctgggcttcagcttcgagttcaccgagcagcagaaggagttccaggccaccgccagaaagttcgccagagaggagatcatccccgtggccgccgagtacgacaagaccggcgagtaccccgtgcccctgatcagaagagcctgggagctgggcctgatgaacacccacatccccgagaactgcgactacagcgtgtgccccctgctggaggcctgcaccctgtacctggacgccttcttcctgctgctgaccggcagcaacctgaacctgcacctgaacctgggcggcctgggcctgggcaccttcgacgcctgcctgatcagcgaggagctggcctacggctgcaccggcgtgcagaccgccatcgagggcaacagcctgggccagatgcccatcatcatcgccggcaacgaccagcagaagaagaagtacctgggcagaatgaccgaggagcccctgatgtgcgcctactgcgtgaccgagcccggcgccggcagcgacgtggccggcatcaagaccaaggccgagaagaagggcgacgagtacatcatcaacggccagaagatgtggatcaccaacggcggcaaggccaactggtacttcctgctggccagaagcgaccccgaccccaaggcccccgccaacaaggccttcaccggcttcatcgtggaggccgacacccccggcatccagatcggcagaaaggagctgaacatgggccagagatgcagcgacaccagaggcatcgtgttcgaggacgtgaaggtgcccaaggagaacgtgctgatcggcgacggcgccggcttcaaggtggccatgggcgccttcgacaagaccagacccgtggtggccgccggcgccgtgggcctggcccagagagccctggacgaggccaccaagtacgccctggagagaaagaccttcggcaagctgctggtggagcaccaggccatcagcttcatgctggccgagatggccatgaaggtggagctggccagaatgagctaccagagagccgcctgggaggtggacagcggcagaagaaacacctactacgccagcatcgccaaggccttcgccggcgacatcgccaaccagctggccaccgacgccgtgcagatcctgggcggcaacggcttcaacaccgagtaccccgtggagaagctgatgagagacgccaagatctaccagatctacgagggcaccagccagatccagagactgatcgtggccagagagcacatcgacaagtacaagaactag

SEQ ID NO: 71658 - DNA, 1266 bp, Artificial Sequence
  Description of Artificial Sequence: Synthetic coding sequence
atggccgccggcttcggcagatgctgcagagtgctgagaagcatcagcagattccactggagaagccagcacaccaaggccaacagacagagagagcccggcctgggcttcagcttcgagttcaccgagcagcagaaggagttccaggccaccgccagaaagttcgccagagaggagatcatccccgtggccgccgagtacgacaagaccggcgagtaccccgtgcccctgatcagaagagcctgggagctgggcctgatgaacacccacatccccgagaactgcggcggcctgggcctgggcaccttcgacgcctgcctgatcagcgaggagctggcctacggctgcaccggcgtgcagaccgccatcgagggcaacagcctgggccagatgcccatcatcatcgccggcaacgaccagcagaagaagaagtacctgggcagaatgaccgaggagcccctgatgtgcgcctactgcgtgaccgagcccggcgccggcagcgacgtggccggcatcaagaccaaggccgagaagaagggcgacgagtacatcatcaacggccagaagatgtggatcaccaacggcggcaaggccaactggtacttcctgctggccagaagcgaccccgaccccaaggcccccgccaacaaggccttcaccggcttcatcgtggaggccgacacccccggcatccagatcggcagaaaggagctgaacatgggccagagatgcagcgacaccagaggcatcgtgttcgaggacgtgaaggtgcccaaggagaacgtgctgatcggcgacggcgccggcttcaaggtggccatgggcgccttcgacaagaccagacccgtggtggccgccggcgccgtgggcctggcccagagagccctggacgaggccaccaagtacgccctggagagaaagaccttcggcaagctgctggtggagcaccaggccatcagcttcatgctggccgagatggccatgaaggtggagctggccagaatgagctaccagagagccgcctgggaggtggacagcggcagaagaaacacctactacgccagcatcgccaaggccttcgccggcgacatcgccaaccagctggccaccgacgccgtgcagatcctgggcggcaacggcttcaacaccgagtaccccgtggagaagctgatgagagacgccaagatctaccagatctacgagggcaccagccagatccagagactgatcgtggccagagagcacatcgacaagtacaagaactag

SEQ ID NO: 71659 - DNA, 1278 bp, Artificial Sequence
  Description of Artificial Sequence: Synthetic coding sequence
atggccgccggcttcggcagatgctgcagatgcagcctgcaggtgctgagaagcatcagcagattccactggagaagccagcacaccaaggccaacagacagagagagcccggcctgggcttcagcttcgagttcaccgagcagcagaaggagttccaggccaccgccagaaagttcgccagagaggagatcatccccgtggccgccgagtacgacaagaccggcgagtaccccgtgcccctgatcagaagagcctgggagctgggcctgatgaacacccacatccccgagaactgcggcggcctgggcctgggcaccttcgacgcctgcctgatcagcgaggagctggcctacggctgcaccggcgtgcagaccgccatcgagggcaacagcctgggccagatgcccatcatcatcgccggcaacgaccagcagaagaagaagtacctgggcagaatgaccgaggagcccctgatgtgcgcctactgcgtgaccgagcccggcgccggcagcgacgtggccggcatcaagaccaaggccgagaagaagggcgacgagtacatcatcaacggccagaagatgtggatcaccaacggcggcaaggccaactggtacttcctgctggccagaagcgaccccgaccccaaggcccccgccaacaaggccttcaccggcttcatcgtggaggccgacacccccggcatccagatcggcagaaaggagctgaacatgggccagagatgcagcgacaccagaggcatcgtgttcgaggacgtgaaggtgcccaaggagaacgtgctgatcggcgacggcgccggcttcaaggtggccatgggcgccttcgacaagaccagacccgtggtggccgccggcgccgtgggcctggcccagagagccctggacgaggccaccaagtacgccctggagagaaagaccttcggcaagctgctggtggagcaccaggccatcagcttcatgctggccgagatggccatgaaggtggagctggccagaatgagctaccagagagccgcctgggaggtggacagcggcagaagaaacacctactacgccagcatcgccaaggccttcgccggcgacatcgccaaccagctggccaccgacgccgtgcagatcctgggcggcaacggcttcaacaccgagtaccccgtggagaagctgatgagagacgccaagatctaccagatctacgagggcaccagccagatccagagactgatcgtggccagagagcacatcgacaagtacaagaactag

SEQ ID NO: 71660 - DNA, 1158 bp, Artificial Sequence
  Description of Artificial Sequence: Synthetic coding sequence
atgctgcaggagttcaccgagcagcagaaggagttccaggccaccgccagaaagttcgccagagaggagatcatccccgtggccgccgagtacgacaagaccggcgagtaccccgtgcccctgatcagaagagcctgggagctgggcctgatgaacacccacatccccgagaactgcggcggcctgggcctgggcaccttcgacgcctgcctgatcagcgaggagctggcctacggctgcaccggcgtgcagaccgccatcgagggcaacagcctgggccagatgcccatcatcatcgccggcaacgaccagcagaagaagaagtacctgggcagaatgaccgaggagcccctgatgtgcgcctactgcgtgaccgagcccggcgccggcagcgacgtggccggcatcaagaccaaggccgagaagaagggcgacgagtacatcatcaacggccagaagatgtggatcaccaacggcggcaaggccaactggtacttcctgctggccagaagcgaccccgaccccaaggcccccgccaacaaggccttcaccggcttcatcgtggaggccgacacccccggcatccagatcggcagaaaggagctgaacatgggccagagatgcagcgacaccagaggcatcgtgttcgaggacgtgaaggtgcccaaggagaacgtgctgatcggcgacggcgccggcttcaaggtggccatgggcgccttcgacaagaccagacccgtggtggccgccggcgccgtgggcctggcccagagagccctggacgaggccaccaagtacgccctggagagaaagaccttcggcaagctgctggtggagcaccaggccatcagcttcatgctggccgagatggccatgaaggtggagctggccagaatgagctaccagagagccgcctgggaggtggacagcggcagaagaaacacctactacgccagcatcgccaaggccttcgccggcgacatcgccaaccagctggccaccgacgccgtgcagatcctgggcggcaacggcttcaacaccgagtaccccgtggagaagctgatgagagacgccaagatctaccagatctacgagggcaccagccagatccagagactgatcgtggccagagagcacatcgacaagtacaagaactag

SEQ ID NO: 71661 - DNA, 699 bp, Artificial Sequence
  Description of Artificial Sequence: Synthetic coding sequence
atgtggatcaccaacggcggcaaggccaactggtacttcctgctggccagaagcgaccccgaccccaaggcccccgccaacaaggccttcaccggcttcatcgtggaggccgacacccccggcatccagatcggcagaaaggagctgaacatgggccagagatgcagcgacaccagaggcatcgtgttcgaggacgtgaaggtgcccaaggagaacgtgctgatcggcgacggcgccggcttcaaggtggccatgggcgccttcgacaagaccagacccgtggtggccgccggcgccgtgggcctggcccagagagccctggacgaggccaccaagtacgccctggagagaaagaccttcggcaagctgctggtggagcaccaggccatcagcttcatgctggccgagatggccatgaaggtggagctggccagaatgagctaccagagagccgcctgggaggtggacagcggcagaagaaacacctactacgccagcatcgccaaggccttcgccggcgacatcgccaaccagctggccaccgacgccgtgcagatcctgggcggcaacggcttcaacaccgagtaccccgtggagaagctgatgagagacgccaagatctaccagatctacgagggcaccagccagatccagagactgatcgtggccagagagcacatcgacaagtacaagaactag

SEQ ID NO: 71662 - DNA, 1446 bp, Artificial Sequence
  Description of Artificial Sequence: Synthetic coding sequence
atggacggcgccgtgatggagggccccctgttcctgcagagccagagattcggcaccaagagatggagaaagacctgggccgtgctgtaccccgccagcccccacggcgtggccagactggagttcttcgaccacaagggcagcagcagcggcggcggcagaggcagcagcagaagactggactgcaaggtgatcagactggccgagtgcgtgagcgtggcccccgtgaccgtggagaccccccccgagcccggcgccaccgccttcagactggacaccgcccagagaagccacctgctggccgccgacgcccccagcagcgccgcctgggtgcagaccctgtgcagaaacgccttccccaagggcagctggaccctggcccccaccgacaacccccccaagctgagcgccctggagatgctggagaacagcctgtacagccccacctgggagggcagccagttctgggtgaccgtgcagagaaccgaggccgccgagagatgcggcctgcacggcagctacgtgctgagagtggaggccgagagactgaccctgctgaccgtgggcgcccagagccagatcctggagcccctgctgagctggccctacaccctgctgagaagatacggcagagacaaggtgatgttcagcttcgaggccggcagaagatgccccagcggccccggcaccttcaccttccagaccgcccagggcaacgacatcttccaggccgtggagaccgccatccacagacagaaggcccagggcaaggccggccagggccacgacgtgctgagagccgacagccacgagggcgaggtggccgagggcaagctgcccagcccccccggcccccaggagctgctggacagcccccccgccctgtacgccgagcccctggacagcctgagaatcgccccctgccccagccaggacagcctgtacagcgaccccctggacagcaccagcgcccaggccggcgagggcgtgcagagaaagaagcccctgtactgggacctgtacgagcacgcccagcagcagctgctgaaggccaagctgaccgaccccaaggaggaccccatctacgacgagcccgagggcctggcccccgtgcccccccagggcctgtacgacctgcccagagagcccaaggacgcctggtggtgccaggccagagtgaaggaggagggctacgagctgccctacaaccccgccaccgacgactacgccgtgcccccccccagaagcaccaagcccctgctggcccccaagccccagggccccgccttccccgagcccggcaccgccaccggcagcggcatcaagagccacaacagcgccctgtacagccaggtgcagaagagcggcgccagcggcagctgggactgcggcctgagcagagtgggcaccgacaagaccggcgtgaagagcgagggcagcacctag

SEQ ID NO: 71663 - DNA, 1299 bp, Artificial Sequence
  Description of Artificial Sequence: Synthetic coding sequence
atggagggcctggccgtgagactgctgagaggcagcagactgctgagaagaaacttcctgacctgcctgagcagctggaagatccccccccacgtgagcaagagcagccagagcgaggccctgctgaacatcaccaacaacggcatccacttcgcccccctgcagaccttcaccgacgaggagatgatgatcaagagcagcgtgaagaagttcgcccaggagcagatcgcccccctggtgagcaccatggacgagaacagcaagatggagaagagcgtgatccagggcctgttccagcagggcctgatgggcatcgaggtggaccccgagtacggcggcaccggcgccagcttcctgagcaccgtgctggtgatcgaggagctggccaaggtggacgccagcgtggccgtgttctgcgagatccagaacaccctgatcaacaccctgatcagaaagcacggcaccgaggagcagaaggccacctacctgccccagctgaccaccgagaaggtgggcagcttctgcctgagcgaggccggcgccggcagcgacagcttcgccctgaagaccagagccgacaaggagggcgactactacgtgctgaacggcagcaagatgtggatcagcagcgccgagcacgccggcctgttcctggtgatggccaacgtggaccccaccatcggctacaagggcatcaccagcttcctggtggacagagacacccccggcctgcacatcggcaagcccgagaacaagctgggcctgagagccagcagcacctgccccctgaccttcgagaacgtgaaggtgcccgaggccaacatcctgggccagatcggccacggctacaagtacgccatcggcagcctgaacgagggcagaatcggcatcgccgcccagatgctgggcctggcccagggctgcttcgactacaccatcccctacatcaaggagagaatccagttcggcaagagactgttcgacttccagggcctgcagcaccaggtggcccacgtggccacccagctggaggccgccagactgctgacctacaacgccgccagactgctggaggccggcaagcccttcatcaaggaggccagcatggccaagtactacgccagcgagatcgccggccagaccaccagcaagtgcatcgagtggatgggcggcgtgggctacaccaaggactaccccgtggagaagtacttcagagacgccaagatcggcaccatctacgagggcgccagcaacatccagctgaacaccatcgccaagcacatcgacgccgagtactag

SEQ ID NO: 71664 - DNA, 993 bp, Artificial Sequence
  Description of Artificial Sequence: Synthetic coding sequence
atgggcatcgaggtggaccccgagtacggcggcaccggcgccagcttcctgagcaccgtgctggtgatcgaggagctggccaaggtggacgccagcgtggccgtgttctgcgagatccagaacaccctgatcaacaccctgatcagaaagcacggcaccgaggagcagaaggccacctacctgccccagctgaccaccgagaaggtgggcagcttctgcctgagcgaggccggcgccggcagcgacagcttcgccctgaagaccagagccgacaaggagggcgactactacgtgctgaacggcagcaagatgtggatcagcagcgccgagcacgccggcctgttcctggtgatggccaacgtggaccccaccatcggctacaagggcatcaccagcttcctggtggacagagacacccccggcctgcacatcggcaagcccgagaacaagctgggcctgagagccagcagcacctgccccctgaccttcgagaacgtgaaggtgcccgaggccaacatcctgggccagatcggccacggctacaagtacgccatcggcagcctgaacgagggcagaatcggcatcgccgcccagatgctgggcctggcccagggctgcttcgactacaccatcccctacatcaaggagagaatccagttcggcaagagactgttcgacttccagggcctgcagcaccaggtggcccacgtggccacccagctggaggccgccagactgctgacctacaacgccgccagactgctggaggccggcaagcccttcatcaaggaggccagcatggccaagtactacgccagcgagatcgccggccagaccaccagcaagtgcatcgagtggatgggcggcgtgggctacaccaaggactaccccgtggagaagtacttcagagacgccaagatcggcaccatctacgagggcgccagcaacatccagctgaacaccatcgccaagcacatcgacgccgagtactag

SEQ ID NO: 71665 - DNA, 1968 bp, Artificial Sequence
  Description of Artificial Sequence: Synthetic coding sequence
atgcaggccgccagaatggccgccagcctgggcagacagctgctgagactgggcggcggcagcagcagactgaccgccctgctgggccagcccagacccggccccgccagaagaccctacgccggcggcgccgcccagctggccctggacaagagcgacagccaccccagcgacgccctgaccagaaagaagcccgccaaggccgagagcaagagcttcgccgtgggcatgttcaagggccagctgaccaccgaccaggtgttcccctaccccagcgtgctgaacgaggagcagacccagttcctgaaggagctggtggagcccgtgagcagattcttcgaggaggtgaacgaccccgccaagaacgacgccctggagatggtggaggagaccacctggcagggcctgaaggagctgggcgccttcggcctgcaggtgcccagcgagctgggcggcgtgggcctgtgcaacacccagtacgccagactggtggagatcgtgggcatgcacgacctgggcgtgggcatcaccctgggcgcccaccagagcatcggcttcaagggcatcctgctgttcggcaccaaggcccagaaggagaagtacctgcccaagctggccagcggcgagaccgtggccgccttctgcctgaccgagcccagcagcggcagcgacgccgccagcatcagaaccagcgccgtgcccagcccctgcggcaagtactacaccctgaacggcagcaagctgtggatcagcaacggcggcctggccgacatcttcaccgtgttcgccaagacccccgtgaccgaccccgccaccggcgccgtgaaggagaagatcaccgccttcgtggtggagagaggcttcggcggcatcacccacggcccccccgagaagaagatgggcatcaaggccagcaacaccgccgaggtgttcttcgacggcgtgagagtgcccagcgagaacgtgctgggcgaggtgggcagcggcttcaaggtggccatgcacatcctgaacaacggcagattcggcatggccgccgccctggccggcaccatgagaggcatcatcgccaaggccgtggaccacgccaccaacagaacccagttcggcgagaagatccacaacttcggcctgatccaggagaagctggccagaatggtgatgctgcagtacgtgaccgagagcatggcctacatggtgagcgccaacatggaccagggcgccaccgacttccagatcgaggccgccatcagcaagatcttcggcagcgaggccgcctggaaggtgaccgacgagtgcatccagatcatgggcggcatgggcttcatgaaggagcccggcgtggagagagtgctgagagacctgagaatcttcagaatcttcgagggcaccaacgacatcctgagactgttcgtggccctgcagggctgcatggacaagggcaaggagctgagcggcctgggcagcgccctgaagaaccccttcggcaacgccggcctgctgctgggcgaggccggcaagcagctgagaagaagagccggcctgggcagcggcctgagcctgagcggcctggtgcaccccgagctgagcagaagcggcgagctggccgtgagagccctggagcagttcgccaccgtggtggaggccaagctgatcaagcacaagaagggcatcgtgaacgagcagttcctgctgcagagactggccgacggcgccatcgacctgtacgccatggtggtggtgctgagcagagccagcagaagcctgagcgagggccaccccaccgcccagcacgagaagatgctgtgcgacacctggtgcatcgaggccgccgccagaatcagagagggcatggccgccctgcagagcgacccctggcagcaggagctgtacagaaacttcaagagcatcagcaaggccctggtggagagaggcggcgtggtgaccagcaaccccctgggcttctag

SEQ ID NO: 71666 - DNA, 1902 bp, Artificial Sequence
  Description of Artificial Sequence: Synthetic coding sequence
atgcaggccgccagaatggccgccagcctgggcagacagctgctgagactgggcggcggcagcagcagactgaccgccctgctgggccagcccagacccggccccgccagaagaccctacgccggcggcgccgcccaggagagcaagagcttcgccgtgggcatgttcaagggccagctgaccaccgaccaggtgttcccctaccccagcgtgctgaacgaggagcagacccagttcctgaaggagctggtggagcccgtgagcagattcttcgaggaggtgaacgaccccgccaagaacgacgccctggagatggtggaggagaccacctggcagggcctgaaggagctgggcgccttcggcctgcaggtgcccagcgagctgggcggcgtgggcctgtgcaacacccagtacgccagactggtggagatcgtgggcatgcacgacctgggcgtgggcatcaccctgggcgcccaccagagcatcggcttcaagggcatcctgctgttcggcaccaaggcccagaaggagaagtacctgcccaagctggccagcggcgagaccgtggccgccttctgcctgaccgagcccagcagcggcagcgacgccgccagcatcagaaccagcgccgtgcccagcccctgcggcaagtactacaccctgaacggcagcaagctgtggatcagcaacggcggcctggccgacatcttcaccgtgttcgccaagacccccgtgaccgaccccgccaccggcgccgtgaaggagaagatcaccgccttcgtggtggagagaggcttcggcggcatcacccacggcccccccgagaagaagatgggcatcaaggccagcaacaccgccgaggtgttcttcgacggcgtgagagtgcccagcgagaacgtgctgggcgaggtgggcagcggcttcaaggtggccatgcacatcctgaacaacggcagattcggcatggccgccgccctggccggcaccatgagaggcatcatcgccaaggccgtggaccacgccaccaacagaacccagttcggcgagaagatccacaacttcggcctgatccaggagaagctggccagaatggtgatgctgcagtacgtgaccgagagcatggcctacatggtgagcgccaacatggaccagggcgccaccgacttccagatcgaggccgccatcagcaagatcttcggcagcgaggccgcctggaaggtgaccgacgagtgcatccagatcatgggcggcatgggcttcatgaaggagcccggcgtggagagagtgctgagagacctgagaatcttcagaatcttcgagggcaccaacgacatcctgagactgttcgtggccctgcagggctgcatggacaagggcaaggagctgagcggcctgggcagcgccctgaagaaccccttcggcaacgccggcctgctgctgggcgaggccggcaagcagctgagaagaagagccggcctgggcagcggcctgagcctgagcggcctggtgcaccccgagctgagcagaagcggcgagctggccgtgagagccctggagcagttcgccaccgtggtggaggccaagctgatcaagcacaagaagggcatcgtgaacgagcagttcctgctgcagagactggccgacggcgccatcgacctgtacgccatggtggtggtgctgagcagagccagcagaagcctgagcgagggccaccccaccgcccagcacgagaagatgctgtgcgacacctggtgcatcgaggccgccgccagaatcagagagggcatggccgccctgcagagcgacccctggcagcaggagctgtacagaaacttcaagagcatcagcaaggccctggtggagagaggcggcgtggtgaccagcaaccccctgggcttctag

SEQ ID NO: 71667 - DNA, 2106 bp, Artificial Sequence
  Description of Artificial Sequence: Synthetic coding sequence
atgcccagaggcccccagcccagcgccgccagatgcaccgtggacgacgagagcggcctgggcgcccccggcagaggcagagccggcagacagagctgggtgagagccagagccagcggcgccagaagagacagcgagatgcaggccgccagaatggccgccagcctgggcagacagctgctgagactgggcggcggcagcagcagactgaccgccctgctgggccagcccagacccggccccgccagaagaccctacgccggcggcgccgcccagctggccctggacaagagcgacagccaccccagcgacgccctgaccagaaagaagcccgccaaggccgagagcaagagcttcgccgtgggcatgttcaagggccagctgaccaccgaccaggtgttcccctaccccagcgtgctgaacgaggagcagacccagttcctgaaggagctggtggagcccgtgagcagattcttcgaggaggtgaacgaccccgccaagaacgacgccctggagatggtggaggagaccacctggcagggcctgaaggagctgggcgccttcggcctgcaggtgcccagcgagctgggcggcgtgggcctgtgcaacacccagtacgccagactggtggagatcgtgggcatgcacgacctgggcgtgggcatcaccctgggcgcccaccagagcatcggcttcaagggcatcctgctgttcggcaccaaggcccagaaggagaagtacctgcccaagctggccagcggcgagaccgtggccgccttctgcctgaccgagcccagcagcggcagcgacgccgccagcatcagaaccagcgccgtgcccagcccctgcggcaagtactacaccctgaacggcagcaagctgtggatcagcaacggcggcctggccgacatcttcaccgtgttcgccaagacccccgtgaccgaccccgccaccggcgccgtgaaggagaagatcaccgccttcgtggtggagagaggcttcggcggcatcacccacggcccccccgagaagaagatgggcatcaaggccagcaacaccgccgaggtgttcttcgacggcgtgagagtgcccagcgagaacgtgctgggcgaggtgggcagcggcttcaaggtggccatgcacatcctgaacaacggcagattcggcatggccgccgccctggccggcaccatgagaggcatcatcgccaaggccgtggaccacgccaccaacagaacccagttcggcgagaagatccacaacttcggcctgatccaggagaagctggccagaatggtgatgctgcagtacgtgaccgagagcatggcctacatggtgagcgccaacatggaccagggcgccaccgacttccagatcgaggccgccatcagcaagatcttcggcagcgaggccgcctggaaggtgaccgacgagtgcatccagatcatgggcggcatgggcttcatgaaggagcccggcgtggagagagtgctgagagacctgagaatcttcagaatcttcgagggcaccaacgacatcctgagactgttcgtggccctgcagggctgcatggacaagggcaaggagctgagcggcctgggcagcgccctgaagaaccccttcggcaacgccggcctgctgctgggcgaggccggcaagcagctgagaagaagagccggcctgggcagcggcctgagcctgagcggcctggtgcaccccgagctgagcagaagcggcgagctggccgtgagagccctggagcagttcgccaccgtggtggaggccaagctgatcaagcacaagaagggcatcgtgaacgagcagttcctgctgcagagactggccgacggcgccatcgacctgtacgccatggtggtggtgctgagcagagccagcagaagcctgagcgagggccaccccaccgcccagcacgagaagatgctgtgcgacacctggtgcatcgaggccgccgccagaatcagagagggcatggccgccctgcagagcgacccctggcagcaggagctgtacagaaacttcaagagcatcagcaaggccctggtggagagaggcggcgtggtgaccagcaaccccctgggcttctag

SEQ ID NO: 71668 - DNA, 2106 bp, Artificial Sequence; identical to SEQ ID NO: 71667
  Description of Artificial Sequence: Synthetic coding sequence

SEQ ID NO: 71669 - DNA, 2037 bp, Artificial Sequence
  Description of Artificial Sequence: Synthetic coding sequence
atgctgggcggcctggccgccgccgccggcaccagaatcatgggcaaggagatcgaggccgaggcccagagacccctgagacagacctggagacccggccagccccccgccatgaccgccaagaccatgagcagcagactgaccgccctgctgggccagcccagacccggccccgccagaagaccctacgccggcggcgccgcccagctggccctggacaagagcgacagccaccccagcgacgccctgaccagaaagaagcccgccaaggccgagagcaagagcttcgccgtgggcatgttcaagggccagctgaccaccgaccaggtgttcccctaccccagcgtgctgaacgaggagcagacccagttcctgaaggagctggtggagcccgtgagcagattcttcgaggaggtgaacgaccccgccaagaacgacgccctggagatggtggaggagaccacctggcagggcctgaaggagctgggcgccttcggcctgcaggtgcccagcgagctgggcggcgtgggcctgtgcaacacccagtacgccagactggtggagatcgtgggcatgcacgacctgggcgtgggcatcaccctgggcgcccaccagagcatcggcttcaagggcatcctgctgttcggcaccaaggcccagaaggagaagtacctgcccaagctggccagcggcgagaccgtggccgccttctgcctgaccgagcccagcagcggcagcgacgccgccagcatcagaaccagcgccgtgcccagcccctgcggcaagtactacaccctgaacggcagcaagctgtggatcagcaacggcggcctggccgacatcttcaccgtgttcgccaagacccccgtgaccgaccccgccaccggcgccgtgaaggagaagatcaccgccttcgtggtggagagaggcttcggcggcatcacccacggcccccccgagaagaagatgggcatcaaggccagcaacaccgccgaggtgttcttcgacggcgtgagagtgcccagcgagaacgtgctgggcgaggtgggcagcggcttcaaggtggccatgcacatcctgaacaacggcagattcggcatggccgccgccctggccggcaccatgagaggcatcatcgccaaggccgtggaccacgccaccaacagaacccagttcggcgagaagatccacaacttcggcctgatccaggagaagctggccagaatggtgatgctgcagtacgtgaccgagagcatggcctacatggtgagcgccaacatggaccagggcgccaccgacttccagatcgaggccgccatcagcaagatcttcggcagcgaggccgcctggaaggtgaccgacgagtgcatccagatcatgggcggcatgggcttcatgaaggagcccggcgtggagagagtgctgagagacctgagaatcttcagaatcttcgagggcaccaacgacatcctgagactgttcgtggccctgcagggctgcatggacaagggcaaggagctgagcggcctgggcagcgccctgaagaaccccttcggcaacgccggcctgctgctgggcgaggccggcaagcagctgagaagaagagccggcctgggcagcggcctgagcctgagcggcctggtgcaccccgagctgagcagaagcggcgagctggccgtgagagccctggagcagttcgccaccgtggtggaggccaagctgatcaagcacaagaagggcatcgtgaacgagcagttcctgctgcagagactggccgacggcgccatcgacctgtacgccatggtggtggtgctgagcagagccagcagaagcctgagcgagggccaccccaccgcccagcacgagaagatgctgtgcgacacctggtgcatcgaggccgccgccagaatcagagagggcatggccgccctgcagagcgacccctggcagcaggagctgtacagaaacttcaagagcatcagcaaggccctggtggagagaggcggcgtggtgaccagcaaccccctgggcttctag

SEQ ID NO: 71670 - DNA, 1983 bp, Artificial Sequence
  Description of Artificial Sequence: Synthetic coding sequence
atgaaccccgacctgagaagagagagagacagcgccagcttcaaccccgagctgctgacccacatcctggacggcagccccgagaagaccagaagaagaagagagatcgagaacatgatcctgaacgaccccgacttccagcacgaggacctgaacttcctgaccagaagccagagatacgaggtggccgtgagaaagagcgccatcatggtgaagaagatgagagagttcggcatcgccgaccccgacgagatcatgtggttcaagaacttcgtgcacagaggcagacccgagcccctggacctgcacctgggcatgttcctgcccaccctgctgcaccaggccaccgccgagcagcaggagagattcttcatgcccgcctggaacctggagatcatcggcacctacgcccagaccgagatgggccacggcacccacctgagaggcctggagaccaccgccacctacgaccccgagacccaggagttcatcctgaacagccccaccgtgaccagcatcaagtggtggcccggcggcctgggcaagaccagcaaccacgccatcgtgctggcccagctgatcaccaagggcaagtgctacggcctgcacgccttcatcgtgcccatcagagagatcggcacccacaagcccctgcccggcatcaccgtgggcgacatcggccccaagttcggctacgacgagatcgacaacggctacctgaagatggacaaccacagaatccccagagagaacatgctgatgaagtacgcccaggtgaagcccgacggcacctacgtgaagcccctgagcaacaagctgacctacggcaccatggtgttcgtgagaagcttcctggtgggcgaggccgccagagccctgagcaaggcctgcaccatcgccatcagatacagcgccgtgagacaccagagcgagatcaagcccggcgagcccgagccccagatcctggacttccagacccagcagtacaagctgttccccctgctggccaccgcctacgccttccagttcgtgggcgcctacatgaaggagacctaccacagaatcaacgagggcatcggccagggcgacctgagcgagctgcccgagctgcacgccctgaccgccggcctgaaggccttcaccagctggaccgccaacaccggcatcgaggcctgcagaatggcctgcggcggccacggctacagccactgcagcggcctgcccaacatctacgtgaacttcacccccagctgcaccttcgagggcgagaacaccgtgatgatgctgcagaccgccagattcctgatgaagagctacgaccaggtgcacagcggcaagctggtgtgcggcatggtgagctacctgaacgacctgcccagccagagaatccagccccagcaggtggccgtgtggcccaccatggtggacatcaacagccccgagagcctgaccgaggcctacaagctgagagccgccagactggtggagatcgccgccaagaacctgcagaaggaggtgatccacagaaagagcaaggaggtggcctggaacctgaccagcgtggacctggtgagagccagcgaggcccactgccactacgtggtggtgaagctgttcagcgagaagctgctgaagatccaggacaaggccatccaggccgtgctgagaagcctgtgcctgctgtacagcctgtacggcatcagccagaacgccggcgacttcctgcagggcagcatcatgaccgagccccagatcacccaggtgaaccagagagtgaaggagctgctgaccctgatcagaagcgacgccgtggccctggtggacgccttcgacttccaggacgtgaccctgggcagcgtgctgggcagatacgacggcaacgtgtacgagaacctgttcgagtgggccaagaacagccccctgaacaaggccgaggtgcacgagagctacaagcacctgaagagcctgcagagcaagctgtag

SEQ ID NO: 71671 - DNA, 1983 bp, Artificial Sequence
  Description of Artificial Sequence: Synthetic coding sequence
atgaaccccgacctgagaagagagagagacagcgccagcttcaaccccgagctgctgacccacatcctggacggcagccccgagaagaccagaagaagaagagagatcgagaacatgatcctgaacgaccccgacttccagcacgaggacctgaacttcctgaccagaagccagagatacgaggtggccgtgagaaagagcgccatcatggtgaagaagatgagagagttcggcatcgccgaccccgacgagatcatgtggttcaagaagctgcacctggtgaacttcgtggagcccgtgggcctgaactacagcatgttcatccccaccctgctgaaccagggcaccaccgcccagaaggagaagtggctgctgagcagcaagggcctgcagatcatcggcacctacgcccagaccgagatgggccacggcacccacctgagaggcctggagaccaccgccacctacgaccccgagacccaggagttcatcctgaacagccccaccgtgaccagcatcaagtggtggcccggcggcctgggcaagaccagcaaccacgccatcgtgctggcccagctgatcaccaagggcaagtgctacggcctgcacgccttcatcgtgcccatcagagagatcggcacccacaagcccctgcccggcatcaccgtgggcgacatcggccccaagttcggctacgacgagatcgacaacggctacctgaagatggacaaccacagaatccccagagagaacatgctgatgaagtacgcccaggtgaagcccgacggcacctacgtgaagcccctgagcaacaagctgacctacggcaccatggtgttcgtgagaagcttcctggtgggcgaggccgccagagccctgagcaaggcctgcaccatcgccatcagatacagcgccgtgagacaccagagcgagatcaagcccggcgagcccgagccccagatcctggacttccagacccagcagtacaagctgttccccctgctggccaccgcctacgccttccagttcgtgggcgcctacatgaaggagacctaccacagaatcaacgagggcatcggccagggcgacctgagcgagctgcccgagctgcacgccctgaccgccggcctgaaggccttcaccagctggaccgccaacaccggcatcgaggcctgcagaatggcctgcggcggccacggctacagccactgcagcggcctgcccaacatctacgtgaacttcacccccagctgcaccttcgagggcgagaacaccgtgatgatgctgcagaccgccagattcctgatgaagagctacgaccaggtgcacagcggcaagctggtgtgcggcatggtgagctacctgaacgacctgcccagccagagaatccagccccagcaggtggccgtgtggcccaccatggtggacatcaacagccccgagagcctgaccgaggcctacaagctgagagccgccagactggtggagatcgccgccaagaacctgcagaaggaggtgatccacagaaagagcaaggaggtggcctggaacctgaccagcgtggacctggtgagagccagcgaggcccactgccactacgtggtggtgaagctgttcagcgagaagctgctgaagatccaggacaaggccatccaggccgtgctgagaagcctgtgcctgctgtacagcctgtacggcatcagccagaacgccggcgacttcctgcagggcagcatcatgaccgagccccagatcacccaggtgaaccagagagtgaaggagctgctgaccctgatcagaagcgacgccgtggccctggtggacgccttcgacttccaggacgtgaccctgggcagcgtgctgggcagatacgacggcaacgtgtacgagaacctgttcgagtgggccaagaacagccccctgaacaaggccgaggtgcacgagagctacaagcacctgaagagcctgcagagcaagctgtag

SEQ ID NO: 71672 - DNA, 1869 bp, Artificial Sequence
  Description of Artificial Sequence: Synthetic coding sequence
atgatcctgaacgaccccgacttccagcacgaggacctgaacttcctgaccagaagccagagatacgaggtggccgtgagaaagagcgccatcatggtgaagaagatgagagagttcggcatcgccgaccccgacgagatcatgtggttcaagaacttcgtgcacagaggcagacccgagcccctggacctgcacctgggcatgttcctgcccaccctgctgcaccaggccaccgccgagcagcaggagagattcttcatgcccgcctggaacctggagatcatcggcacctacgcccagaccgagatgggccacggcacccacctgagaggcctggagaccaccgccacctacgaccccgagacccaggagttcatcctgaacagccccaccgtgaccagcatcaagtggtggcccggcggcctgggcaagaccagcaaccacgccatcgtgctggcccagctgatcaccaagggcaagtgctacggcctgcacgccttcatcgtgcccatcagagagatcggcacccacaagcccctgcccggcatcaccgtgggcgacatcggccccaagttcggctacgacgagatcgacaacggctacctgaagatggacaaccacagaatccccagagagaacatgctgatgaagtacgcccaggtgaagcccgacggcacctacgtgaagcccctgagcaacaagctgacctacggcaccatggtgttcgtgagaagcttcctggtgggcgaggccgccagagccctgagcaaggcctgcaccatcgccatcagatacagcgccgtgagacaccagagcgagatcaagcccggcgagcccgagccccagatcctggacttccagacccagcagtacaagctgttccccctgctggccaccgcctacgccttccagttcgtgggcgcctacatgaaggagacctaccacagaatcaacgagggcatcggccagggcgacctgagcgagctgcccgagctgcacgccctgaccgccggcctgaaggccttcaccagctggaccgccaacaccggcatcgaggcctgcagaatggcctgcggcggccacggctacagccactgcagcggcctgcccaacatctacgtgaacttcacccccagctgcaccttcgagggcgagaacaccgtgatgatgctgcagaccgccagattcctgatgaagagctacgaccaggtgcacagcggcaagctggtgtgcggcatggtgagctacctgaacgacctgcccagccagagaatccagccccagcaggtggccgtgtggcccaccatggtggacatcaacagccccgagagcctgaccgaggcctacaagctgagagccgccagactggtggagatcgccgccaagaacctgcagaaggaggtgatccacagaaagagcaaggaggtggcctggaacctgaccagcgtggacctggtgagagccagcgaggcccactgccactacgtggtggtgaagctgttcagcgagaagctgctgaagatccaggacaaggccatccaggccgtgctgagaagcctgtgcctgctgtacagcctgtacggcatcagccagaacgccggcgacttcctgcagggcagcatcatgaccgagccccagatcacccaggtgaaccagagagtgaaggagctgctgaccctgatcagaagcgacgccgtggccctggtggacgccttcgacttccaggacgtgaccctgggcagcgtgctgggcagatacgacggcaacgtgtacgagaacctgttcgagtgggccaagaacagccccctgaacaaggccgaggtgcacgagagctacaagcacctgaagagcctgcagagcaagctgtag

SEQ ID NO: 71673 - DNA, 1779 bp, Artificial Sequence
  Description of Artificial Sequence: Synthetic coding sequence
atggccgccttcatccagagaacccccgacaactggcacctgagacccgacggcaacggccccagattcgtgcacagaggcagacccgagcccctggacctgcacctgggcatgttcctgcccaccctgctgcaccaggccaccgccgagcagcaggagagattcttcatgcccgcctggaacctggagatcatcggcacctacgcccagaccgagatgggccacggcacccacctgagaggcctggagaccaccgccacctacgaccccgagacccaggagttcatcctgaacagccccaccgtgaccagcatcaagtggtggcccggcggcctgggcaagaccagcaaccacgccatcgtgctggcccagctgatcaccaagggcaagtgctacggcctgcacgccttcatcgtgcccatcagagagatcggcacccacaagcccctgcccggcatcaccgtgggcgacatcggccccaagttcggctacgacgagatcgacaacggctacctgaagatggacaaccacagaatccccagagagaacatgctgatgaagtacgcccaggtgaagcccgacggcacctacgtgaagcccctgagcaacaagctgacctacggcaccatggtgttcgtgagaagcttcctggtgggcgaggccgccagagccctgagcaaggcctgcaccatcgccatcagatacagcgccgtgagacaccagagcgagatcaagcccggcgagcccgagccccagatcctggacttccagacccagcagtacaagctgttccccctgctggccaccgcctacgccttccagttcgtgggcgcctacatgaaggagacctaccacagaatcaacgagggcatcggccagggcgacctgagcgagctgcccgagctgcacgccctgaccgccggcctgaaggccttcaccagctggaccgccaacaccggcatcgaggcctgcagaatggcctgcggcggccacggctacagccactgcagcggcctgcccaacatctacgtgaacttcacccccagctgcaccttcgagggcgagaacaccgtgatgatgctgcagaccgccagattcctgatgaagagctacgaccaggtgcacagcggcaagctggtgtgcggcatggtgagctacctgaacgacctgcccagccagagaatccagccccagcaggtggccgtgtggcccaccatggtggacatcaacagccccgagagcctgaccgaggcctacaagctgagagccgccagactggtggagatcgccgccaagaacctgcagaaggaggtgatccacagaaagagcaaggaggtggcctggaacctgaccagcgtggacctggtgagagccagcgaggcccactgccactacgtggtggtgaagctgttcagcgagaagctgctgaagatccaggacaaggccatccaggccgtgctgagaagcctgtgcctgctgtacagcctgtacggcatcagccagaacgccggcgacttcctgcagggcagcatcatgaccgagccccagatcacccaggtgaaccagagagtgaaggagctgctgaccctgatcagaagcgacgccgtggccctggtggacgccttcgacttccaggacgtgaccctgggcagcgtgctgggcagatacgacggcaacgtgtacgagaacctgttcgagtgggccaagaacagccccctgaacaaggccgaggtgcacgagagctacaagcacctgaagagcctgcagagcaagctgtag

SEQ ID NO: 71674 - DNA, 1983 bp, Artificial Sequence; identical to SEQ ID NO: 71670
  Description of Artificial Sequence: Synthetic coding sequence

SEQ ID NO: 71675 - DNA, 2046 bp, Artificial Sequence
  Description of Artificial Sequence: Synthetic coding sequence
atgggcagccccgtgcacagagtgagcctgggcgacacctggagcagacagatgcaccccgacatcgagagcgagagatacatgcagagcttcgacgtggagagactgaccaacatcctggacggcggcgcccagaacaccgccctgagaagaaaggtggagagcatcatccacagctaccccgagttcagctgcaaggacaactacttcatgacccagaacgagagatacaaggccgccatgagaagagccttccacatcagactgatcgccagaagactgggctggctggaggacggcagagagctgggctacgcctacagagccctgagcggcgacgtggccctgaacatccacagagtgttcgtgagagccctgagaagcctgggcagcgaggagcagatcgccaagtgggaccccctgtgcaagaacatccagatcatcgccacctacgcccagaccgagctgggccacggcacctacctgcagggcctggagaccgaggccacctacgacgccgccacccaggagttcgtgatccacagccccaccctgaccgccaccaagtggtggcccggcgacctgggcagaagcgccacccacgccctggtgcaggcccagctgatctgcagcggcgccagaagaggcatgcacgccttcatcgtgcccatcagaagcctgcaggaccacacccccctgcccggcatcatcatcggcgacatcggccccaagatggacttcgaccagaccgacaacggcttcctgcagctgaaccacgtgagagtgcccagagagaacatgctgagcagattcgcccaggtgctgcccgacggcacctacgtgaagctgggcaccgcccagagcaactacctgcccatggtggtggtgagagtggagctgctgagcggcgagatcctgcccatcctgcagaaggcctgcgtgatcgccatgagatacagcgtgatcagaagacagagcagactgagacccagcgaccccgaggccaaggtgctggactaccagacccagcagcagaagctgttcccccagctggccatcagctacgccttccacttcctggccgtgagcctgctggagttcttccagcacagctacaccgccatcctgaaccaggacttcagcttcctgcccgagctgcacgccctgagcaccggcatgaaggccatgatgagcgagttctgcacccagggcgccgagatgtgcagaagagcctgcggcggccacggctacagcaagctgagcggcctgcccagcctggtgaccaagctgagcgccagctgcacctacgagggcgagaacaccgtgctgtacctgcaggtggccagattcctggtgaagagctacctgcagacccagatgagccccggcagcaccccccagagaagcctgagccccagcgtggcctacctgaccgcccccgacctggccagatgccccgcccagagagccgccgacttcctgtgccccgagctgtacaccaccgcctgggcccacgtggccgtgagactgatcaaggacagcgtgcagcacctgcagaccctgacccagagcggcgccgaccagcacgaggcctggaaccagaccaccgtgatccacctgcaggccgccaaggtgcactgctactacgtgaccgtgaagggcttcaccgaggccctggagaagctggagaacgagcccgccatccagcaggtgctgaagagactgtgcgacctgcacgccatccacggcatcctgaccaacagcggcgacttcctgcacgacgccttcctgagcggcgcccaggtggacatggccagaaccgcctacctggacctgctgagactgatcagaaaggacgccatcctgctgaccgacgccttcgacttcaccgaccagtgcctgaacagcgccctgggctgctacgacggcaacgtgtacgagagactgttccagtgggcccagaagagccccaccaacacccaggagaaccccgcctacgaggagtacatcagacccctgctgcagagctggagaagcaagctgtag

SEQ ID NO: 71676 - DNA, 516 bp, Artificial Sequence
  Description of Artificial Sequence: Synthetic coding sequence
atgggcagccccgtgcacagagtgagcctgggcgacacctggagcagacagatgcaccccgacatcgagagcgagagatacatgcagagcttcgacgtggagagactgaccaacatcctggacggcggcgcccagaacaccgccctgagaagaaaggtggagagcatcatccacagctaccccgagttcagctgcaaggacaactacttcatgacccagaacgagagatacaaggccgccatgagaagagccttccacatcagactgatcgccagaagactgggctggctggaggacggcagagagctgggctacgcctacagagccctgagcggcgacgtggccctgaacatccacagagtgttcgtgagagccctgagaagcctgggcagcgaggagcagatcgccaagtgggaccccctgtgcaagaacatccagatcatcgccacctacgcccagaccgagctgggccacggcacctacctgcagggcctggagaccgaggccacctactag

SEQ ID NO: 71677 - DNA, 2103 bp, Artificial Sequence
  Description of Artificial Sequence: Synthetic coding sequence
atggccagcaccgtggagggcggcgacaccgccctgctgcccgagttccccagaggccccctggacgcctacagagccagagccagcttcagctggaaggagctggccctgttcaccgagggcgagggcatgctgagattcaagaagaccatcttcagcgccctggagaacgaccccctgttcgccagaagccccggcgccgacctgagcctggagaagtacagagagctgaacttcctgagatgcaagagaatcttcgagtacgacttcctgagcgtggaggacatgttcaagagccccctgaaggtgcccgccctgatccagtgcctgggcatgtacgacagcagcctggccgccaagtacctgctgcacagcctggtgttcggcagcgccgtgtacagcagcggcagcgagagacacctgacctacatccagaagatcttcagaatggagatcttcggctgcttcgccctgaccgagctgagccacggcagcaacaccaaggccatcagaaccaccgcccactacgaccccgccaccgaggagttcatcatccacagccccgacttcgaggccgccaagttctgggtgggcaacatgggcaagaccgccacccacgccgtggtgttcgccaagctgtgcgtgcccggcgaccagtgccacggcctgcaccccttcatcgtgcagatcagagaccccaagaccctgctgcccatgcccggcgtgatggtgggcgacatcggcaagaagctgggccagaacggcctggacaacggcttcgccatgttccacaaggtgagagtgcccagacagagcctgctgaacagaatgggcgacgtgacccccgagggcacctacgtgagccccttcaaggacgtgagacagagattcggcgccagcctgggcagcctgagcagcggcagagtgagcatcgtgagcctggccatcctgaacctgaagctggccgtggccatcgccctgagattcagcgccaccagaagacagttcggccccaccgaggaggaggagatccccgtgctggagtaccccatgcagcagtggagactgctgccctacctggccgccgtgtacgccctggaccacttcagcaagagcctgttcctggacctggtggagctgcagagaggcctggccagcggcgacagaagcgccagacaggccgagctgggcagagagatccacgccctggccagcgccagcaagcccctggccagctggaccacccagcagggcatccaggagtgcagagaggcctgcggcggccacggctacctggccatgaacagactgggcgtgctgagagacgacaacgaccccaactgcacctacgagggcgacaacaacatcctgctgcagcagaccagcaactacctgctgggcctgctggcccaccaggtgcacgacggcgcctgcttcagaagccccctgaagagcgtggacttcctggacgcctaccccggcatcctggaccagaagttcgaggtgagcagcgtggccgactgcctggacagcgccgtggccctggccgcctacaagtggctggtgtgctacctgctgagagagacctaccagaagctgaaccaggagaagagaagcggcagcagcgacttcgaggccagaaacaagtgccaggtgagccacggcagacccctggccctggccttcgtggagctgaccgtggtgcagagattccacgagcacgtgcaccagcccagcgtgccccccagcctgagagccgtgctgggcagactgagcgccctgtacgccctgtggagcctgagcagacacgccgccctgctgtacagaggcggctacttcagcggcgagcaggccggcgaggtgctggagagcgccgtgctggccctgtgcagccagctgaaggacgacgccgtggccctggtggacgtgatcgccccccccgacttcgtgctggacagccccatcggcagagccgacggcgagctgtacaagaacctgtggggcgccgtgctgcaggagagcaaggtgctggagagagccagctggtggcccgagttcagcgtgaacaagcccgtgatcggcagcctgaagagcaagctgtag

SEQ ID NO: 71678 - DNA, 1875 bp, Artificial Sequence
  Description of Artificial Sequence: Synthetic coding sequence
atggccagcaccgtggagggcggcgacaccgccctgctgcccgagttccccagaggccccctggacgcctacagagccagagccagcttcagctggaaggagctggccctgttcaccgagggcgagggcatgctgagattcaagaagaccatcttcagcgccctggagaacgaccccctgttcgccagaagccccggcgccgacctgagcctggagaagtacagagagctgaacttcctgagatgcaagagaatcttcgagtacgacttcctgagcgtggaggacatgttcaagagccccctgaaggtgcccgccctgatccagtgcctgggcatgtacgacagcagcctggccgccaagtacctgctgcacagcctggtgttcggcagcgccgtgtacagcagcggcagcgagagacacctgacctacatccagaagatcttcagaatggagatcttcggctgcttcgccctgaccgagctgagccacggcagcaacaccaaggccatcagaaccaccgcccactacgaccccgccaccgaggagttcatcatccacagccccgacttcgaggccgccaagttctgggtgggcaacatgggcaagaccgccacccacgccgtggtgttcgccaagctgtgcgtgcccggcgaccagtgccacggcctgcaccccttcatcgtgcagatcagagaccccaagaccctgctgcccatgcccggcgtgatggtgggcgacatcggcaagaagctgggccagaacggcctggacaacggcttcgccatgttccacaaggtgagagtgcccagacagagcctgctgaacagaatgggcgacgtgacccccgagggcacctacgtgagccccttcaaggacgtgagacagagattcggcgccagcctgggcagcctgagcagcggcagagtgagcatcgtgagcctggccatcctgaacctgaagctggccgtggccatcgccctgagattcagcgccaccagaagacagttcggccccaccgaggaggaggagatccccgtgctggagtaccccatgcagcagtggagactgctgccctacctggccgccgtgtacgccctggaccacttcagcaagagcctgttcctggacctggtggagctgcagagaggcctggccagcggcgacagaagcgccagacaggccgagctgggcagagagatccacgccctggccagcgccagcaagcccctggccagctggaccacccagcagggcatccaggagtgcagagaggcctgcggcggccacggctacctggccatgaacagactgggcgtgctgagagacgacaacgaccccaactgcacctacgagggcgacaacaacatcctgctgcagcagaccagcaactacctgctgggcctgctggcccaccaggtgcacgacggcgcctgcttcagaagccccctgaagagcgtggacttcctggacgcctaccccggcatcctggaccagaagttcgaggtgagcagcgtggccgactgcctggacagcgccgtggccctggccgcctacaagtggctggtgtgctacctgctgagagagacctaccagaagctgaaccaggagaagagaagcggcagcagcgacttcgaggccagaaacaagtgccaggtgagccacggcagacccctggccctggccttcgtggagctgaccgtggtgcagagattccacgagcacgtgcaccagcccagcgtgccccccagcctgagagccgtgctgggcagactgagcgccctgtacgccctgtggagcctgagcagacacgccgccctgctgtacagagccgagagaagatgcagctgccccggcagaagagacagaagcagctag

SEQ ID NO: 71679 - DNA, 2103 bp, Artificial Sequence; identical to SEQ ID NO: 71677
  Description of Artificial Sequence: Synthetic coding sequence

SEQ ID NO: 71680 - DNA, 2175 bp, Artificial Sequence
  Description of Artificial Sequence: Synthetic coding sequence
atgcccagaaacagcggcgccggctacggctgcccccacggcgaccccagcatgctggacagcagagagaccccccaggagagcagacaggacatgatcgtgagaaccacccaggagaagctgaagaccagcagcctgaccgacagacagcccctgagcaaggagagcctgaaccacgccctggagctgagcgtgcccgagaaggtgaacaacgcccagtgggacgcccccgaggaggccctgtggaccaccagagccgacggcagagtgagactgagaatcgaccccagctgcccccagctgccctacaccgtgcacagaatgttctacgaggccctggacaagtacggcgacctgatcgccctgggcttcaagagacaggacaagtgggagcacatcagctacagccagtactacctgctggccagaagagccgccaagggcttcctgaagctgggcctgaagcaggcccacagcgtggccatcctgggcttcaacagccccgagtggttcttcagcgccgtgggcaccgtgttcgccggcggcatcgtgaccggcatctacaccaccagcagccccgaggcctgccagtacatcgcctacgactgctgcgccaacgtgatcatggtggacacccagaagcagctggagaagatcctgaagatctggaagcagctgccccacctgaaggccgtggtgatctacaaggagcccccccccaacaagatggccaacgtgtacaccatggaggagttcatggagctgggcaacgaggtgcccgaggaggccctggacgccatcatcgacacccagcagcccaaccagtgctgcgtgctggtgtacaccagcggcaccaccggcaaccccaagggcgtgatgctgagccaggacaacatcacctggaccgccagatacggcagccaggccggcgacatcagacccgccgaggtgcagcaggaggtggtggtgagctacctgcccctgagccacatcgccgcccagatctacgacctgtggaccggcatccagtggggcgcccaggtgtgcttcgccgagcccgacgccctgaagggcagcctggtgaacaccctgagagaggtggagcccaccagccacatgggcgtgcccagagtgtgggagaagatcatggagagaatccaggaggtggccgcccagagcggcttcatcagaagaaagatgctgctgtgggccatgagcgtgaccctggagcagaacctgacctgccccggcagcgacctgaagcccttcaccaccagactggccgactacctggtgctggccaaggtgagacaggccctgggcttcgccaagtgccagaagaacttctacggcgccgcccccatgatggccgagacccagcacttcttcctgggcctgaacatcagactgtacgccggctacggcctgagcgagaccagcggcccccacttcatgagcagcccctacaactacagactgtacagcagcggcaagctggtgcccggctgcagagtgaagctggtgaaccaggacgccgagggcatcggcgagatctgcctgtggggcagaaccatcttcatgggctacctgaacatggaggacaagacctgcgaggccatcgacgaggagggctggctgcacaccggcgacgccggcagactggacgccgacggcttcctgtacatcaccggcagactgaaggagctgatcatcaccgccggcggcgagaacgtgccccccgtgcccatcgaggaggccgtgaagatggagctgcccatcatcagcaacgccatgctgatcggcgaccagagaaagttcctgagcatgctgctgaccctgaagtgcaccctggaccccgacaccagcgaccagaccgacaacctgaccgagcaggccatggagttctgccagagagtgggcagcagagccaccaccgtgagcgagatcatcgagaagaaggacgaggccgtgtaccaggccatcgaggagggcatcagaagagtgaacatgaacgccgccgccagaccctaccacatccagaagtgggccatcctggagagagacttcagcatcagcggcggcgagctgggccccaccatgaagctgaagagactgaccgtgctggagaagtacaagggcatcatcgacagcttctaccaggagcagaagatgtag

SEQ ID NO: 71681 - DNA, 1449 bp, Artificial Sequence
  Description of Artificial Sequence: Synthetic coding sequence
atggccaacgtgtacaccatggaggagttcatggagctgggcaacgaggtgcccgaggaggccctggacgccatcatcgacacccagcagcccaaccagtgctgcgtgctggtgtacaccagcggcaccaccggcaaccccaagggcgtgatgctgagccaggacaacatcacctggaccgccagatacggcagccaggccggcgacatcagacccgccgaggtgcagcaggaggtggtggtgagctacctgcccctgagccacatcgccgcccagatctacgacctgtggaccggcatccagtggggcgcccaggtgtgcttcgccgagcccgacgccctgaagggcagcctggtgaacaccctgagagaggtggagcccaccagccacatgggcgtgcccagagtgtgggagaagatcatggagagaatccaggaggtggccgcccagagcggcttcatcagaagaaagatgctgctgtgggccatgagcgtgaccctggagcagaacctgacctgccccggcagcgacctgaagcccttcaccaccagactggccgactacctggtgctggccaaggtgagacaggccctgggcttcgccaagtgccagaagaacttctacggcgccgcccccatgatggccgagacccagcacttcttcctgggcctgaacatcagactgtacgccggctacggcctgagcgagaccagcggcccccacttcatgagcagcccctacaactacagactgtacagcagcggcaagctggtgcccggctgcagagtgaagctggtgaaccaggacgccgagggcatcggcgagatctgcctgtggggcagaaccatcttcatgggctacctgaacatggaggacaagacctgcgaggccatcgacgaggagggctggctgcacaccggcgacgccggcagactggacgccgacggcttcctgtacatcaccggcagactgaaggagctgatcatcaccgccggcggcgagaacgtgccccccgtgcccatcgaggaggccgtgaagatggagctgcccatcatcagcaacgccatgctgatcggcgaccagagaaagttcctgagcatgctgctgaccctgaagtgcaccctggaccccgacaccagcgaccagaccgacaacctgaccgagcaggccatggagttctgccagagagtgggcagcagagccaccaccgtgagcgagatcatcgagaagaaggacgaggccgtgtaccaggccatcgaggagggcatcagaagagtgaacatgaacgccgccgccagaccctaccacatccagaagtgggccatcctggagagagacttcagcatcagcggcggcgagctgggccccaccatgaagctgaagagactgaccgtgctggagaagtacaagggcatcatcgacagcttctaccaggagcagaagatgtag

SEQ ID NO: 71682 - DNA, 2001 bp, Artificial Sequence
  Description of Artificial Sequence: Synthetic coding sequence
atgaccggcacccccaagacccaggagggcgccaaggacctggaggtggacatgaacaagaccgaggtgacccccagactgtggaccacctgcagagacggcgaggtgctgctgagactgagcaagcacggccccggccacgagacccccatgaccatccccgagttcttcagagagagcgtgaacagattcggcacctaccccgccctggccagcaagaacggcaagaagtgggagatcctgaacttcaaccagtactacgaggcctgcagaaaggccgccaagagcctgatcaagctgggcctggagagattccacggcgtgggcatcctgggcttcaacagcgccgagtggttcatcaccgccgtgggcgccatcctggccggcggcctgtgcgtgggcatctacgccaccaacagcgccgaggtgtgccagtacgtgatcacccacgccaaggtgaacatcctgctggtggagaacgaccagcagctgcagaagatcctgagcatcccccagagcagcctggagcccctgaaggccatcatccagtacagactgcccatgaagaagaacaacaacctgtacagctgggacgacttcatggagctgggcagaagcatccccgacacccagctggagcaggtgatcgagagccagaaggccaaccagtgcgccgtgctgatctacaccagcggcaccaccggcatccccaagggcgtgatgctgagccacgacaacatcacctggatcgccggcgccgtgaccaaggacttcaagctgaccgacaagcacgagaccgtggtgagctacctgcccctgagccacatcgccgcccagatgatggacatctgggtgcccatcaagatcggcgccctgacctacttcgcccaggccgacgccctgaagggcaccctggtgagcaccctgaaggaggtgaagcccaccgtgttcatcggcgtgccccagatctgggagaagatccacgagatggtgaagaagaacagcgccaagagcatgggcctgaagaagaaggccttcgtgtgggccagaaacatcggcttcaaggtgaacagcaagaagatgctgggcaagtacaacacccccgtgagctacagaatggccaagaccctggtgttcagcaaggtgaagaccagcctgggcctggaccactgccacagcttcatcagcggcaccgcccccctgaaccaggagaccgccgagttcttcctgagcctggacatccccatcggcgagctgtacggcctgagcgagagcagcggcccccacaccatcagcaaccagaacaactacagactgctgagctgcggcaagatcctgaccggctgcaagaacatgctgttccagcagaacaaggacggcatcggcgagatctgcctgtggggcagacacatcttcatgggctacctggagagcgagaccgagaccaccgaggccatcgacgacgagggctggctgcacagcggcgacctgggccagctggacggcctgggcttcctgtacgtgaccggccacatcaaggagatcctgatcaccgccggcggcgagaacgtgccccccatccccgtggagaccctggtgaagaagaagatccccatcatcagcaacgccatgctggtgggcgacaagctgaagttcctgagcatgctgctgaccctgaagtgcgagatgaaccagatgagcggcgagcccctggacaagctgaacttcgaggccatcaacttctgcagaggcctgggcagccaggccagcaccgtgaccgagatcgtgaagcagcaggaccccctggtgtacaaggccatccagcagggcatcaacgccgtgaaccaggaggccatgaacaacgcccagagaatcgagaagtgggtgatcctggagaaggacttcagcatctacggcggcgagctgggccccatgatgaagctgaagagacacttcgtggcccagaagtacaagaagcagatcgaccacatgtaccactag

SEQ ID NO: 71683 - DNA, 1848 bp, Artificial Sequence
  Description of Artificial Sequence: Synthetic coding sequence
atggccgtgtacgtgggcatgctgagactgggcagactgtgcgccggcagcagcggcgtgctgggcgccagagccgccctgagcagaagctggcaggaggccagactgcagggcgtgagattcctgagcagcagagaggtggacagaatggtgagcacccccatcggcggcctgagctacgtgcagggctgcaccaagaagcacctgaacagcaagaccgtgggccagtgcctggagaccaccgcccagagagtgcccgagagagaggccctggtggtgctgcacgaggacgtgagactgaccttcgcccagctgaaggaggaggtggacaaggccgccagcggcctgctgagcatcggcctgtgcaagggcgacagactgggcatgtggggccccaacagctacgcctgggtgctgatgcagctggccaccgcccaggccggcatcatcctggtgagcgtgaaccccgcctaccaggccatggagctggagtacgtgctgaagaaggtgggctgcaaggccctggtgttccccaagcagttcaagacccagcagtactacaacgtgctgaagcagatctgccccgaggtggagaacgcccagcccggcgccctgaagagccagagactgcccgacctgaccaccgtgatcagcgtggacgcccccctgcccggcaccctgctgctggacgaggtggtggccgccggcagcaccagacagcacctggaccagctgcagtacaaccagcagttcctgagctgccacgaccccatcaacatccagttcaccagcggcaccaccggcagccccaagggcgccaccctgagccactacaacatcgtgaacaacagcaacatcctgggcgagagactgaagctgcacgagaagacccccgagcagctgagaatgatcctgcccaaccccctgtaccactgcctgggcagcgtggccggcaccatgatgtgcctgatgtacggcgccaccctgatcctggccagccccatcttcaacggcaagaaggccctggaggccatcagcagagagagaggcaccttcctgtacggcacccccaccatgttcgtggacatcctgaaccagcccgacttcagcagctacgacatcagcaccatgtgcggcggcgtgatcgccggcagccccgccccccccgagctgatcagagccatcatcaacaagatcaacatgaaggacctggtggtggcctacggcaccaccgagaacagccccgtgaccttcgcccacttccccgaggacaccgtggagcagaaggccgagagcgtgggcagaatcatgccccacaccgaggccagaatcatgaacatggaggccggcaccctggccaagctgaacacccccggcgagctgtgcatcagaggctactgcgtgatgctgggctactggggcgagccccagaagaccgaggaggccgtggaccaggacaagtggtactggaccggcgacgtggccaccatgaacgagcagggcttctgcaagatcgtgggcagaagcaaggacatgatcatcagaggcggcgagaacatctaccccgccgagctggaggacttcttccacacccaccccaaggtgcaggaggtgcaggtggtgggcgtgaaggacgacagaatgggcgaggagatctgcgcctgcatcagactgaaggacggcgaggagaccaccgtggaggagatcaaggccttctgcaagggcaagatcagccacttcaagatccccaagtacatcgtgttcgtgaccaactaccccctgaccatcagcggcaagatccagaagttcaagctgagagagcagatggagagacacctgaacctgtag

SEQ ID NO: 71684 - DNA, 1923 bp, Artificial Sequence
  Description of Artificial Sequence: Synthetic coding sequence
atggccgtgtacgtgggcatgctgagactgggcagactgtgcgccggcagcagcggcgtgctgggcgccagagccgccctgagcagaagctggcaggaggccagactgcagggcgtgagattcctgagcgccagaggcggcatggaggccggcagacagagaatcagcgtgcccagcagcttcaccgccagcgccgccgcccacagcagagaggtggacagaatggtgagcacccccatcggcggcctgagctacgtgcagggctgcaccaagaagcacctgaacagcaagaccgtgggccagtgcctggagaccaccgcccagagagtgcccgagagagaggccctggtggtgctgcacgaggacgtgagactgaccttcgcccagctgaaggaggaggtggacaaggccgccagcggcctgctgagcatcggcctgtgcaagggcgacagactgggcatgtggggccccaacagctacgcctgggtgctgatgcagctggccaccgcccaggccggcatcatcctggtgagcgtgaaccccgcctaccaggccatggagctggagtacgtgctgaagaaggtgggctgcaaggccctggtgttccccaagcagttcaagacccagcagtactacaacgtgctgaagcagatctgccccgaggtggagaacgcccagcccggcgccctgaagagccagagactgcccgacctgaccaccgtgatcagcgtggacgcccccctgcccggcaccctgctgctggacgaggtggtggccgccggcagcaccagacagcacctggaccagctgcagtacaaccagcagttcctgagctgccacgaccccatcaacatccagttcaccagcggcaccaccggcagccccaagggcgccaccctgagccactacaacatcgtgaacaacagcaacatcctgggcgagagactgaagctgcacgagaagacccccgagcagctgagaatgatcctgcccaaccccctgtaccactgcctgggcagcgtggccggcaccatgatgtgcctgatgtacggcgccaccctgatcctggccagccccatcttcaacggcaagaaggccctggaggccatcagcagagagagaggcaccttcctgtacggcacccccaccatgttcgtggacatcctgaaccagcccgacttcagcagctacgacatcagcaccatgtgcggcggcgtgatcgccggcagccccgccccccccgagctgatcagagccatcatcaacaagatcaacatgaaggacctggtggtggcctacggcaccaccgagaacagccccgtgaccttcgcccacttccccgaggacaccgtggagcagaaggccgagagcgtgggcagaatcatgccccacaccgaggccagaatcatgaacatggaggccggcaccctggccaagctgaacacccccggcgagctgtgcatcagaggctactgcgtgatgctgggctactggggcgagccccagaagaccgaggaggccgtggaccaggacaagtggtactggaccggcgacgtggccaccatgaacgagcagggcttctgcaagatcgtgggcagaagcaaggacatgatcatcagaggcggcgagaacatctaccccgccgagctggaggacttcttccacacccaccccaaggtgcaggaggtgcaggtggtgggcgtgaaggacgacagaatgggcgaggagatctgcgcctgcatcagactgaaggacggcgaggagaccaccgtggaggagatcaaggccttctgcaagggcaagatcagccacttcaagatccccaagtacatcgtgttcgtgaccaactaccccctgaccatcagcggcaagatccagaagttcaagctgagagagcagatggagagacacctgaacctgtag

SEQ ID NO: 71685 - DNA, 1809 bp, Artificial Sequence
  Description of Artificial Sequence: Synthetic coding sequence
atggccgtgtacgtgggcatgctgagactgggcagactgtgcgccggcagcagcggcgtgctgggcgccagagccgccctgagcagaagctggcaggaggccagactgcagggcgtgagattcctgagcagcagagaggtggacagaatggtgagcacccccatcggcggcctgagctacgtgcagggctgcaccaagaagcacctgaacagcaagaccgtgggccagtgcctggagaccaccgcccagagagtgcccgagagagaggccctggtggtgctgcacgaggacgtgagactgaccttcgcccagctgaaggaggaggtggacaaggccgccagcggcctgctgagcatcggcctgtgcaagggcgacagactgggcatgtggggccccaacagctacgcctgggtgctgatgcagctggccaccgcccaggccatggagctggagtacgtgctgaagaaggtgggctgcaaggccctggtgttccccaagcagttcaagacccagcagtactacaacgtgctgaagcagatctgccccgaggtggagaacgcccagcccggcgccctgaagagccagagactgcccgacctgaccaccgtgatcagcgtggacgcccccctgcccggcaccctgctgctggacgaggtggtggccgccggcagcaccagacagcacctggaccagctgcagtacaaccagcagttcctgagctgccacgaccccatcaacatccagttcaccagcggcaccaccggcagccccaagggcgccaccctgagccactacaacatcgtgaacaacagcaacatcctgggcgagagactgaagctgcacgagaagacccccgagcagctgagaatgatcctgcccaaccccctgtaccactgcctgggcagcgtggccggcaccatgatgtgcctgatgtacggcgccaccctgatcctggccagccccatcttcaacggcaagaaggccctggaggccatcagcagagagagaggcaccttcctgtacggcacccccaccatgttcgtggacatcctgaaccagcccgacttcagcagctacgacatcagcaccatgtgcggcggcgtgatcgccggcagccccgccccccccgagctgatcagagccatcatcaacaagatcaacatgaaggacctggtggtggcctacggcaccaccgagaacagccccgtgaccttcgcccacttccccgaggacaccgtggagcagaaggccgagagcgtgggcagaatcatgccccacaccgaggccagaatcatgaacatggaggccggcaccctggccaagctgaacacccccggcgagctgtgcatcagaggctactgcgtgatgctgggctactggggcgagccccagaagaccgaggaggccgtggaccaggacaagtggtactggaccggcgacgtggccaccatgaacgagcagggcttctgcaagatcgtgggcagaagcaaggacatgatcatcagaggcggcgagaacatctaccccgccgagctggaggacttcttccacacccaccccaaggtgcaggaggtgcaggtggtgggcgtgaaggacgacagaatgggcgaggagatctgcgcctgcatcagactgaaggacggcgaggagaccaccgtggaggagatcaaggccttctgcaagggcaagatcagccacttcaagatccccaagtacatcgtgttcgtgaccaactaccccctgaccatcagcggcaagatccagaagttcaagctgagagagcagatggagagacacctgaacctgtag

SEQ ID NO: 71686 - DNA, 1719 bp, Artificial Sequence
  Description of Artificial Sequence: Synthetic coding sequence
atggccgtgtacgtgggcatgctgagactgggcagactgtgcgccggcagcagcggcgtgctgggcgccagagccgccctgagcagaagctggcaggaggccagactgcagggcgtgagattcctgagcagcagagaggtggacagaatggtgagcacccccatcggcggcctgagctacgtgcagggctgcaccaagaagcacctgaacagcaagaccgtgggccagtgcctggagaccaccgcccagagagtgcccgagagagaggccctggtggtgctgcacgaggacgtgagactgaccttcgcccagctgaaggaggaggtgagcgtgaaccccgcctaccaggccatggagctggagtacgtgctgaagaaggtgggctgcaaggccctggtgttccccaagcagttcaagacccagcagtactacaacgtgctgaagcagatctgccccgaggtggagaacgcccagcccggcgccctgaagagccagagactgcccgacctgaccaccgtgatcagcgtggacgcccccctgcccggcaccctgctgctggacgaggtggtggccgccggcagcaccagacagcacctggaccagctgcagtacaaccagcagttcctgagctgccacgaccccatcaacatccagttcaccagcggcaccaccggcagccccaagggcgccaccctgagccactacaacatcgtgaacaacagcaacatcctgggcgagagactgaagctgcacgagaagacccccgagcagctgagaatgatcctgcccaaccccctgtaccactgcctgggcagcgtggccggcaccatgatgtgcctgatgtacggcgccaccctgatcctggccagccccatcttcaacggcaagaaggccctggaggccatcagcagagagagaggcaccttcctgtacggcacccccaccatgttcgtggacatcctgaaccagcccgacttcagcagctacgacatcagcaccatgtgcggcggcgtgatcgccggcagccccgccccccccgagctgatcagagccatcatcaacaagatcaacatgaaggacctggtggtggcctacggcaccaccgagaacagccccgtgaccttcgcccacttccccgaggacaccgtggagcagaaggccgagagcgtgggcagaatcatgccccacaccgaggccagaatcatgaacatggaggccggcaccctggccaagctgaacacccccggcgagctgtgcatcagaggctactgcgtgatgctgggctactggggcgagccccagaagaccgaggaggccgtggaccaggacaagtggtactggaccggcgacgtggccaccatgaacgagcagggcttctgcaagatcgtgggcagaagcaaggacatgatcatcagaggcggcgagaacatctaccccgccgagctggaggacttcttccacacccaccccaaggtgcaggaggtgcaggtggtgggcgtgaaggacgacagaatgggcgaggagatctgcgcctgcatcagactgaaggacggcgaggagaccaccgtggaggagatcaaggccttctgcaagggcaagatcagccacttcaagatccccaagtacatcgtgttcgtgaccaactaccccctgaccatcagcggcaagatccagaagttcaagctgagagagcagatggagagacacctgaacctgtag

SEQ ID NO: 71687 - DNA, 1368 bp, Artificial Sequence
  Description of Artificial Sequence: Synthetic coding sequence
atggagctggagtacgtgctgaagaaggtgggctgcaaggccctggtgttccccaagcagttcaagacccagcagtactacaacgtgctgaagcagatctgccccgaggtggagaacgcccagcccggcgccctgaagagccagagactgcccgacctgaccaccgtgatcagcgtggacgcccccctgcccggcaccctgctgctggacgaggtggtggccgccggcagcaccagacagcacctggaccagctgcagtacaaccagcagttcctgagctgccacgaccccatcaacatccagttcaccagcggcaccaccggcagccccaagggcgccaccctgagccactacaacatcgtgaacaacagcaacatcctgggcgagagactgaagctgcacgagaagacccccgagcagctgagaatgatcctgcccaaccccctgtaccactgcctgggcagcgtggccggcaccatgatgtgcctgatgtacggcgccaccctgatcctggccagccccatcttcaacggcaagaaggccctggaggccatcagcagagagagaggcaccttcctgtacggcacccccaccatgttcgtggacatcctgaaccagcccgacttcagcagctacgacatcagcaccatgtgcggcggcgtgatcgccggcagccccgccccccccgagctgatcagagccatcatcaacaagatcaacatgaaggacctggtggtggcctacggcaccaccgagaacagccccgtgaccttcgcccacttccccgaggacaccgtggagcagaaggccgagagcgtgggcagaatcatgccccacaccgaggccagaatcatgaacatggaggccggcaccctggccaagctgaacacccccggcgagctgtgcatcagaggctactgcgtgatgctgggctactggggcgagccccagaagaccgaggaggccgtggaccaggacaagtggtactggaccggcgacgtggccaccatgaacgagcagggcttctgcaagatcgtgggcagaagcaaggacatgatcatcagaggcggcgagaacatctaccccgccgagctggaggacttcttccacacccaccccaaggtgcaggaggtgcaggtggtgggcgtgaaggacgacagaatgggcgaggagatctgcgcctgcatcagactgaaggacggcgaggagaccaccgtggaggagatcaaggccttctgcaagggcaagatcagccacttcaagatccccaagtacatcgtgttcgtgaccaactaccccctgaccatcagcggcaagatccagaagttcaagctgagagagcagatggagagacacctgaacctgtag

SEQ ID NO: 71688 - DNA, 1731 bp, Artificial Sequence
  Description of Artificial Sequence: Synthetic coding sequence
atgctgccccacgtggtgctgaccttcagaagactgggctgcgccctggccagctgcagactggcccccgccagacacagaggcagcggcctgctgcacaccgcccccgtggccagaagcgacagaagcgcccccgtgttcaccagagccctggccttcggcgacagaatcgccctggtggaccagcacggcagacacacctacagagagctgtacagcagaagcctgagactgagccaggagatctgcagactgtgcggctgcgtgggcggcgacctgagagaggagagagtgagcttcctgtgcgccaacgacgccagctacgtggtggcccagtgggccagctggatgagcggcggcgtggccgtgcccctgtacagaaagcaccccgccgcccagctggagtacgtgatctgcgacagccagagcagcgtggtgctggccagccaggagtacctggagctgctgagccccgtggtgagaaagctgggcgtgcccctgctgcccctgacccccgccatctacaccggcgccgtggaggagcccgccgaggtgcccgtgcccgagcagggctggagaaacaagggcgccatgatcatctacaccagcggcaccaccggcagacccaagggcgtgctgagcacccaccagaacatcagagccgtggtgaccggcctggtgcacaagtgggcctggaccaaggacgacgtgatcctgcacgtgctgcccctgcaccacgtgcacggcgtggtgaacgccctgctgtgccccctgtgggtgggcgccacctgcgtgatgatgcccgagttcagcccccagcaggtgtgggagaagttcctgagcagcgagacccccagaatcaacgtgttcatggccgtgcccaccatctacaccaagctgatggagtactacgacagacacttcacccagccccacgcccaggacttcctgagagccgtgtgcgaggagaagatcagactgatggtgagcggcagcgccgccctgcccctgcccgtgctggagaagtggaagaacatcaccggccacaccctgctggagagatacggcatgaccgagatcggcatggccctgagcggccccctgaccaccgccgtgagactgcccggcagcgtgggcacccccctgcccggcgtgcaggtgagaatcgtgagcgagaacccccagagagaggcctgcagctacaccatccacgccgagggcgacgagagaggcaccaaggtgacccccggcttcgaggagaaggagggcgagctgctggtgagaggccccagcgtgttcagagagtactggaacaagcccgaggagaccaagagcgccttcaccctggacggctggttcaagaccggcgacaccgtggtgttcaaggacggccagtactggatcagaggcagaaccagcgtggacatcatcaagaccggcggctacaaggtgagcgccctggaggtggagtggcacctgctggcccaccccagcatcaccgacgtggccgtgatcggcgtgcccgacatgacctggggccagagagtgaccgccgtggtgaccctgagagagggccacagcctgagccacagagagctgaaggagtgggccagaaacgtgctggccccctacgccgtgcccagcgagctggtgctggtggaggagatccccagaaaccagatgggcaagatcgacaagaaggccctgatcagacacttccaccccagctag

SEQ ID NO: 71689 - DNA, 1731 bp, Artificial Sequence; identical to SEQ ID NO: 71688
  Description of Artificial Sequence: Synthetic coding sequence

SEQ ID NO: 71690 - DNA, 714 bp, Artificial Sequence
  Description of Artificial Sequence: Synthetic coding sequence
atgctgccccacgtggtgctgaccttcagaagactgggctgcgccctggccagctgcagactggcccccgccagacacagaggcagcggcctgctgcacaccgcccccgtggccagaagcgacagaagcgcccccgtgttcaccagagccctggccttcggcgacagaatcgccctggtggaccagcacggcagacacacctacagagagctgtacagcagaagcctgagactgagccaggagatctgcagactgtgcggctgcgtgggcggcgacctgagagaggagagagtgagcttcctgtgcgccaacgacgccagctacgtggtggcccagtgggccagctggatgagcggcggcgtggccgtgcccctgtacagaaagcaccccgccgcccagctggagtacgtgatctgcgacagccagagcagcgtggtgctggccagccaggagtacctggagctgctgagccccgtggtgagaaagctgggcgtgcccctgctgcccctgacccccgccatctacaccggcgccgtggaggagcccgccgaggtgcccgtgcccgagcagggctggagaaacaagggcgccatgatcatctacaccagcggcaccaccggcagacccaagggcgtgctgagcacccaccagaacatcagagccgtggtgaccggcctggtgcacaagtgggcctggaccaaggacgacgtgtag

SEQ ID NO: 71691 - DNA, 2097 bp, Artificial Sequence
  Description of Artificial Sequence: Synthetic coding sequence
atgcaggcccacgagctgttcagatacttcagaatgcccgagctggtggacttcagacagtacgtgagaaccctgcccaccaacaccctgatgggcttcggcgccttcgccgccctgaccaccttctggtacgccaccagacccaagcccctgaagcccccctgcgacctgagcatgcagagcgtggaggtggccggcagcggcggcgccagaagaagcgccctgctggacagcgacgagcccctggtgtacttctacgacgacgtgaccaccctgtacgagggcttccagagaggcatccaggtgagcaacaacggcccctgcctgggcagcagaaagcccgaccagccctacgagtggctgagctacaagcaggtggccgagctgagcgagtgcatcggcagcgccctgatccagaagggcttcaagaccgcccccgaccagttcatcggcatcttcgcccagaacagacccgagtgggtgatcatcgagcagggctgcttcgcctacagcatggtgatcgtgcccctgtacgacaccctgggcaacgaggccatcacctacatcgtgaacaaggccgagctgagcctggtgttcgtggacaagcccgagaaggccaagctgctgctggagggcgtggagaacaagctgatccccggcctgaagatcatcgtggtgatggacgcctacggcagcgagctggtggagagaggccagagatgcggcgtggaggtgaccagcatgaaggccatggaggacctgggcagagccaacagaagaaagcccaagccccccgcccccgaggacctggccgtgatctgcttcaccagcggcaccaccggcaaccccaagggcgccatggtgacccacagaaacatcgtgagcgactgcagcgccttcgtgaaggccaccgagaacaccgtgaacccctgccccgacgacaccctgatcagcttcctgcccctggcccacatgttcgagagagtggtggagtgcgtgatgctgtgccacggcgccaagatcggcttcttccagggcgacatcagactgctgatggacgacctgaaggtgctgcagcccaccgtgttccccgtggtgcccagactgctgaacagaatgttcgacagaatcttcggccaggccaacaccaccctgaagagatggctgctggacttcgccagcaagagaaaggaggccgagctgagaagcggcatcatcagaaacaacagcctgtgggacagactgatcttccacaaggtgcagagcagcctgggcggcagagtgagactgatggtgaccggcgccgcccccgtgagcgccaccgtgctgaccttcctgagagccgccctgggctgccagttctacgagggctacggccagaccgagtgcaccgccggctgctgcctgaccatgcccggcgactggaccgccggccacgtgggcgcccccatgccctgcaacctgatcaagctggtggacgtggaggagatgaactacatggccgccgagggcgagggcgaggtgtgcgtgaagggccccaacgtgttccagggctacctgaaggaccccgccaagaccgccgaggccctggacaaggacggctggctgcacaccggcgacatcggcaagtggctgcccaacggcaccctgaagatcatcgacagaaagaagcacatcttcaagctggcccagggcgagtacatcgcccccgagaagatcgagaacatctacatgagaagcgagcccgtggcccaggtgttcgtgcacggcgagagcctgcaggccttcctgatcgccatcgtggtgcccgacgtggagaccctgtgcagctgggcccagaagagaggcttcgagggcagcttcgaggagctgtgcagaaacaaggacgtgaagaaggccatcctggaggacatggtgagactgggcaaggacagcggcctgaagcccttcgagcaggtgaagggcatcaccctgcaccccgagctgttcagcatcgacaacggcctgctgacccccaccatgaaggccaagagacccgagctgagaaactacttcagaagccagatcgacgacctgtacagcaccatcaaggtgtag

SEQ ID NO: 71692 - DNA, 1584 bp, Artificial Sequence
  Description of Artificial Sequence: Synthetic coding sequence
atggtgatcgtgcccctgtacgacaccctgggcaacgaggccatcacctacatcgtgaacaaggccgagctgagcctggtgttcgtggacaagcccgagaaggccaagctgctgctggagggcgtggagaacaagctgatccccggcctgaagatcatcgtggtgatggacgcctacggcagcgagctggtggagagaggccagagatgcggcgtggaggtgaccagcatgaaggccatggaggacctgggcagagccaacagaagaaagcccaagccccccgcccccgaggacctggccgtgatctgcttcaccagcggcaccaccggcaaccccaagggcgccatggtgacccacagaaacatcgtgagcgactgcagcgccttcgtgaaggccaccgagaacaccgtgaacccctgccccgacgacaccctgatcagcttcctgcccctggcccacatgttcgagagagtggtggagtgcgtgatgctgtgccacggcgccaagatcggcttcttccagggcgacatcagactgctgatggacgacctgaaggtgctgcagcccaccgtgttccccgtggtgcccagactgctgaacagaatgttcgacagaatcttcggccaggccaacaccaccctgaagagatggctgctggacttcgccagcaagagaaaggaggccgagctgagaagcggcatcatcagaaacaacagcctgtgggacagactgatcttccacaaggtgcagagcagcctgggcggcagagtgagactgatggtgaccggcgccgcccccgtgagcgccaccgtgctgaccttcctgagagccgccctgggctgccagttctacgagggctacggccagaccgagtgcaccgccggctgctgcctgaccatgcccggcgactggaccgccggccacgtgggcgcccccatgccctgcaacctgatcaagctggtggacgtggaggagatgaactacatggccgccgagggcgagggcgaggtgtgcgtgaagggccccaacgtgttccagggctacctgaaggaccccgccaagaccgccgaggccctggacaaggacggctggctgcacaccggcgacatcggcaagtggctgcccaacggcaccctgaagatcatcgacagaaagaagcacatcttcaagctggcccagggcgagtacatcgcccccgagaagatcgagaacatctacatgagaagcgagcccgtggcccaggtgttcgtgcacggcgagagcctgcaggccttcctgatcgccatcgtggtgcccgacgtggagaccctgtgcagctgggcccagaagagaggcttcgagggcagcttcgaggagctgtgcagaaacaaggacgtgaagaaggccatcctggaggacatggtgagactgggcaaggacagcggcctgaagcccttcgagcaggtgaagggcatcaccctgcaccccgagctgttcagcatcgacaacggcctgctgacccccaccatgaaggccaagagacccgagctgagaaactacttcagaagccagatcgacgacctgtacagcaccatcaaggtgtag

SEQ ID NO: 71693 - DNA, 1584 bp, Artificial Sequence; identical to SEQ ID NO: 71692
  Description of Artificial Sequence: Synthetic coding sequence

SEQ ID NO: 71694 - DNA, 2097 bp, Artificial Sequence; identical to SEQ ID NO: 71691
  Description of Artificial Sequence: Synthetic coding sequence

SEQ ID NO: 71695 - DNA, 1995 bp, Artificial Sequence
  Description of Artificial Sequence: Synthetic coding sequence
atgcaggcccacgagctgttcagatacttcagaatgcccgagctggtggacttcagacagtacgtgagaaccctgcccaccaacaccctgatgggcttcggcgccttcgccgccctgaccaccttctggtacgccaccagacccaagcccctgaagcccccctgcgacctgagcatgcagagcgtggaggtggccggcagcggcggcgccagaagaagcgccctgctggacagcgacgagcccctggtgtacttctacgacgacgtgaccaccctgtacgagggcttccagagaggcatccaggtgagcaacaacggcccctgcctgggcagcagaaagcccgaccagccctacgagtggctgagctacaagcagtgggtgatcatcgagcagggctgcttcgcctacagcatggtgatcgtgcccctgtacgacaccctgggcaacgaggccatcacctacatcgtgaacaaggccgagctgagcctggtgttcgtggacaagcccgagaaggccaagctgctgctggagggcgtggagaacaagctgatccccggcctgaagatcatcgtggtgatggacgcctacggcagcgagctggtggagagaggccagagatgcggcgtggaggtgaccagcatgaaggccatggaggacctgggcagagccaacagaagaaagcccaagccccccgcccccgaggacctggccgtgatctgcttcaccagcggcaccaccggcaaccccaagggcgccatggtgacccacagaaacatcgtgagcgactgcagcgccttcgtgaaggccaccgagaacaccgtgaacccctgccccgacgacaccctgatcagcttcctgcccctggcccacatgttcgagagagtggtggagtgcgtgatgctgtgccacggcgccaagatcggcttcttccagggcgacatcagactgctgatggacgacctgaaggtgctgcagcccaccgtgttccccgtggtgcccagactgctgaacagaatgttcgacagaatcttcggccaggccaacaccaccctgaagagatggctgctggacttcgccagcaagagaaaggaggccgagctgagaagcggcatcatcagaaacaacagcctgtgggacagactgatcttccacaaggtgcagagcagcctgggcggcagagtgagactgatggtgaccggcgccgcccccgtgagcgccaccgtgctgaccttcctgagagccgccctgggctgccagttctacgagggctacggccagaccgagtgcaccgccggctgctgcctgaccatgcccggcgactggaccgccggccacgtgggcgcccccatgccctgcaacctgatcaagctggtggacgtggaggagatgaactacatggccgccgagggcgagggcgaggtgtgcgtgaagggccccaacgtgttccagggctacctgaaggaccccgccaagaccgccgaggccctggacaaggacggctggctgcacaccggcgacatcggcaagtggctgcccaacggcaccctgaagatcatcgacagaaagaagcacatcttcaagctggcccagggcgagtacatcgcccccgagaagatcgagaacatctacatgagaagcgagcccgtggcccaggtgttcgtgcacggcgagagcctgcaggccttcctgatcgccatcgtggtgcccgacgtggagaccctgtgcagctgggcccagaagagaggcttcgagggcagcttcgaggagctgtgcagaaacaaggacgtgaagaaggccatcctggaggacatggtgagactgggcaaggacagcggcctgaagcccttcgagcaggtgaagggcatcaccctgcaccccgagctgttcagcatcgacaacggcctgctgacccccaccatgaaggccaagagacccgagctgagaaactacttcagaagccagatcgacgacctgtacagcaccatcaaggtgtag

SEQ ID NO: 71696 - DNA, 2097 bp, Artificial Sequence; identical to SEQ ID NO: 71691
  Description of Artificial Sequence: Synthetic coding sequence

SEQ ID NO: 71697 - DNA, 2163 bp, Artificial Sequence
  Description of Artificial Sequence: Synthetic coding sequence
atgaacaaccacgtgagcagcaagcccagcaccatgaagctgaagcacaccatcaaccccatcctgctgtacttcatccacttcctgatcagcctgtacaccatcctgacctacatccccttctacttcttcagcgagagcagacaggagaagagcaacagaatcaaggccaagcccgtgaacagcaagcccgacagcgcctacagaagcgtgaacagcctggacggcctggccagcgtgctgtaccccggctgcgacaccctggacaaggtgttcacctacgccaagaacaagttcaagaacaagagactgctgggcaccagagaggtgctgaacgaggaggacgaggtgcagcccaacggcaagatcttcaagaaggtgatcctgggccagtacaactggctgagctacgaggacgtgttcgtgagagccttcaacttcggcaacggcctgcagatgctgggccagaagcccaagaccaacatcgccatcttctgcgagaccagagccgagtggatgatcgccgcccaggcctgcttcatgtacaacttccagctggtgaccctgtacgccaccctgggcggccccgccatcgtgcacgccctgaacgagaccgaggtgaccaacatcatcaccagcaaggagctgctgcagaccaagctgaaggacatcgtgagcctggtgcccagactgagacacatcatcaccgtggacggcaagccccccacctggagcgagttccccaagggcatcatcgtgcacaccatggccgccgtggaggccctgggcgccaaggccagcatggagaaccagccccacagcaagcccctgcccagcgacatcgccgtgatcatgtacaccagcggcagcaccggcctgcccaagggcgtgatgatcagccacagcaacatcatcgccggcatcaccggcatggccgagagaatccccgagctgggcgaggaggacgtgtacatcggctacctgcccctggcccacgtgctggagctgagcgccgagctggtgtgcctgagccacggctgcagaatcggctacagcagcccccagaccctggccgaccagagcagcaagatcaagaagggcagcaagggcgacaccagcatgctgaagcccaccctgatggccgccgtgcccgagatcatggacagaatctacaagaacgtgatgaacaaggtgagcgagatgagcagcttccagagaaacctgttcatcctggcctacaactacaagatggagcagatcagcaagggcagaaacacccccctgtgcgacagcttcgtgttcagaaaggtgagaagcctgctgggcggcaacatcagactgctgctgtgcggcggcgcccccctgagcgccaccacccagagattcatgaacatctgcttctgctgccccgtgggccagggctacggcctgaccgagagcgccggcgccggcaccatcagcgaggtgtgggactacaacaccggcagagtgggcgcccccctggtgtgctgcgagatcaagctgaagaactgggaggagggcggctacttcaacaccgacaagccccaccccagaggcgagatcctgatcggcggccagagcgtgaccatgggctactacaagaacgaggccaagaccaaggccgacttcttcgaggacgagaacggccagagatggctgtgcaccggcgacatcggcgagttcgagcccgacggctgcctgaagatcatcgacagaaagaaggacctggtgaagctgcaggccggcgagtacgtgagcctgggcaaggtggaggccgccctgaagaacctgcccctggtggacaacatctgcgcctacgccaacagctaccacagctacgtgatcggcttcgtggtgcccaaccagaaggagctgaccgagctggccagaaagaagggcctgaagggcacctgggaggagctgtgcaacagctgcgagatggagaacgaggtgctgaaggtgctgagcgaggccgccatcagcgccagcctggagaagttcgagatccccgtgaagatcagactgagccccgagccctggacccccgagaccggcctggtgaccgacgccttcaagctgaagagaaaggagctgaagacccactaccaggccgacatcgagagaatgtacggcagaaagtag

SEQ ID NO: 71698 - DNA, 2163 bp, Artificial Sequence; identical to SEQ ID NO: 71697
  Description of Artificial Sequence: Synthetic coding sequence

SEQ ID NO: 71699 - DNA, 267 bp, Artificial Sequence
  Description of Artificial Sequence: Synthetic coding sequence
atgaacaaccacgtgagcagcaagcccagcaccatgaagctgaagcacaccatcaaccccatcctgctgtacttcatccacttcctgatcagcctgtacaccatcctgacctacatccccttctacttcttcagcgagagcagacaggagaagagcaacagaatcaaggccaagcccgtgaacagcaagcccgacagcgcctacagaagcgtgaacagcctggacggcctggccagcgtgctgtaccccggctgcgacaccctgtag

SEQ ID NO: 71700 - DNA, 288 bp, Artificial Sequence
  Description of Artificial Sequence: Synthetic coding sequence
atgaacaaccacgtgagcagcaagcccagcaccatgaagctgaagcacaccatcaaccccatcctgctgtacttcatccacttcctgatcagcctgtacaccatcctgacctacatccccttctacttcttcagcgagagcagacaggagaagagcaacagaatcaaggccaagcccgtgaacagcaagcccgacagcgcctacagaagcgtgaacagcctggacggcctggccagcgtgctgtaccccggctgcgacaccctggacaaggtgttcacctacgcctag

SEQ ID NO: 71701 - DNA, 2052 bp, Artificial Sequence
  Description of Artificial Sequence: Synthetic coding sequence
atgctgttcatcttcaacttcctgttcagccccctgcccacccccgccctgatctgcatcctgaccttcggcgccgccatcttcctgtggctgatcaccagaccccagcccgtgctgcccctgctggacctgaacaaccagagcgtgggcatcgagggcggcgccagaaagggcgtgagccagaagaacaacgacctgaccagctgctgcttcagcgacgccaagaccatgtacgaggtgttccagagaggcctggccgtgagcgacaacggcccctgcctgggctacagaaagcccaaccagccctacagatggctgagctacaagcaggtgagcgacagagccgagtacctgggcagctgcctgctgcacaagggctacaagagcagccccgaccagttcgtgggcatcttcgcccagaacagacccgagtggatcatcagcgagctggcctgctacacctacagcatggtggccgtgcccctgtacgacaccctgggccccgaggccatcgtgcacatcgtgaacaaggccgacatcgccatggtgatctgcgacaccccccagaaggccctggtgctgatcggcaacgtggagaagggcttcacccccagcctgaaggtgatcatcctgatggaccccttcgacgacgacctgaagcagagaggcgagaagagcggcatcgagatcctgagcctgtacgacgccgagaacctgggcaaggagcacttcagaaagcccgtgccccccagccccgaggacctgagcgtgatctgcttcaccagcggcaccaccggcgaccccaagggcgccatgatcacccaccagaacatcgtgagcaacgccgccgccttcctgaagtgcgtggagcacgcctacgagcccacccccgacgacgtggccatcagctacctgcccctggcccacatgttcgagagaatcgtgcaggccgtggtgtacagctgcggcgccagagtgggcttcttccagggcgacatcagactgctggccgacgacatgaagaccctgaagcccaccctgttccccgccgtgcccagactgctgaacagaatctacgacaaggtgcagaacgaggccaagacccccctgaagaagttcctgctgaagctggccgtgagcagcaagttcaaggagctgcagaagggcatcatcagacacgacagcttctgggacaagctgatcttcgccaagatccaggacagcctgggcggcagagtgagagtgatcgtgaccggcgccgcccccatgagcaccagcgtgatgaccttcttcagagccgccatgggctgccaggtgtacgaggcctacggccagaccgagtgcaccggcggctgcaccttcaccctgcccggcgactggaccagcggccacgtgggcgtgcccctggcctgcaactacgtgaagctggaggacgtggccgacatgaactacttcaccgtgaacaacgagggcgaggtgtgcatcaagggcaccaacgtgttcaagggctacctgaaggaccccgagaagacccaggaggccctggacagcgacggctggctgcacaccggcgacatcggcagatggctgcccaacggcaccctgaagatcatcgacagaaagaagaacatcttcaagctggcccagggcgagtacatcgcccccgagaagatcgagaacatctacaacagaagccagcccgtgctgcagatcttcgtgcacggcgagagcctgagaagcagcctggtgggcgtggtggtgcccgacaccgacgtgctgcccagcttcgccgccaagctgggcgtgaagggcagcttcgaggagctgtgccagaaccaggtggtgagagaggccatcctggaggacctgcagaagatcggcaaggagagcggcctgaagaccttcgagcaggtgaaggccatcttcctgcaccccgagcccttcagcatcgagaacggcctgctgacccccaccctgaaggccaagagaggcgagctgagcaagtacttcagaacccagatcgacagcctgtacgagcacatccaggactag

SEQ ID NO: 71702 - DNA, 2052 bp, Artificial Sequence; identical to SEQ ID NO: 71701
  Description of Artificial Sequence: Synthetic coding sequence

SEQ ID NO: 71703 - DNA, 2220 bp, Artificial Sequence
  Description of Artificial Sequence: Synthetic coding sequence
atggacgccctgaagcccccctgcctgtggagaaaccacgagagaggcaagaaggacagagacagctgcggcagaaagaacagcgagcccggcagcccccacagcctggaggccctgagagacgccgcccccagccagggcctgaacttcctgctgctgttcaccaagatgctgttcatcttcaacttcctgttcagccccctgcccacccccgccctgatctgcatcctgaccttcggcgccgccatcttcctgtggctgatcaccagaccccagcccgtgctgcccctgctggacctgaacaaccagagcgtgggcatcgagggcggcgccagaaagggcgtgagccagaagaacaacgacctgaccagctgctgcttcagcgacgccaagaccatgtacgaggtgttccagagaggcctggccgtgagcgacaacggcccctgcctgggctacagaaagcccaaccagccctacagatggctgagctacaagcaggtgagcgacagagccgagtacctgggcagctgcctgctgcacaagggctacaagagcagccccgaccagttcgtgggcatcttcgcccagaacagacccgagtggatcatcagcgagctggcctgctacacctacagcatggtggccgtgcccctgtacgacaccctgggccccgaggccatcgtgcacatcgtgaacaaggccgacatcgccatggtgatctgcgacaccccccagaaggccctggtgctgatcggcaacgtggagaagggcttcacccccagcctgaaggtgatcatcctgatggaccccttcgacgacgacctgaagcagagaggcgagaagagcggcatcgagatcctgagcctgtacgacgccgagaacctgggcaaggagcacttcagaaagcccgtgccccccagccccgaggacctgagcgtgatctgcttcaccagcggcaccaccggcgaccccaagggcgccatgatcacccaccagaacatcgtgagcaacgccgccgccttcctgaagtgcgtggagcacgcctacgagcccacccccgacgacgtggccatcagctacctgcccctggcccacatgttcgagagaatcgtgcaggccgtggtgtacagctgcggcgccagagtgggcttcttccagggcgacatcagactgctggccgacgacatgaagaccctgaagcccaccctgttccccgccgtgcccagactgctgaacagaatctacgacaaggtgcagaacgaggccaagacccccctgaagaagttcctgctgaagctggccgtgagcagcaagttcaaggagctgcagaagggcatcatcagacacgacagcttctgggacaagctgatcttcgccaagatccaggacagcctgggcggcagagtgagagtgatcgtgaccggcgccgcccccatgagcaccagcgtgatgaccttcttcagagccgccatgggctgccaggtgtacgaggcctacggccagaccgagtgcaccggcggctgcaccttcaccctgcccggcgactggaccagcggccacgtgggcgtgcccctggcctgcaactacgtgaagctggaggacgtggccgacatgaactacttcaccgtgaacaacgagggcgaggtgtgcatcaagggcaccaacgtgttcaagggctacctgaaggaccccgagaagacccaggaggccctggacagcgacggctggctgcacaccggcgacatcggcagatggctgcccaacggcaccctgaagatcatcgacagaaagaagaacatcttcaagctggcccagggcgagtacatcgcccccgagaagatcgagaacatctacaacagaagccagcccgtgctgcagatcttcgtgcacggcgagagcctgagaagcagcctggtgggcgtggtggtgcccgacaccgacgtgctgcccagcttcgccgccaagctgggcgtgaagggcagcttcgaggagctgtgccagaaccaggtggtgagagaggccatcctggaggacctgcagaagatcggcaaggagagcggcctgaagaccttcgagcaggtgaaggccatcttcctgcaccccgagcccttcagcatcgagaacggcctgctgacccccaccctgaaggccaagagaggcgagctgagcaagtacttcagaacccagatcgacagcctgtacgagcacatccaggactag

SEQ ID NO: 71704 - DNA, 1398 bp, Artificial Sequence
  Description of Artificial Sequence: Synthetic coding sequence
atgctgttccccggcgccagcatcgtgcccgagtgctggctgctggtgctgatccagaacctgggcaaggagcacttcagaaagcccgtgccccccagccccgaggacctgagcgtgatctgcttcaccagcggcaccaccggcgaccccaagggcgccatgatcacccaccagaacatcgtgagcaacgccgccgccttcctgaagtgcgtggagcacgcctacgagcccacccccgacgacgtggccatcagctacctgcccctggcccacatgttcgagagaatcgtgcaggccgtggtgtacagctgcggcgccagagtgggcttcttccagggcgacatcagactgctggccgacgacatgaagaccctgaagcccaccctgttccccgccgtgcccagactgctgaacagaatctacgacaaggtgcagaacgaggccaagacccccctgaagaagttcctgctgaagctggccgtgagcagcaagttcaaggagctgcagaagggcatcatcagacacgacagcttctgggacaagctgatcttcgccaagatccaggacagcctgggcggcagagtgagagtgatcgtgaccggcgccgcccccatgagcaccagcgtgatgaccttcttcagagccgccatgggctgccaggtgtacgaggcctacggccagaccgagtgcaccggcggctgcaccttcaccctgcccggcgactggaccagcggccacgtgggcgtgcccctggcctgcaactacgtgaagctggaggacgtggccgacatgaactacttcaccgtgaacaacgagggcgaggtgtgcatcaagggcaccaacgtgttcaagggctacctgaaggaccccgagaagacccaggaggccctggacagcgacggctggctgcacaccggcgacatcggcagatggctgcccaacggcaccctgaagatcatcgacagaaagaagaacatcttcaagctggcccagggcgagtacatcgcccccgagaagatcgagaacatctacaacagaagccagcccgtgctgcagatcttcgtgcacggcgagagcctgagaagcagcctggtgggcgtggtggtgcccgacaccgacgtgctgcccagcttcgccgccaagctgggcgtgaagggcagcttcgaggagctgtgccagaaccaggtggtgagagaggccatcctggaggacctgcagaagatcggcaaggagagcggcctgaagaccttcgagcaggtgaaggccatcttcctgcaccccgagcccttcagcatcgagaacggcctgctgacccccaccctgaaggccaagagaggcgagctgagcaagtacttcagaacccagatcgacagcctgtacgagcacatccaggactag

SEQ ID NO: 71705 - DNA, 2052 bp, Artificial Sequence; identical to SEQ ID NO: 71701
  Description of Artificial Sequence: Synthetic coding sequence

SEQ ID NO: 71706 - DNA, 1980 bp, Artificial Sequence
  Description of Artificial Sequence: Synthetic coding sequence
atgctgttcatcttcaacttcctgttcagccccctgcccacccccgccctgatctgcatcctgaccttcggcgccgccatcttcctgtggctgatcaccagaccccagcccgtgctgcccctgctggacctgaacaaccagagcgtgggcatcgagggcggcgccagaaagggcgtgagccagaagaacaacgacctgaccagctgctgcttcagcgacgccaagaccatgtacgaggtgttccagagaggcctggccgtgagcgacaacggcccctgcctgggctacagaaagcccaaccagccctacagatggctgagctacaagcaggtgagcgacagagccgagtacctgggcagctgcctgctgcacaagggctacaagagcagccccgaccagttcgtgggcatcttcgcccagaacagacccgagtggatcatcagcgagctggcctgctacacctacagcatggtggccgtgcccctgtacgacaccctgggccccgaggccatcgtgcacatcgtgaacaaggccgacatcgccatggtgatctgcgacaccccccagaaggccctggtgctgatcggcaacgtggagaagggcttcacccccagcctgaaggtgatcatcctgatggaccccttcgacgacgacctgaagcagagaggcgagaagagcggcatcgagatcctgagcctgtacgacgccgagaacctgggcaaggagcacttcagaaagcccgtgccccccagccccgaggacctgagcgtgatctgcttcaccagcggcaccaccggcgaccccaagggcgccatgatcacccaccagaacatcgtgagcaacgccgccgccttcctgaagtgcgtggagcacgcctacgagcccacccccgacgacgtggccatcagctacctgcccctggcccacatgttcgagagaatcgtgcaggccgtggtgtacagctgcggcgccagagtgggcttcttccagggcgacatcagactgctggccgacgacatgaagaccctgaagcccaccctgttccccgccgtgcccagactgctgaacagaatctacgacaaggtgcagaacgaggccaagacccccctgaagaagttcctgctgaagctggccgtgagcagcaagttcaaggagctgcagaagggcatcatcagacacgacagcttctgggacaagctgatcttcgccaagatccaggacagcctgggcggcagagtgagagtgatcgtgaccggcgccgcccccatgagcaccagcgtgatgaccttcttcagagccgccatgggctgccaggtgtacgaggcctacggccagaccgagtgcaccggcggctgcaccttcaccctgcccggcgactggaccagcggccacgtgggcgtgcccctggcctgcaactacgtgaagctggaggacgtggccgacatgaactacttcaccgtgaacaacgagggcgaggtgtgcatcaagggcaccaacgtgttcaagggctacctgaaggaccccgagaagacccaggaggccctggacagcgacggctggctgcacaccggcgacatcggcagatggctgcccaacggcaccctgaagatcatcgacagaaagaagaacatcttcaagctggcccagggcgagtacatcgcccccgagaagatcgagaacatctacaacagaagccagcccgtgctgcagatcttcgtgcacggcgagagcctgagaagcagcctggtgggcgtggtggtgcccgacaccgacgtgctgcccagcttcgccgccaagctgggcgtgaagggcagcttcgaggagctgtgccagaaccaggtgaaggccatcttcctgcaccccgagcccttcagcatcgagaacggcctgctgacccccaccctgaaggccaagagaggcgagctgagcaagtacttcagaacccagatcgacagcctgtacgagcacatccaggactag

SEQ ID NO: 71707 - DNA, 2169 bp, Artificial Sequence
  Description of Artificial Sequence: Synthetic coding sequence
atgctgaccttcttcctggtgagcggcggcagcctgtggctgttcgtggagttcgtgctgagcctgctggagaagatgcagacccaggagatcctgagaatcctgagactgcccgagctgggcgacctgggccagttcttcagaagcctgagcgccaccaccctggtgagcatgggcgccctggccgccatcctggcctactggttcacccacagacccaaggccctgcagcccccctgcaacctgctgatgcagagcgaggaggtggaggacagcggcggcgccagaagaagcgtgatcggcagcggcccccagctgctgacccactactacgacgacgccagaaccatgtaccaggtgttcagaagaggcctgagcatcagcggcaacggcccctgcctgggcttcagaaagcccaagcagccctaccagtggctgagctaccaggaggtggccgacagagccgagttcctgggcagcggcctgctgcagcacaactgcaaggcctgcaccgaccagttcatcggcgtgttcgcccagaacagacccgagtggatcatcgtggagctggcctgctacacctacagcatggtggtggtgcccctgtacgacaccctgggccccggcgccatcagatacatcatcaacaccgccgacatcagcaccgtgatcgtggacaagccccagaaggccgtgctgctgctggagcacgtggagagaaaggagacccccggcctgaagctgatcatcctgatggaccccttcgaggaggccctgaaggagagaggccagaagtgcggcgtggtgatcaagagcatgcaggccgtggaggactgcggccaggagaaccaccaggcccccgtgcccccccagcccgacgacctgagcatcgtgtgcttcaccagcggcaccaccggcaaccccaagggcgccatgctgacccacggcaacgtggtggccgacttcagcggcttcctgaaggtgaccgagagccagtgggcccccacctgcgccgacgtgcacatcagctacctgcccctggcccacatgttcgagagaatggtgcagagcgtggtgtactgccacggcggcagagtgggcttcttccagggcgacatcagactgctgagcgacgacatgaaggccctgtgccccaccatcttccccgtggtgcccagactgctgaacagaatgtacgacaagatcttcagccaggccaacacccccctgaagagatggctgctggagttcgccgccaagagaaagcaggccgaggtgagaagcggcatcatcagaaacgacagcatctgggacgagctgttcttcaacaagatccaggccagcctgggcggctgcgtgagaatgatcgtgaccggcgccgcccccgccagccccaccgtgctgggcttcctgagagccgccctgggctgccaggtgtacgagggctacggccagaccgagtgcaccgccggctgcaccttcaccacccccggcgactggaccagcggccacgtgggcgcccccctgccctgcaaccacatcaagctggtggacgtggaggagctgaactactgggcctgcaagggcgagggcgagatctgcgtgagaggccccaacgtgttcaagggctacctgaaggaccccgacagaaccaaggaggccctggacagcgacggctggctgcacaccggcgacatcggcaagtggctgcccgccggcaccctgaagatcatcgacagaaagaagcacatcttcaagctggcccagggcgagtacgtggcccccgagaagatcgagaacatctacatcagaagccagcccgtggcccagatctacgtgcacggcgacagcctgaaggccttcctggtgggcatcgtggtgcccgaccccgaggtgatgcccagctgggcccagaagagaggcatcgagggcacctacgccgacctgtgcaccaacaaggacctgaagaaggccatcctggaggacatggtgagactgggcaaggagagcggcctgcacagcttcgagcaggtgaaggccatccacatccacagcgacatgttcagcgtgcagaacggcctgctgacccccaccctgaaggccaagagacccgagctgagagagtacttcaagaagcagatcgaggagctgtacagcatcagcatgtag

SEQ ID NO: 71708 - DNA, 1869 bp, Artificial Sequence
  Description of Artificial Sequence: Synthetic coding sequence
atgcagacccaggagatcctgagaatcctgagactgcccgagctgggcgacctgggccagttcttcagaagcctgagcgccaccaccctggacagcggcggcgccagaagaagcgtgatcggcagcggcccccagctgctgacccactactacgacgacgccagaaccatgtaccaggtgttcagaagaggcctgagcatcagcggcaacggcccctgcctgggcttcagaaagcccaagcagccctaccagtggctgagctaccaggaggtggccgacagagccgagttcctgggcagcggcctgctgcagcacaactgcaaggcctgcaccgaccagttcatcggcgtgttcgcccagaacagacccgagtggatcatcgtggagctggcctgctacacctacagcatggtggtggtgcccctgtacgacaccctgggccccggcgccatcagatacatcatcaacaccgccgacatcagcaccgtgatcgtggacaagccccagaaggccgtgctgctgctggagcacgtggagagaaaggagacccccggcctgaagctgatcatcctgatggaccccttcgaggaggccctgaaggagagaggccagaagtgcggcgtggtgatcaagagcatgcaggccgtggaggactgcggccaggagaaccaccaggcccccgtgcccccccagcccgacgacctgagcatcgtgtgcttcaccagcggcaccaccggcaaccccaagggcgccatgctgacccacggcaacgtggtggccgacttcagcggcttcctgaaggtgaccgagggcgacatcagactgctgagcgacgacatgaaggccctgtgccccaccatcttccccgtggtgcccagactgctgaacagaatgtacgacaagatcttcagccaggccaacacccccctgaagagatggctgctggagttcgccgccaagagaaagcaggccgaggtgagaagcggcatcatcagaaacgacagcatctgggacgagctgttcttcaacaagatccaggccagcctgggcggctgcgtgagaatgatcgtgaccggcgccgcccccgccagccccaccgtgctgggcttcctgagagccgccctgggctgccaggtgtacgagggctacggccagaccgagtgcaccgccggctgcaccttcaccacccccggcgactggaccagcggccacgtgggcgcccccctgccctgcaaccacatcaagctggtggacgtggaggagctgaactactgggcctgcaagggcgagggcgagatctgcgtgagaggccccaacgtgttcaagggctacctgaaggaccccgacagaaccaaggaggccctggacagcgacggctggctgcacaccggcgacatcggcaagtggctgcccgccggcaccctgaagatcatcgacagaaagaagcacatcttcaagctggcccagggcgagtacgtggcccccgagaagatcgagaacatctacatcagaagccagcccgtggcccagatctacgtgcacggcgacagcctgaaggccttcctggtgggcatcgtggtgcccgaccccgaggtgatgcccagctgggcccagaagagaggcatcgagggcacctacgccgacctgtgcaccaacaaggacctgaagaaggccatcctggaggacatggtgagactgggcaaggagagcggcctgcacagcttcgagcaggtgaaggccatccacatccacagcgacatgttcagcgtgcagaacggcctgctgacccccaccctgaaggccaagagacccgagctgagagagtacttcaagaagcagatcgaggagctgtacagcatcagcatgtag

SEQ ID NO: 71709 - DNA, 2094 bp, Artificial Sequence
  Description of Artificial Sequence: Synthetic coding sequence
atgcagacccaggagatcctgagaatcctgagactgcccgagctgggcgacctgggccagttcttcagaagcctgagcgccaccaccctggtgagcatgggcgccctggccgccatcctggcctactggttcacccacagacccaaggccctgcagcccccctgcaacctgctgatgcagagcgaggaggtggaggacagcggcggcgccagaagaagcgtgatcggcagcggcccccagctgctgacccactactacgacgacgccagaaccatgtaccaggtgttcagaagaggcctgagcatcagcggcaacggcccctgcctgggcttcagaaagcccaagcagccctaccagtggctgagctaccaggaggtggccgacagagccgagttcctgggcagcggcctgctgcagcacaactgcaaggcctgcaccgaccagttcatcggcgtgttcgcccagaacagacccgagtggatcatcgtggagctggcctgctacacctacagcatggtggtggtgcccctgtacgacaccctgggccccggcgccatcagatacatcatcaacaccgccgacatcagcaccgtgatcgtggacaagccccagaaggccgtgctgctgctggagcacgtggagagaaaggagacccccggcctgaagctgatcatcctgatggaccccttcgaggaggccctgaaggagagaggccagaagtgcggcgtggtgatcaagagcatgcaggccgtggaggactgcggccaggagaaccaccaggcccccgtgcccccccagcccgacgacctgagcatcgtgtgcttcaccagcggcaccaccggcaaccccaagggcgccatgctgacccacggcaacgtggtggccgacttcagcggcttcctgaaggtgaccgagaaggtgatcttccccagacaggacgacgtgctgatcagcttcctgcccctggcccacatgttcgagagagtgatccagagcgtggtgtactgccacggcggcagagtgggcttcttccagggcgacatcagactgctgagcgacgacatgaaggccctgtgccccaccatcttccccgtggtgcccagactgctgaacagaatgtacgacaagatcttcagccaggccaacacccccctgaagagatggctgctggagttcgccgccaagagaaagcaggccgaggtgagaagcggcatcatcagaaacgacagcatctgggacgagctgttcttcaacaagatccaggccagcctgggcggctgcgtgagaatgatcgtgaccggcgccgcccccgccagccccaccgtgctgggcttcctgagagccgccctgggctgccaggtgtacgagggctacggccagaccgagtgcaccgccggctgcaccttcaccacccccggcgactggaccagcggccacgtgggcgcccccctgccctgcaaccacatcaagctggtggacgtggaggagctgaactactgggcctgcaagggcgagggcgagatctgcgtgagaggccccaacgtgttcaagggctacctgaaggaccccgacagaaccaaggaggccctggacagcgacggctggctgcacaccggcgacatcggcaagtggctgcccgccggcaccctgaagatcatcgacagaaagaagcacatcttcaagctggcccagggcgagtacgtggcccccgagaagatcgagaacatctacatcagaagccagcccgtggcccagatctacgtgcacggcgacagcctgaaggccttcctggtgggcatcgtggtgcccgaccccgaggtgatgcccagctgggcccagaagagaggcatcgagggcacctacgccgacctgtgcaccaacaaggacctgaagaaggccatcctggaggacatggtgagactgggcaaggagagcggcctgcacagcttcgagcaggtgaaggccatccacatccacagcgacatgttcagcgtgcagaacggcctgctgacccccaccctgaaggccaagagacccgagctgagagagtacttcaagaagcagatcgaggagctgtacagcatcagcatgtag

SEQ ID NO: 71710 - DNA, 2094 bp, Artificial Sequence
  Description of Artificial Sequence: Synthetic coding sequence
atgcagacccaggagatcctgagaatcctgagactgcccgagctgggcgacctgggccagttcttcagaagcctgagcgccaccaccctggtgagcatgggcgccctggccgccatcctggcctactggttcacccacagacccaaggccctgcagcccccctgcaacctgctgatgcagagcgaggaggtggaggacagcggcggcgccagaagaagcgtgatcggcagcggcccccagctgctgacccactactacgacgacgccagaaccatgtaccaggtgttcagaagaggcctgagcatcagcggcaacggcccctgcctgggcttcagaaagcccaagcagccctaccagtggctgagctaccaggaggtggccgacagagccgagttcctgggcagcggcctgctgcagcacaactgcaaggcctgcaccgaccagttcatcggcgtgttcgcccagaacagacccgagtggatcatcgtggagctggcctgctacacctacagcatggtggtggtgcccctgtacgacaccctgggccccggcgccatcagatacatcatcaacaccgccgacatcagcaccgtgatcgtggacaagccccagaaggccgtgctgctgctggagcacgtggagagaaaggagacccccggcctgaagctgatcatcctgatggaccccttcgaggaggccctgaaggagagaggccagaagtgcggcgtggtgatcaagagcatgcaggccgtggaggactgcggccaggagaaccaccaggcccccgtgcccccccagcccgacgacctgagcatcgtgtgcttcaccagcggcaccaccggcaaccccaagggcgccatgctgacccacggcaacgtggtggccgacttcagcggcttcctgaaggtgaccgagagccagtgggcccccacctgcgccgacgtgcacatcagctacctgcccctggcccacatgttcgagagaatggtgcagagcgtggtgtactgccacggcggcagagtgggcttcttccagggcgacatcagactgctgagcgacgacatgaaggccctgtgccccaccatcttccccgtggtgcccagactgctgaacagaatgtacgacaagatcttcagccaggccaacacccccctgaagagatggctgctggagttcgccgccaagagaaagcaggccgaggtgagaagcggcatcatcagaaacgacagcatctgggacgagctgttcttcaacaagatccaggccagcctgggcggctgcgtgagaatgatcgtgaccggcgccgcccccgccagccccaccgtgctgggcttcctgagagccgccctgggctgccaggtgtacgagggctacggccagaccgagtgcaccgccggctgcaccttcaccacccccggcgactggaccagcggccacgtgggcgcccccctgccctgcaaccacatcaagctggtggacgtggaggagctgaactactgggcctgcaagggcgagggcgagatctgcgtgagaggccccaacgtgttcaagggctacctgaaggaccccgacagaaccaaggaggccctggacagcgacggctggctgcacaccggcgacatcggcaagtggctgcccgccggcaccctgaagatcatcgacagaaagaagcacatcttcaagctggcccagggcgagtacgtggcccccgagaagatcgagaacatctacatcagaagccagcccgtggcccagatctacgtgcacggcgacagcctgaaggccttcctggtgggcatcgtggtgcccgaccccgaggtgatgcccagctgggcccagaagagaggcatcgagggcacctacgccgacctgtgcaccaacaaggacctgaagaaggccatcctggaggacatggtgagactgggcaaggagagcggcctgcacagcttcgagcaggtgaaggccatccacatccacagcgacatgttcagcgtgcagaacggcctgctgacccccaccctgaaggccaagagacccgagctgagagagtacttcaagaagcagatcgaggagctgtacagcatcagcatgtag

SEQ ID NO: 71711 - DNA, 2127 bp, Artificial Sequence
  Description of Artificial Sequence: Synthetic coding sequence
atgcccgagttcgtgctgagcctgctggagaagatgcagacccaggagatcctgagaatcctgagactgcccgagctgggcgacctgggccagttcttcagaagcctgagcgccaccaccctggtgagcatgggcgccctggccgccatcctggcctactggttcacccacagacccaaggccctgcagcccccctgcaacctgctgatgcagagcgaggaggtggaggacagcggcggcgccagaagaagcgtgatcggcagcggcccccagctgctgacccactactacgacgacgccagaaccatgtaccaggtgttcagaagaggcctgagcatcagcggcaacggcccctgcctgggcttcagaaagcccaagcagccctaccagtggctgagctaccaggaggtggccgacagagccgagttcctgggcagcggcctgctgcagcacaactgcaaggcctgcaccgaccagttcatcggcgtgttcgcccagaacagacccgagtggatcatcgtggagctggcctgctacacctacagcatggtggtggtgcccctgtacgacaccctgggccccggcgccatcagatacatcatcaacaccgccgacatcagcaccgtgatcgtggacaagccccagaaggccgtgctgctgctggagcacgtggagagaaaggagacccccggcctgaagctgatcatcctgatggaccccttcgaggaggccctgaaggagagaggccagaagtgcggcgtggtgatcaagagcatgcaggccgtggaggactgcggccaggagaaccaccaggcccccgtgcccccccagcccgacgacctgagcatcgtgtgcttcaccagcggcaccaccggcaaccccaagggcgccatgctgacccacggcaacgtggtggccgacttcagcggcttcctgaaggtgaccgagaaggtgatcttccccagacaggacgacgtgctgatcagcttcctgcccctggcccacatgttcgagagagtgatccagagcgtggtgtactgccacggcggcagagtgggcttcttccagggcgacatcagactgctgagcgacgacatgaaggccctgtgccccaccatcttccccgtggtgcccagactgctgaacagaatgtacgacaagatcttcagccaggccaacacccccctgaagagatggctgctggagttcgccgccaagagaaagcaggccgaggtgagaagcggcatcatcagaaacgacagcatctgggacgagctgttcttcaacaagatccaggccagcctgggcggctgcgtgagaatgatcgtgaccggcgccgcccccgccagccccaccgtgctgggcttcctgagagccgccctgggctgccaggtgtacgagggctacggccagaccgagtgcaccgccggctgcaccttcaccacccccggcgactggaccagcggccacgtgggcgcccccctgccctgcaaccacatcaagctggtggacgtggaggagctgaactactgggcctgcaagggcgagggcgagatctgcgtgagaggccccaacgtgttcaagggctacctgaaggaccccgacagaaccaaggaggccctggacagcgacggctggctgcacaccggcgacatcggcaagtggctgcccgccggcaccctgaagatcatcgacagaaagaagcacatcttcaagctggcccagggcgagtacgtggcccccgagaagatcgagaacatctacatcagaagccagcccgtggcccagatctacgtgcacggcgacagcctgaaggccttcctggtgggcatcgtggtgcccgaccccgaggtgatgcccagctgggcccagaagagaggcatcgagggcacctacgccgacctgtgcaccaacaaggacctgaagaaggccatcctggaggacatggtgagactgggcaaggagagcggcctgcacagcttcgagcaggtgaaggccatccacatccacagcgacatgttcagcgtgcagaacggcctgctgacccccaccctgaaggccaagagacccgagctgagagagtacttcaagaagcagatcgaggagctgtacagcatcagcatgtag

SEQ ID NO: 71712 - DNA, 2004 bp, Artificial Sequence
  Description of Artificial Sequence: Synthetic coding sequence
atgcagacccaggagatcctgagaatcctgagactgcccgagctgggcgacctgggccagttcttcagaagcctgagcgccaccaccctggtgagcatgggcgccctggccgccatcctggcctactggttcacccacagacccaaggccctgcagcccccctgcaacctgctgatgcagagcgaggaggtggaggacagcggcggcgccagaagaagcgtgatcggcagcggcccccagctgctgacccactactacgacgacgccagaaccatgtaccaggtgttcagaagaggcctgagcatcagcggcaacggcccctgcctgggcttcagaaagcccaagcagccctaccagtggctgagctaccaggaggtggccgacagagccgagttcctgggcagcggcctgctgcagcacaactgcaaggcctgcaccgaccagttcatcggcgtgttcgcccagaacagacccgagtggatcatcgtggagctggcctgctacacctacagcatggtggtggtgcccctgtacgacaccctgggccccggcgccatcagatacatcatcaacaccgccgacatcagcaccgtgatcgtggacaagccccagaaggccgtgctgctgctggagcacgtggagagaaaggagacccccggcctgaagctgatcatcctgatggaccccttcgaggaggccctgaaggagagaggccagaagtgcggcgtggtgatcaagagcatgcaggccgtggaggactgcggccaggagaaccaccaggcccccgtgcccccccagcccgacgacctgagcatcgtgtgcttcaccagcggcaccaccggcaaccccaagggcgccatgctgacccacggcaacgtggtggccgacttcagcggcttcctgaaggtgaccgagagccagtgggcccccacctgcgccgacgtgcacatcagctacctgcccctggcccacatgttcgagagaatggtgcagagcgtggtgtactgccacggcggcagagtgggcttcttccagggcgacatcagactgctgagcgacgacatgaaggccctgtgccccaccatcttccccgtggtgcccagactgctgaacagaatgtacgacaagatcttcagccaggccaacacccccctgaagagatggctgctggagttcgccgccaagagaaagcaggccgaggtgagaagcggcatcatcagaaacgacagcatctgggacgagctgttcttcaacaagatccaggccagcctgggcggctgcgtgagaatgatcgtgaccggcgccgcccccgccagccccaccgtgctgggcttcctgagagccgccctgggctgccaggtgtacgagggctacggccagaccgagtgcaccgccggctgcaccttcaccacccccggcgactggaccagcggccacgtgggcgcccccctgccctgcaaccacatcaagctggtggacgtggaggagctgaactactgggcctgcaagggcgagggcgagatctgcgtgagaggccccaacgtgttcaagggctacctgaaggaccccgacagaaccaaggaggccctggacagcgacggctggctgcacaccggcgacatcggcaagtggctgcccgccggcaccctgaagatcatcgacagaaagaagcacatcttcaagctggcccagggcgagtacgtggcccccgagaagatcgagaacatctacatcagaagccagcccgtggcccagatctacgtgcacggcgacagcctgaaggccttcctggtgggcatcgtggtgcccgaccccgaggtgatgcccagctgggcccagaagagaggcatcgagggcacctacgccgacctgtgcaccaacaaggacctgaagaaggccatcctggaggacatggtgagactgggcaaggagagcggcctgcacagcttcgagcaggacctgccccagtgcctgatccagatcaaggtgttcagcaagtactag

SEQ ID NO: 71713 - DNA, 2169 bp, Artificial Sequence
  Description of Artificial Sequence: Synthetic coding sequence
atgctgaccttcttcctggtgagcggcggcagcctgtggctgttcgtggagttcgtgctgagcctgctggagaagatgcagacccaggagatcctgagaatcctgagactgcccgagctgggcgacctgggccagttcttcagaagcctgagcgccaccaccctggtgagcatgggcgccctggccgccatcctggcctactggttcacccacagacccaaggccctgcagcccccctgcaacctgctgatgcagagcgaggaggtggaggacagcggcggcgccagaagaagcgtgatcggcagcggcccccagctgctgacccactactacgacgacgccagaaccatgtaccaggtgttcagaagaggcctgagcatcagcggcaacggcccctgcctgggcttcagaaagcccaagcagccctaccagtggctgagctaccaggaggtggccgacagagccgagttcctgggcagcggcctgctgcagcacaactgcaaggcctgcaccgaccagttcatcggcgtgttcgcccagaacagacccgagtggatcatcgtggagctggcctgctacacctacagcatggtggtggtgcccctgtacgacaccctgggccccggcgccatcagatacatcatcaacaccgccgacatcagcaccgtgatcgtggacaagccccagaaggccgtgctgctgctggagcacgtggagagaaaggagacccccggcctgaagctgatcatcctgatggaccccttcgaggaggccctgaaggagagaggccagaagtgcggcgtggtgatcaagagcatgcaggccgtggaggactgcggccaggagaaccaccaggcccccgtgcccccccagcccgacgacctgagcatcgtgtgcttcaccagcggcaccaccggcaaccccaagggcgccatgctgacccacggcaacgtggtggccgacttcagcggcttcctgaaggtgaccgagaaggtgatcttccccagacaggacgacgtgctgatcagcttcctgcccctggcccacatgttcgagagagtgatccagagcgtggtgtactgccacggcggcagagtgggcttcttccagggcgacatcagactgctgagcgacgacatgaaggccctgtgccccaccatcttccccgtggtgcccagactgctgaacagaatgtacgacaagatcttcagccaggccaacacccccctgaagagatggctgctggagttcgccgccaagagaaagcaggccgaggtgagaagcggcatcatcagaaacgacagcatctgggacgagctgttcttcaacaagatccaggccagcctgggcggctgcgtgagaatgatcgtgaccggcgccgcccccgccagccccaccgtgctgggcttcctgagagccgccctgggctgccaggtgtacgagggctacggccagaccgagtgcaccgccggctgcaccttcaccacccccggcgactggaccagcggccacgtgggcgcccccctgccctgcaaccacatcaagctggtggacgtggaggagctgaactactgggcctgcaagggcgagggcgagatctgcgtgagaggccccaacgtgttcaagggctacctgaaggaccccgacagaaccaaggaggccctggacagcgacggctggctgcacaccggcgacatcggcaagtggctgcccgccggcaccctgaagatcatcgacagaaagaagcacatcttcaagctggcccagggcgagtacgtggcccccgagaagatcgagaacatctacatcagaagccagcccgtggcccagatctacgtgcacggcgacagcctgaaggccttcctggtgggcatcgtggtgcccgaccccgaggtgatgcccagctgggcccagaagagaggcatcgagggcacctacgccgacctgtgcaccaacaaggacctgaagaaggccatcctggaggacatggtgagactgggcaaggagagcggcctgcacagcttcgagcaggtgaaggccatccacatccacagcgacatgttcagcgtgcagaacggcctgctgacccccaccctgaaggccaagagacccgagctgagagagtacttcaagaagcagatcgaggagctgtacagcatcagcatgtag

SEQ ID NO: 71714 - DNA, 2139 bp, Artificial Sequence
  Description of Artificial Sequence: Synthetic coding sequence
atgcagacccaggagatcctgagaatcctgagactgcccgagctgggcgacctgggccagttcttcagaagcctgagcgccaccaccctggtgagcatgggcgccctggccgccatcctggcctactggttcacccacagacccaaggccctgcagcccccctgcaacctgctgatgcagagcgaggaggtggaggacagcggcggcgccagaagaagcgtgatcggcagcggcccccagctgctgacccactactacgacgacgccagaaccatgtaccaggtgttcagaagaggcctgagcatcagcggcaacggcccctgcctgggcttcagaaagcccaagcagccctaccagtggctgagctaccaggaggtggccgacagagccgagttcctgggcagcggcctgctgcagcacaactgcaaggcctgcaccgaccagttcatcggcgtgttcgcccagaacagacccgagtggatcatcgtggagctggcctgctacacctacagcatggtggtggtgcccctgtacgacaccctgggccccggcgccatcagatacatcatcaacaccggcctgagctgccaggagggcgccagcgccaccgccagcacccaggccgacatcagcaccgtgatcgtggacaagccccagaaggccgtgctgctgctggagcacgtggagagaaaggagacccccggcctgaagctgatcatcctgatggaccccttcgaggaggccctgaaggagagaggccagaagtgcggcgtggtgatcaagagcatgcaggccgtggaggactgcggccaggagaaccaccaggcccccgtgcccccccagcccgacgacctgagcatcgtgtgcttcaccagcggcaccaccggcaaccccaagggcgccatgctgacccacggcaacgtggtggccgacttcagcggcttcctgaaggtgaccgagaaggtgatcttccccagacaggacgacgtgctgatcagcttcctgcccctggcccacatgttcgagagagtgatccagagcgtggtgtactgccacggcggcagagtgggcttcttccagggcgacatcagactgctgagcgacgacatgaaggccctgtgccccaccatcttccccgtggtgcccagactgctgaacagaatgtacgacaagatcttcagccaggccaacacccccctgaagagatggctgctggagttcgccgccaagagaaagcaggccgaggtgagaagcggcatcatcagaaacgacagcatctgggacgagctgttcttcaacaagatccaggccagcctgggcggctgcgtgagaatgatcgtgaccggcgccgcccccgccagccccaccgtgctgggcttcctgagagccgccctgggctgccaggtgtacgagggctacggccagaccgagtgcaccgccggctgcaccttcaccacccccggcgactggaccagcggccacgtgggcgcccccctgccctgcaaccacatcaagctggtggacgtggaggagctgaactactgggcctgcaagggcgagggcgagatctgcgtgagaggccccaacgtgttcaagggctacctgaaggaccccgacagaaccaaggaggccctggacagcgacggctggctgcacaccggcgacatcggcaagtggctgcccgccggcaccctgaagatcatcgacagaaagaagcacatcttcaagctggcccagggcgagtacgtggcccccgagaagatcgagaacatctacatcagaagccagcccgtggcccagatctacgtgcacggcgacagcctgaaggccttcctggtgggcatcgtggtgcccgaccccgaggtgatgcccagctgggcccagaagagaggcatcgagggcacctacgccgacctgtgcaccaacaaggacctgaagaaggccatcctggaggacatggtgagactgggcaaggagagcggcctgcacagcttcgagcaggtgaaggccatccacatccacagcgacatgttcagcgtgcagaacggcctgctgacccccaccctgaaggccaagagacccgagctgagagagtacttcaagaagcagatcgaggagctgtacagcatcagcatgtag

SEQ ID NO: 71715 - DNA, 2094 bp, Artificial Sequence; identical to SEQ ID NO: 71710
  Description of Artificial Sequence: Synthetic coding sequence

SEQ ID NO: 71716 - DNA, 1821 bp, Artificial Sequence
  Description of Artificial Sequence: Synthetic coding sequence
atgtaccaggtgttcagaagaggcctgagcatcagcggcaacggcccctgcctgggcttcagaaagcccaagcagccctaccagtggctgagctaccaggaggtggccgacagagccgagttcctgggcagcggcctgctgcagcacaactgcaaggcctgcaccgaccagttcatcggcgtgttcgcccagaacagacccgagtggatcatcgtggagctggcctgctacacctacagcatggtggtggtgcccctgtacgacaccctgggccccggcgccatcagatacatcatcaacaccgccgacatcagcaccgtgatcgtggacaagccccagaaggccgtgctgctgctggagcacgtggagagaaaggagacccccggcctgaagctgatcatcctgatggaccccttcgaggaggccctgaaggagagaggccagaagtgcggcgtggtgatcaagagcatgcaggccgtggaggactgcggccaggagaaccaccaggcccccgtgcccccccagcccgacgacctgagcatcgtgtgcttcaccagcggcaccaccggcaaccccaagggcgccatgctgacccacggcaacgtggtggccgacttcagcggcttcctgaaggtgaccgagaaggtgatcttccccagacaggacgacgtgctgatcagcttcctgcccctggcccacatgttcgagagagtgatccagagcgtggtgtactgccacggcggcagagtgggcttcttccagggcgacatcagactgctgagcgacgacatgaaggccctgtgccccaccatcttccccgtggtgcccagactgctgaacagaatgtacgacaagatcttcagccaggccaacacccccctgaagagatggctgctggagttcgccgccaagagaaagcaggccgaggtgagaagcggcatcatcagaaacgacagcatctgggacgagctgttcttcaacaagatccaggccagcctgggcggctgcgtgagaatgatcgtgaccggcgccgcccccgccagccccaccgtgctgggcttcctgagagccgccctgggctgccaggtgtacgagggctacggccagaccgagtgcaccgccggctgcaccttcaccacccccggcgactggaccagcggccacgtgggcgcccccctgccctgcaaccacatcaagctggtggacgtggaggagctgaactactgggcctgcaagggcgagggcgagatctgcgtgagaggccccaacgtgttcaagggctacctgaaggaccccgacagaaccaaggaggccctggacagcgacggctggctgcacaccggcgacatcggcaagtggctgcccgccggcaccctgaagatcatcgacagaaagaagcacatcttcaagctggcccagggcgagtacgtggcccccgagaagatcgagaacatctacatcagaagccagcccgtggcccagatctacgtgcacggcgacagcctgaaggccttcctggtgggcatcgtggtgcccgaccccgaggtgatgcccagctgggcccagaagagaggcatcgagggcacctacgccgacctgtgcaccaacaaggacctgaagaaggccatcctggaggacatggtgagactgggcaaggagagcggcctgcacagcttcgagcaggtgaaggccatccacatccacagcgacatgttcagcgtgcagaacggcctgctgacccccaccctgaaggccaagagacccgagctgagagagtacttcaagaagcagatcgaggagctgtacagcatcagcatgtag

SEQ ID NO: 71717 - DNA, 1386 bp, Artificial Sequence
  Description of Artificial Sequence: Synthetic coding sequence
atgagcagacaggtggtgagaagcagcaagttcagacacgtgttcggccagcccgccaaggccgaccagtgctacgaggacgtgagagtgagccagaccacctgggacagcggcttctgcgccgtgaaccccaagttcgtggccctgatctgcgaggccagcggcggcggcgccttcctggtgctgcccctgggcaagaccggcagagtggacaagaacgcccccaccgtgtgcggccacaccgcccccgtgctggacatcgcctggtgcccccacaacgacaacgtgatcgccagcggcagcgaggactgcaccgtgatggtgtgggagatccccgacggcggcctgatgctgcccctgagagagcccgtggtgaccctggagggccacaccaagagagtgggcatcgtggcctggcacaccaccgcccagaacgtgctgctgagcgccggctgcgacaacgtgatcatggtgtgggacgtgggcaccggcgccgccatgctgaccctgggccccgaggtgcaccccgacaccatctacagcgtggactggagcagagacggcggcctgatctgcaccagctgcagagacaagagagtgagaatcatcgagcccagaaagggcaccgtggtggccgagaaggacagaccccacgagggcaccagacccgtgagagccgtgttcgtgagcgagggcaagatcctgaccaccggcttcagcagaatgagcgagagacaggtggccctgtgggacaccaagcacctggaggagcccctgagcctgcaggagctggacaccagcagcggcgtgctgctgcccttcttcgaccccgacaccaacatcgtgtacctgtgcggcaagggcgacagcagcatcagatacttcgagatcaccagcgaggcccccttcctgcactacctgagcatgttcagcagcaaggagagccagagaggcatgggctacatgcccaagagaggcctggaggtgaacaagtgcgagatcgccagattctacaagctgcacgagagaagatgcgagcccatcgccatgaccgtgcccagaaagagcgacctgttccaggaggacctgtacccccccaccgccggccccgaccccgccctgaccgccgaggagtggctgggcggcagagacgccggccccctgctgatcagcctgaaggacggctacgtgccccccaagagcagagagctgagagtgaacagaggcctggacaccggcagaagaagagccgcccccgaggccagcggcacccccagcagcgacgccgtgagcagactggaggaggagatgagaaagctgcaggccaccgtgcaggagctgcagaagagactggacagactggaggagaccgtgcaggccaagtag

SEQ ID NO: 71718 - DNA, 1734 bp, Artificial Sequence
  Description of Artificial Sequence: Synthetic coding sequence
atgcagtggctgatgagattcagaaccctgtggggcatccacaagagcttccacaacatccaccccgcccccagccagctgagatgcagaagcctgagcgagttcggcgcccccagatggaacgactacgaggtgcccgaggagttcaacttcgccagctacgtgctggactactgggcccagaaggagaaggagggcaagagaggccccaaccccgccttctggtgggtgaacggccagggcgacgaggtgaagtggagcttcagagagatgggcgacctgaccagaagagtggccaacgtgttcacccagacctgcggcctgcagcagggcgaccacctggccctgatgctgcccagagtgcccgagtggtggctggtggccgtgggctgcatgagaaccggcatcatcttcatccccgccaccatcctgctgaaggccaaggacatcctgtacagactgcagctgagcaaggccaagggcatcgtgaccatcgacgccctggccagcgaggtggacagcatcgccagccagtgccccagcctgaagaccaagctgctggtgagcgaccacagcagagagggctggctggacttcagaagcctggtgaagagcgccagccccgagcacacctgcgtgaagagcaagaccctggaccccatggtgatcttcttcaccagcggcaccaccggcttccccaagatggccaagcacagccacggcctggccctgcagcccagcttccccggcagcagaaagctgagaagcctgaagaccagcgacgtgagctggtgcctgagcgacagcggctggatcgtggccaccatctggaccctggtggagccctggaccgccggctgcaccgtgttcatccaccacctgccccagttcgacaccaaggtgatcatccagaccctgctgaagtaccccatcaaccacttctggggcgtgagcagcatctacagaatgatcctgcagcaggacttcaccagcatcagattccccgccctggagcactgctacaccggcggcgaggtggtgctgcccaaggaccaggaggagtggaagagaagaaccggcctgctgctgtacgagaactacggccagagcgagaccggcctgatctgcgccacctactggggcatgaagatcaagcccggcttcatgggcaaggccacccccccctacgacgtgcaggtgatcgacgacaagggcagcatcctgccccccaacaccgagggcaacatcggcatcagaatcaagcccgtgagacccgtgagcctgttcatgtgctacgagggcgaccccgagaagaccgccaaggtggagtgcggcgacttctacaacaccggcgacagaggcaagatggacgaggagggctacatctgcttcctgggcagaagcgacgacatcatcaacgccagcggctacagaatcggccccgccgaggtggagagcgccctggtggagcaccccgccgtggccgagagcgccgtggtgggcagccccgaccccatcagaggcgaggtggtgaaggccttcatcgtgctgaccccccagttcctgagccacgacaaggaccagctgaccaaggagctgcagcagcacgtgaagagcgtgaccgccccctacaagtaccccagaaaggtggagttcgtgagcgagctgcccaagaccatcaccggcaagatcgagagaaaggagctgagaaagaaggagaccggccagatgtag

SEQ ID NO: 71719 - DNA, 1734 bp, Artificial Sequence; identical to SEQ ID NO: 71718
  Description of Artificial Sequence: Synthetic coding sequence

SEQ ID NO: 71720 - DNA, 465 bp, Artificial Sequence
  Description of Artificial Sequence: Synthetic coding sequence
atgcagtggctgatgagattcagaaccctgtggggcatccacaagagcttccacaacatccaccccgcccccagccagctgagatgcagaagcctgagcgagttcggcgcccccagatggaacgactacgaggtgcccgaggagttcaacttcgccagctacgtgctggactactgggcccagaaggagaaggagggcaagagaggccccaaccccgccttctggtgggtgaacggccagggcgacgaggtgaagtggagcttcagagagatgggcgacctgaccagaagagtggccaacgtgttcacccagacctgcggcctgcagcagggcgaccacctggccctgatgctgcccagagtgcccgagtggtggctggtggccgtgggctgcatgagaaccggcatcatcttcatccccgccaccatcctgctgaaggccaaggacatcctgtacagactgtag

SEQ ID NO: 71721 - DNA, 1533 bp, Artificial Sequence
  Description of Artificial Sequence: Synthetic coding sequence
atgagacccggcctgagcttcctgctggccctgctgttcttcctgggccaggccgccggcgacctgggcgacgtgggcccccccatccccagccccggcttcagcagcttccccggcgtggacagcagcagcagcttcagcagcagcagcagaagcggcagcagcagcagcagaagcctgggcagcggcggcagcgtgagccagctgttcagcaacttcaccggcagcgtggacgacagaggcacctgccagtgcagcgtgagcctgcccgacaccaccttccccgtggacagagtggagagactggagttcaccgcccacgtgctgagccagaagttcgagaaggagctgagcaaggtgagagagtacgtgcagctgatcagcgtgtacgagaagaagctgctgaacctgaccgtgagaatcgacatcatggagaaggacaccatcagctacaccgagctggacttcgagctgatcaaggtggaggtgaaggagatggagaagctggtgatccagctgaaggagagcttcggcggcagcagcgagatcgtggaccagctggaggtggagatcagaaacatgaccctgctggtggagaagctggagaccctggacaagaacaacgtgctggccatcagaagagagatcgtggccctgaagaccaagctgaaggagtgcgaggccagcaaggaccagaacacccccgtggtgcaccccccccccacccccggcagctgcggccacggcggcgtggtgaacatcagcaagcccagcgtggtgcagctgaactggagaggcttcagctacctgtacggcgcctggggcagagactacagcccccagcaccccaacaagggcctgtactgggtggcccccctgaacaccgacggcagactgctggagtactacagactgtacaacaccctggacgacctgctgctgtacatcaacgccagagagctgagaatcacctacggccagggcagcggcaccgccgtgtacaacaacaacatgtacgtgaacatgtacaacaccggcaacatcgccagagtgaacctgaccaccaacaccatcgccgtgacccagaccctgcccaacgccgcctacaacaacagattcagctacgccaacgtggcctggcaggacatcgacttcgccgtggacgagaacggcctgtgggtgatctacagcaccgaggccagcaccggcaacatggtgatcagcaagctgaacgacaccaccctgcaggtgctgaacacctggtacaccaagcagtacaagcccagcgccagcaacgccttcatggtgtgcggcgtgctgtacgccaccagaaccatgaacaccagaaccgaggagatcttctactactacgacaccaacaccggcaaggagggcaagctggacatcgtgatgcacaagatgcaggagaaggtgcagagcatcaactacaaccccttcgaccagaagctgtacgtgtacaacgacggctacctgctgaactacgacctgagcgtgctgcagaagccccagtag

SEQ ID NO: 71722 - DNA, 1734 bp, Artificial Sequence
  Description of Artificial Sequence: Synthetic coding sequence
atgcactggctgagaaaggtgcagggcctgtgcaccctgtggggcacccagatgagcagcagaaccctgtacatcaacagcagacagctggtgagcctgcagtggggccaccaggaggtgcccgccaagttcaacttcgccagcgacgtgctggaccactgggccgacatggagaaggccggcaagagactgcccagccccgccctgtggtgggtgaacggcaagggcaaggagctgatgtggaacttcagagagctgagcgagaacagccagcaggccgccaacgtgctgagcggcgcctgcggcctgcagagaggcgacagagtggccgtggtgctgcccagagtgcccgagtggtggctggtgatcctgggctgcatcagagccggcctgatcttcatgcccggcaccatccagatgaagagcaccgacatcctgtacagactgcagatgagcaaggccaaggccatcgtggccggcgacgaggtgatccaggaggtggacaccgtggccagcgagtgccccagcctgagaatcaagctgctggtgagcgagaagagctgcgacggctggctgaacttcaagaagctgctgaacgaggccagcaccacccaccactgcgtggagaccggcagccaggaggccagcgccatctacttcaccagcggcaccagcggcctgcccaagatggccgagcacagctacagcagcctgggcctgaaggccaagatggacgccggctggaccggcctgcaggccagcgacatcatgtggaccatcagcgacaccggctggatcctgaacatcctgtgcagcctgatggagccctgggccctgggcgcctgcaccttcgtgcacctgctgcccaagttcgaccccctggtgatcctgaagaccctgagcagctaccccatcaagagcatgatgggcgcccccatcgtgtacagaatgctgctgcagcaggacctgagcagctacaagttcccccacctgcagaactgcgtgaccgtgggcgagagcctgctgcccgagaccctggagaactggagagcccagaccggcctggacatcagagagagctacggccagaccgagaccggcctgacctgcatggtgagcaagaccatgaagatcaagcccggctacatgggcaccgccgccagctgctacgacgtgcagatcatcgacgacaagggcaacgtgctgccccccggcaccgagggcgacatcggcatcagagtgaagcccatcagacccatcggcatcttcagcggctacgtggacaaccccgacaagaccgccgccaacatcagaggcgacttctggctgctgggcgacagaggcatcaaggacgaggacggctacttccagttcatgggcagagccaacgacatcatcaacagcagcggctacagaatcggccccagcgaggtggagaacgccctgatggagcaccccgccgtggtggagaccgccgtgatcagcagccccgaccccgtgagaggcgaggtggtgaaggccttcgtggtgctggccagccagttcctgagccacgaccccgagcagctgaccaaggagctgcagcagcacgtgaagagcgtgaccgccccctacaagtaccccagaaagatcgagttcgtgctgaacctgcccaagaccgtgaccggcaagatccagagagccaagctgagagacaaggagtggaagatgagcggcaaggccagagcccagtag

SEQ ID NO: 71723 - DNA, 1497 bp, Artificial Sequence
  Description of Artificial Sequence: Synthetic coding sequence
atgtggaacttcagagagctgagcgagaacagccagcaggccgccaacgtgctgagcggcgcctgcggcctgcagagaggcgacagagtggccgtggtgctgcccagagtgcccgagtggtggctggtgatcctgggctgcatcagagccggcctgatcttcatgcccggcaccatccagatgaagagcaccgacatcctgtacagactgcagatgagcaaggccaaggccatcgtggccggcgacgaggtgatccaggaggtggacaccgtggccagcgagtgccccagcctgagaatcaagctgctggtgagcgagaagagctgcgacggctggctgaacttcaagaagctgctgaacgaggccagcaccacccaccactgcgtggagaccggcagccaggaggccagcgccatctacttcaccagcggcaccagcggcctgcccaagatggccgagcacagctacagcagcctgggcctgaaggccaagatggacgccggctggaccggcctgcaggccagcgacatcatgtggaccatcagcgacaccggctggatcctgaacatcctgtgcagcctgatggagccctgggccctgggcgcctgcaccttcgtgcacctgctgcccaagttcgaccccctggtgatcctgaagaccctgagcagctaccccatcaagagcatgatgggcgcccccatcgtgtacagaatgctgctgcagcaggacctgagcagctacaagttcccccacctgcagaactgcgtgaccgtgggcgagagcctgctgcccgagaccctggagaactggagagcccagaccggcctggacatcagagagagctacggccagaccgagaccggcctgacctgcatggtgagcaagaccatgaagatcaagcccggctacatgggcaccgccgccagctgctacgacgtgcagatcatcgacgacaagggcaacgtgctgccccccggcaccgagggcgacatcggcatcagagtgaagcccatcagacccatcggcatcttcagcggctacgtggacaaccccgacaagaccgccgccaacatcagaggcgacttctggctgctgggcgacagaggcatcaaggacgaggacggctacttccagttcatgggcagagccaacgacatcatcaacagcagcggctacagaatcggccccagcgaggtggagaacgccctgatggagcaccccgccgtggtggagaccgccgtgatcagcagccccgaccccgtgagaggcgaggtggtgaaggccttcgtggtgctggccagccagttcctgagccacgaccccgagcagctgaccaaggagctgcagcagcacgtgaagagcgtgaccgccccctacaagtaccccagaaagatcgagttcgtgctgaacctgcccaagaccgtgaccggcaagatccagagagccaagctgagagacaaggagtggaagatgagcggcaaggccagagcccagtag

SEQ ID NO: 71724 - DNA, 627 bp, Artificial Sequence
  Description of Artificial Sequence: Synthetic coding sequence
atgcactggctgagaaaggtgcagggcctgtgcaccctgtggggcacccagatgagcagcagaaccctgtacatcaacagcagacagctggtgagcctgcagtggggccaccaggaggtgcccgccaagttcaacttcgccagcgacgtgctggaccactgggccgacatggagaaggccggcaagagactgcccagccccgccctgtggtgggtgaacggcaagggcaaggagctgatgtggaacttcagagagctgagcgagaacagccagcaggccgccaacgtgctgagcggcgcctgcggcctgcagagaggcgacagagtggccgtggtgctgcccagagtgcccgagtggtggctggtgatcctgggctgcatcagagccggcctgatcttcatgcccggcaccatccagatgaagagcaccgacatcctgtacagactgcagatgagcaaggccaaggccatcgtggccggcgacgaggtgatccaggaggtggacaccgtggccagcgagtgccccagcctgagaatcaagctgctggtgagcgagaagagctgcgacggctggctgaacttcaagaagctgctgaagtacaaggtgagacacagagacgtgaagtag

SEQ ID NO: 71725 - DNA, 1050 bp, Artificial Sequence
  Description of Artificial Sequence: Synthetic coding sequence
atgagacacccccccctgatcaccgtgtggagactggaggccaagatggacgccggctggaccggcctgcaggccagcgacatcatgtggaccatcagcgacaccggctggatcctgaacatcctgtgcagcctgatggagccctgggccctgggcgcctgcaccttcgtgcacctgctgcccaagttcgaccccctggtgatcctgaagaccctgagcagctaccccatcaagagcatgatgggcgcccccatcgtgtacagaatgctgctgcagcaggacctgagcagctacaagttcccccacctgcagaactgcgtgaccgtgggcgagagcctgctgcccgagaccctggagaactggagagcccagaccggcctggacatcagagagagctacggccagaccgagaccggcctgacctgcatggtgagcaagaccatgaagatcaagcccggctacatgggcaccgccgccagctgctacgacgtgcagatcatcgacgacaagggcaacgtgctgccccccggcaccgagggcgacatcggcatcagagtgaagcccatcagacccatcggcatcttcagcggctacgtggacaaccccgacaagaccgccgccaacatcagaggcgacttctggctgctgggcgacagaggcatcaaggacgaggacggctacttccagttcatgggcagagccaacgacatcatcaacagcagcggctacagaatcggccccagcgaggtggagaacgccctgatggagcaccccgccgtggtggagaccgccgtgatcagcagccccgaccccgtgagaggcgaggtggtgaaggccttcgtggtgctggccagccagttcctgagccacgaccccgagcagctgaccaaggagctgcagcagcacgtgaagagcgtgaccgccccctacaagtaccccagaaagatcgagttcgtgctgaacctgcccaagaccgtgaccggcaagatccagagagccaagctgagagacaaggagtggaagatgagcggcaaggccagagcccagtag

SEQ ID NO: 71726 - DNA, 1734 bp, Artificial Sequence; identical to SEQ ID NO: 71722
  Description of Artificial Sequence: Synthetic coding sequence

SEQ ID NO: 71727 - DNA, 1734 bp, Artificial Sequence
  Description of Artificial Sequence: Synthetic coding sequence
atgcactggctgagaaaggtgcagggcctgtgcaccctgtggggcacccagatgagcagcagaaccctgtacatcaacagcagacagctggtgagcctgcagtggggccaccaggaggtgcccgccaagttcaacttcgccagcgacgtgctggaccactgggccgacatggagaaggccggcaagagactgcccagccccgccctgtggtgggtgaacggcaagggcaaggagctgatgtggaacttcagagagctgagcgagaacagccagcaggccgccaacatcctgagcggcgcctgcggcctgcagagaggcgacagagtggccgtgatgctgcccagagtgcccgagtggtggctggtgatcctgggctgcatcagagccggcctgatcttcatgcccggcaccatccagatgaagagcaccgacatcctgtacagactgcagatgagcaaggccaaggccatcgtggccggcgacgaggtgatccaggaggtggacaccgtggccagcgagtgccccagcctgagaatcaagctgctggtgagcgagaagagctgcgacggctggctgaacttcaagaagctgctgaacgaggccagcaccacccaccactgcgtggagaccggcagccaggaggccagcgccatctacttcaccagcggcaccagcggcctgcccaagatggccgagcacagctacagcagcctgggcctgaaggccaagatggacgccggctggaccggcctgcaggccagcgacatcatgtggaccatcagcgacaccggctggatcctgaacatcctgggcagcctgctggagagctggaccctgggcgcctgcaccttcgtgcacctgctgcccaagttcgaccccctggtgatcctgaagaccctgagcagctaccccatcaagagcatgatgggcgcccccatcgtgtacagaatgctgctgcagcaggacctgagcagctacaagttcccccacctgcagaactgcctggccggcggcgagagcctgctgcccgagaccctggagaactggagagcccagaccggcctggacatcagagagttctacggccagaccgagaccggcctgacctgcatggtgagcaagaccatgaagatcaagcccggctacatgggcaccgccgccagctgctacgacgtgcaggtgatcgacgacaagggcaacgtgctgccccccggcaccgagggcgacatcggcatcagagtgaagcccatcagacccatcggcatcttcagcggctacgtggagaaccccgacaagaccgccgccaacatcagaggcgacttctggctgctgggcgacagaggcatcaaggacgaggacggctacttccagttcatgggcagagccgacgacatcatcaacagcagcggctacagaatcggccccagcgaggtggagaacgccctgatgaagcaccccgccgtggtggagaccgccgtgatcagcagccccgaccccgtgagaggcgaggtggtgaaggccttcgtgatcctggccagccagttcctgagccacgaccccgagcagctgaccaaggagctgcagcagcacgtgaagagcgtgaccgccccctacaagtaccccagaaagatcgagttcgtgctgaacctgcccaagaccgtgaccggcaagatccagagaaccaagctgagagacaaggagtggaagatgagcggcaaggccagagcccagtag

SEQ ID NO: 71728 - DNA, 627 bp, Artificial Sequence
  Description of Artificial Sequence: Synthetic coding sequence
atgcactggctgagaaaggtgcagggcctgtgcaccctgtggggcacccagatgagcagcagaaccctgtacatcaacagcagacagctggtgagcctgcagtggggccaccaggaggtgcccgccaagttcaacttcgccagcgacgtgctggaccactgggccgacatggagaaggccggcaagagactgcccagccccgccctgtggtgggtgaacggcaagggcaaggagctgatgtggaacttcagagagctgagcgagaacagccagcaggccgccaacatcctgagcggcgcctgcggcctgcagagaggcgacagagtggccgtgatgctgcccagagtgcccgagtggtggctggtgatcctgggctgcatcagagccggcctgatcttcatgcccggcaccatccagatgaagagcaccgacatcctgtacagactgcagatgagcaaggccaaggccatcgtggccggcgacgaggtgatccaggaggtggacaccgtggccagcgagtgccccagcctgagaatcaagctgctggtgagcgagaagagctgcgacggctggctgaacttcaagaagctgctgaagtacaaggtgagacacagagaggtgaagtag

SEQ ID NO: 71729 - DNA, 1761 bp, Artificial Sequence
  Description of Artificial Sequence: Synthetic coding sequence
atgctggccagagtgaccagaaagatgctgagacacgccaagtgcttccagagactggccatcttcggcagcgtgagagccctgcacaaggacaacagaaccgccaccccccagaacttcagcaactacgagagcatgaagcaggacttcaagctgggcatccccgagtacttcaacttcgccaaggacgtgctggaccagtggaccgacaaggagaaggccggcaagaagcccagcaaccccgccttctggtggatcaacagaaacggcgaggagatgagatggagcttcgaggagctgggcagcctgagcagaaagttcgccaacatcctgagcgaggcctgcagcctgcagagaggcgacagagtgatcctgatcctgcccagagtgcccgagtggtggctggccaacgtggcctgcctgagaaccggcaccgtgctgatccccggcaccacccagctgacccagaaggacatcctgtacagactgcagagcagcaaggccaactgcatcatcaccaacgacgtgctggcccccgccgtggacgccgtggccagcaagtgcgagaacctgcacagcaagctgatcgtgagcgagaacagcagagagggctggggcaacctgaaggagctgatgaagcacgccagcgacagccacacctgcgtgaagaccaagcacaacgagatcatggccatcttcttcaccagcggcaccagcggctaccccaagatgaccgcccacacccacagcagcttcggcctgggcctgagcgtgaacggcagattctggctggacctgacccccagcgacgtgatgtggaacaccagcgacaccggctgggccaagagcgcctggagcagcgtgttcagcccctggatccagggcgcctgcgtgttcacccaccacctgcccagattcgagcccaccagcatcctgcagaccctgagcaagtaccccatcaccgtgttctgcagcgcccccaccgtgtacagaatgctggtgcagaacgacatcaccagctacaagttcaagagcctgaagcactgcgtgagcgccggcgagcccatcacccccgacgtgaccgagaagtggagaaacaagaccggcctggacatctacgagggctacggccagaccgagaccgtgctgatctgcggcaacttcaagggcatgaagatcaagcccggcagcatgggcaagcccagccccgccttcgacgtgaagatcgtggacgtgaacggcaacgtgctgccccccggccaggagggcgacatcggcatccaggtgctgcccaacagacccttcggcctgttcacccactacgtggacaaccccagcaagaccgccagcaccctgagaggcaacttctacatcaccggcgacagaggctacatggacaaggacggctacttctggttcgtggccagagccgacgacgtgatcctgagcagcggctacagaatcggccccttcgaggtggagaacgccctgaacgagcaccccagcgtggccgagagcgccgtggtgagcagccccgaccccatcagaggcgaggtggtgaaggccttcgtggtgctgaaccccgactacaagagccacgaccaggagcagctgatcaaggagatccaggagcacgtgaagaagaccaccgccccctacaagtaccccagaaaggtggagttcatccaggagctgcccaagaccatcagcggcaagaccaagagaaacgagctgagaaagaaggagtggaagaccatctag

SEQ ID NO: 71730 - DNA, 1317 bp, Artificial Sequence
  Description of Artificial Sequence: Synthetic coding sequence
atgctggccagagtgaccagaaagatgctgagacacgccaagtgcttccagagactggccatcttcggcagcgtgagagccctgcacaaggacaacagaaccgccaccccccagaacttcagcaactacgagagcatgaagcaggacttcaagctgggcatccccgagtacttcaacttcgccaaggacgtgctggaccagtggaccgacaaggagaaggccggcaagaagcccagcaaccccgccttctggtggatcaacagaaacggcgaggagatgagatggagcttcgaggagctgggcagcctgagcagaaagttcgccaacatcctgagcgaggcctgcagcctgcagagaggcgacagagtgatcctgatcctgcccagagtgcccgagtggtggctggccaacgtggcctgcctgagaaccggcaccgtgctgatccccggcaccacccagctgacccagaaggacatcctgtacagactgcagagcagcaaggccaactgcatcatcaccaacgacgtgctggcccccgccgtggacgccgtggccagcaagtgcgagaacctgcacagcaagctgatcgtgagcgagaacagcagagagggctggggcaacctgaaggagctgatgaagcacgccagcgacagccacacctgcgtgaagaccaagcacaacgagatcatggccatcttcttcaccagcggcaccagcggctaccccaagatgaccgcccacacccacagcagcttcggcctgggcctgagcgtgaacggcagattctggctggacctgacccccagcgacgtgatgtggaacaccagcgacaccggctgggccaagagcgcctggagcagcgtgttcagcccctggatccagggcgcctgcgtgttcacccaccacctgcccagattcgagcccaccagcatcctgcagaccctgagcaagtaccccatcaccgtgttctgcagcgcccccaccgtgtacagaatgctggtgcagaacgacatcaccagctacaagttcaagagcctgaagcactgcgtgagcgccggcgagcccatcacccccgacgtgaccgagaagtggagaaacaagaccggcctggacatctacgagggctacggccagaccgagaccgtgctgatctgcggcaacttcaagggcatgaagatcaagcccggcagcatgggcaagcccagccccgccttcgacgtgaaggtgtgcaccagccccagcagaagaatgttcaacaaccccatctgcaccctgcccacctacagactgcccccctacaagctgagcctgctgtag

SEQ ID NO: 71731 - DNA, 1737 bp, Artificial Sequence
  Description of Artificial Sequence: Synthetic coding sequence
atgaagcaggacttcaagctgggcatccccgagtacttcaacttcgccaaggacgtgctggaccagtggaccgacaaggagaaggccggcaagaagcccagcaaccccgccttctggtggatcaacagaaacggcgaggagatgagatggagcttcgaggagctgggcagcctgagcagaaagttcgccaacatcctgagcgaggcctgcagcctgcagagaggcgacagagtgatcctgatcctgcccagagtgcccgagtggtggctggccaacgtggcctgcctgagaaccggcaccgtgctgatccccggcaccacccagctgacccagaaggacatcctgtacagactgcagagcagcaaggccaactgcatcatcaccaacgacgtgctggcccccgccgtggacgccgtggccagcaagtgcgagaacctgcacagcaagctgatcgtgagcgagaacagcagagagggctggggcaacctgaaggagctgatgaaggtgttcctgtgccaccccggctggagcaccgtggccagaagctggctgaccgccaccagcaccagcctggtgcaggccatcctgagcctgctgagcagctgggactacagacacgccagcgacagccacacctgcgtgaagaccaagcacaacgagatcatggccatcttcttcaccagcggcaccagcggctaccccaagatgaccgcccacacccacagcagcttcggcctgggcctgagcgtgaacggcagattctggctggacctgacccccagcgacgtgatgtggaacaccagcgacaccggctgggccaagagcgcctggagcagcgtgttcagcccctggatccagggcgcctgcgtgttcacccaccacctgcccagattcgagcccaccagcatcctgcagaccctgagcaagtaccccatcaccgtgttctgcagcgcccccaccgtgtacagaatgctggtgcagaacgacatcaccagctacaagttcaagagcctgaagcactgcgtgagcgccggcgagcccatcacccccgacgtgaccgagaagtggagaaacaagaccggcctggacatctacgagggctacggccagaccgagaccgtgctgatctgcggcaacttcaagggcatgaagatcaagcccggcagcatgggcaagcccagccccgccttcgacgtgaagatcgtggacgtgaacggcaacgtgctgccccccggccaggagggcgacatcggcatccaggtgctgcccaacagacccttcggcctgttcacccactacgtggacaaccccagcaagaccgccagcaccctgagaggcaacttctacatcaccggcgacagaggctacatggacaaggacggctacttctggttcgtggccagagccgacgacgtgatcctgagcagcggctacagaatcggccccttcgaggtggagaacgccctgaacgagcaccccagcgtggccgagagcgccgtggtgagcagccccgaccccatcagaggcgaggtggtgaaggccttcgtggtgctgaaccccgactacaagagccacgaccaggagcagctgatcaaggagatccaggagcacgtgaagaagaccaccgccccctacaagtaccccagaaaggtggagttcatccaggagctgcccaagaccatcagcggcaagaccaagagaaacgagctgagaaagaaggagtggaagaccatctag

SEQ ID NO: 71732 - DNA, 1740 bp, Artificial Sequence
  Description of Artificial Sequence: Synthetic coding sequence
atgagaccctggctgagacacctggtgctgcaggccctgagaaacagcagagccttctgcggcagccacggcaagcccgcccccctgcccgtgccccagaagatcgtggccacctgggaggccatcagcctgggcagacagctggtgcccgagtacttcaacttcgcccacgacgtgctggacgtgtggagcagactggaggaggccggccacagaccccccaaccccgccttctggtgggtgaacggcaccggcgccgagatcaagtggagcttcgaggagctgggcaagcagagcagaaaggccgccaacgtgctgggcggcgcctgcggcctgcagcccggcgacagaatgatgctggtgctgcccagactgcccgagtggtggctggtgagcgtggcctgcatgagaaccggcaccgtgatgatccccggcgtgacccagctgaccgagaaggacctgaagtacagactgcaggccagcagagccaagagcatcatcaccagcgacagcctggcccccagagtggacgccatcagcgccgagtgccccagcctgcagaccaagctgctggtgagcgacagcagcagacccggctggctgaacttcagagagctgctgagagaggccagcaccgagcacaactgcatgagaaccaagagcagagaccccctggccatctacttcaccagcggcaccaccggcgcccccaagatggtggagcacagccagagcagctacggcctgggcttcgtggccagcggcagaagatgggtggccctgaccgagagcgacatcttctggaacaccaccgacaccggctgggtgaaggccgcctggaccctgttcagcgcctggcccaacggcagctgcatcttcgtgcacgagctgcccagagtggacgccaaggtgatcctgaacaccctgagcaagttccccatcaccaccctgtgctgcgtgcccaccatcttcagactgctggtgcaggaggacctgaccagataccagttccagagcctgagacactgcctgaccggcggcgaggccctgaaccccgacgtgagagagaagtggaagcaccagaccggcgtggagctgtacgagggctacggccagagcgagaccgtggtgatctgcgccaaccccaagggcatgaagatcaagagcggcagcatgggcaaggccagccccccctacgacgtgcagatcgtggacgacgagggcaacgtgctgccccccggcgaggagggcaacgtggccgtgagaatcagacccaccagacccttctgcttcttcaactgctacctggacaaccccgagaagaccgccgccagcgagcagggcgacttctacatcaccggcgacagagccagaatggacaaggacggctacttctggttcatgggcagaaacgacgacgtgatcaacagcagcagctacagaatcggccccgtggaggtggagagcgccctggccgagcaccccgccgtgctggagagcgccgtggtgagcagccccgaccccatcagaggcgaggtggtgaaggccttcatcgtgctgacccccgcctacagcagccacgaccccgaggccctgaccagagagctgcaggagcacgtgaagagagtgaccgccccctacaagtaccccagaaaggtggccttcgtgagcgagctgcccaagaccgtgagcggcaagatccagagaagcaagctgagaagccaggagtggggcaagtag

SEQ ID NO: 71733 - DNA, 2070 bp, Artificial Sequence
  Description of Artificial Sequence: Synthetic coding sequence
atggccgccagaaccctgggcagaggcgtgggcagactgctgggcagcctgagaggcctgagcggccagcccgccagacccccctgcggcgtgagcgcccccagaagagccgccagcggccccagcggcagcgcccccgccgtggccgccgccgccgcccagcccggcagctaccccgccctgagcgcccaggccgccagagagcccgccgccttctggggccccctggccagagacaccctggtgtgggacaccccctaccacaccgtgtgggactgcgacttcagcaccggcaagatcggctggttcctgggcggccagctgaacgtgagcgtgaactgcctggaccagcacgtgagaaagagccccgagagcgtggccctgatctgggagagagacgagcccggcaccgaggtgagaatcacctacagagagctgctggagaccacctgcagactggccaacaccctgaagagacacggcgtgcacagaggcgacagagtggccatctacatgcccgtgagccccctggccgtggccgccatgctggcctgcgccagaatcggcgccgtgcacaccgtgatcttcgccggcttcagcgccgagagcctggccggcagaatcaacgacgccaagtgcaaggtggtgatcaccttcaaccagggcctgagaggcggcagagtggtggagctgaagaagatcgtggacgaggccgtgaagcactgccccaccgtgcagcacgtgctggtggcccacagaaccgacaacaaggtgcacatgggcgacctggacgtgcccctggagcaggagatggccaaggaggaccccgtgtgcgcccccgagagcatgggcagcgaggacatgctgttcatgctgtacaccagcggcagcaccggcatgcccaagggcatcgtgcacacccaggccggctacctgctgtacgccgccctgacccacaagctggtgttcgaccaccagcccggcgacatcttcggctgcgtggccgacatcggctggatcaccggccacagctacgtggtgtacggccccctgtgcaacggcgccaccagcgtgctgttcgagagcacccccgtgtaccccaacgccggcagatactgggagaccgtggagagactgaagatcaaccagttctacggcgcccccaccgccgtgagactgctgctgaagtacggcgacgcctgggtgaagaagtacgacagaagcagcctgagaaccctgggcagcgtgggcgagcccatcaactgcgaggcctgggagtggctgcacagagtggtgggcgacagcagatgcaccctggtggacacctggtggcagaccgagaccggcggcatctgcatcgcccccagacccagcgaggagggcgccgagatcctgcccgccatggccatgagacccttcttcggcatcgtgcccgtgctgatggacgagaagggcagcgtggtggagggcagcaacgtgagcggcgccctgtgcatcagccaggcctggcccggcatggccagaaccatctacggcgaccaccagagattcgtggacgcctacttcaaggcctaccccggctactacttcaccggcgacggcgcctacagaaccgagggcggctactaccagatcaccggcagaatggacgacgtgatcaacatcagcggccacagactgggcaccgccgagatcgaggacgccatcgccgaccaccccgccgtgcccgagagcgccgtgatcggctacccccacgacatcaagggcgaggccgccttcgccttcatcgtggtgaaggacagcgccggcgacagcgacgtggtggtgcaggagctgaagagcatggtggccaccaagatcgccaagtacgccgtgcccgacgagatcctggtggtgaagagactgcccaagaccagaagcggcaaggtgatgagaagactgctgagaaagatcatcaccagcgaggcccaggagctgggcgacaccaccaccctggaggaccccagcatcatcgccgagatcctgagcgtgtaccagaagtgcaaggacaagcaggccgccgccaagtag

SEQ ID NO: 71734 - DNA, 462 bp, Artificial Sequence
  Description of Artificial Sequence: Synthetic coding sequence
atggccgccagaaccctgggcagaggcgtgggcagactgctgggcagcctgagaggcctgagcggccagcccgccagacccccctgcggcgtgagcgcccccagaagagccgccagcggccccagcggcagcgcccccgccgtggccgccgccgccgcccagcccggcagctaccccgccctgagcgcccaggccgccagagagcccgccgccttctggggccccctggccagagacaccctggtgtgggacaccccctaccacaccgtgtgggactgcgacttcagcaccggcaagatcggctggttcctgggcggccagctgaacgtgagcgtgaactgcctggaccagcacgtgagaaagagccccgagagcgtggccctgatctgggagagagacgagcccggcaccgaggtgagaatcacctacagcccctggctgcagatgccctgcggcccctag

SEQ ID NO: 71735 - DNA, 1455 bp, Artificial Sequence
  Description of Artificial Sequence: Synthetic coding sequence
atggccgccagaaccctgggcagaggcgtgggcagactgctgggcagcctgagaggcctgagcggccagcccgccagacccccctgcggcgtgagcgcccccagaagagccgccagcggccccagcggcagcgcccccgccgtggccgccgccgccgcccagcccggcagctaccccgccctgagcgcccaggccgccagagagcccgccgccttctggggccccctggccagagacaccctggtgtgggacaccccctaccacaccgtgtgggactgcgacttcagcaccggcaagatcggctggttcctgggcggccagctgaacgtgagcgtgaactgcctggaccagcacgtgagaaagagccccgagagcgtggccctgatctgggagagagacgagcccggcaccgaggtgagaatcacctacagagagctgctggagaccacctgcagactggccaacaccctgaagagacacggcgtgcacagaggcgacagagtggccatctacatgcccgtgagccccctggccgtggccgccatgctggcctgcgccagaatcggcgccgtgcacaccgtgatcttcgccggcttcagcgccgagagcctggccggcagaatcaacgacgtgggcgagcccatcaactgcgaggcctgggagtggctgcacagagtggtgggcgacagcagatgcaccctggtggacacctggtggcagaccgagaccggcggcatctgcatcgcccccagacccagcgaggagggcgccgagatcctgcccgccatggccatgagacccttcttcggcatcgtgcccgtgctgatggacgagaagggcagcgtggtggagggcagcaacgtgagcggcgccctgtgcatcagccaggcctggcccggcatggccagaaccatctacggcgaccaccagagattcgtggacgcctacttcaaggcctaccccggctactacttcaccggcgacggcgcctacagaaccgagggcggctactaccagatcaccggcagaatggacgacgtgatcaacatcagcggccacagactgggcaccgccgagatcgaggacgccatcgccgaccaccccgccgtgcccgagagcgccgtgatcggctacccccacgacatcaagggcgaggccgccttcgccttcatcgtggtgaaggacagcgccggcgacagcgacgtggtggtgcaggagctgaagagcatggtggccaccaagatcgccaagtacgccgtgcccgacgagatcctggtggtgaagagactgcccaagaccagaagcggcaaggtgatgagaagactgctgagaaagatcatcaccagcgaggcccaggagctgggcgacaccaccaccctggaggaccccagcatcatcgccgagatcctgagcgtgtaccagaagtgcaaggacaagcaggccgccgccaagtag

SEQ ID NO: 71736 - DNA, 1728 bp, Artificial Sequence
  Description of Artificial Sequence: Synthetic coding sequence
atggccgccagaaccctgggcagaggcgtgggcagactgctgggcagcctgagaggcctgagcggccagcccgccagacccccctgcggcgtgagcgcccccagaagagccgccagcggccccagcggcagcgcccccgccgtggccgccgccgccgcccagcccggcagctaccccgccctgagcgcccaggccgccagagagcccgccgccttctggggccccctggccagagacaccctggtgtgggacaccccctaccacaccgtgtgggactgcgacttcagcaccggcaagatcggctggttcctgggcggccagctgaacgtgagcgtgaactgcctggaccagcacgtgagaaagagccccgagagcgtggccctgatctgggagagagacgagcccggcaccgaggtgagaatcacctacagagagctgctggagaccacctgcagactggccaacaccctgaagagacacggcgtgcacagaggcgacagagtggccatctacatgcccgtgagccccctggccgtggccgccatgctggcctgcgccagaatcggcgccgtgcacaccgtgatcttcgccggcttcagcgccgagagcctggccggcagaatcaacgacgccaagtgcaaggtggtgatcaccttcaaccagggcctgagaggcggcagagtggtggagctgaagaagatcgtggacgaggccgtgaagcactgccccaccgtgcagcacgtgctggtggcccacagaaccgacaacaaggtgcacatgggcgacctggacgtgcccctggagcaggagatggccaaggaggaccccgtgtgcgcccccgagagcatgggcagcgaggacatgctgttcatgctgtacaccagcggcagcaccggcatgcccaagggcatcgtgcacacccaggccggctacctgctgtacgccgccctgacccacaagctggtgttcgaccaccagcccggcgacatcttcggctgcgtggccgacatcggctggatcaccggccacagctacgtggtgtacggccccctgtgcaacggcgccaccagcgtgctgttcgagagcacccccgtgtaccccaacgccggcagatactgggagaccgtggagagactgaagatcaaccagttctacggcgcccccaccgccgtgagactgctgctgaagtacggcgacgcctgggtgaagaagtacgacagaagcagcctgagaaccctgggcagcgtgggcgagcccatcaactgcgaggcctgggagtggctgcacagagtggtgggcgacagcagatgcaccctggtggacacctggtggcagaccgagaccggcggcatctgcatcgcccccagacccagcgaggagggcgccgagatcctgcccgccatggccatgagacccttcttcggcatcgtgcccgtgctgatggacgagaagggcagcgtggtggagggcagcaacgtgagcggcgccctgtgcatcagccaggcctggcccggcatggccagaaccatctacggcgaccaccagagattcgtggacgcctacttcaaggcctaccccggctactacttcaccggcgacggcgcctacagaaccgagggcggctactaccagatcaccggcagaatggacgacgtgatcaacatcctgcagatcgtgggcttcttcagagaggccatcagaaacagcggcgacctgctggagcactag

SEQ ID NO: 71737 - DNA, 1821 bp, Artificial Sequence
  Description of Artificial Sequence: Synthetic coding sequence
atgctgaagaccttcctgttcctggagaagtacttcccctgcatcaagtacagcagcgcctgcttccccggcaccggcctggacgtgtacgacatcaagttcgccgtgctgctgcacccccagaccgccctgcacttcggccccccccccagcctgatggccttcagcagcctgtgctgcagagagctgctggagaccacctgcagactggccaacaccctgaagagacacggcgtgcacagaggcgacagagtggccatctacatgcccgtgagccccctggccgtggccgccatgctggcctgcgccagaatcggcgccgtgcacaccgtgatcttcgccggcttcagcgccgagagcctggccggcagaatcaacgacgccaagtgcaaggtggtgatcaccttcaaccagggcctgagaggcggcagagtggtggagctgaagaagatcgtggacgaggccgtgaagcactgccccaccgtgcagcacgtgctggtggcccacagaaccgacaacaaggtgcacatgggcgacctggacgtgcccctggagcaggagatggccaaggaggaccccgtgtgcgcccccgagagcatgggcagcgaggacatgctgttcatgctgtacaccagcggcagcaccggcatgcccaagggcatcgtgcacacccaggccggctacctgctgtacgccgccctgacccacaagctggtgttcgaccaccagcccggcgacatcttcggctgcgtggccgacatcggctggatcaccggccacagctacgtggtgtacggccccctgtgcaacggcgccaccagcgtgctgttcgagagcacccccgtgtaccccaacgccggcagatactgggagaccgtggagagactgaagatcaaccagttctacggcgcccccaccgccgtgagactgctgctgaagtacggcgacgcctgggtgaagaagtacgacagaagcagcctgagaaccctgggcagcgtgggcgagcccatcaactgcgaggcctgggagtggctgcacagagtggtgggcgacagcagatgcaccctggtggacacctggtggcagaccgagaccggcggcatctgcatcgcccccagacccagcgaggagggcgccgagatcctgcccgccatggccatgagacccttcttcggcatcgtgcccgtgctgatggacgagaagggcagcgtggtggagggcagcaacgtgagcggcgccctgtgcatcagccaggcctggcccggcatggccagaaccatctacggcgaccaccagagattcgtggacgcctacttcaaggcctaccccggctactacttcaccggcgacggcgcctacagaaccgagggcggctactaccagatcaccggcagaatggacgacgtgatcaacatcagcggccacagactgggcaccgccgagatcgaggacgccatcgccgaccaccccgccgtgcccgagagcgccgtgatcggctacccccacgacatcaagggcgaggccgccttcgccttcatcgtggtgaaggacagcgccggcgacagcgacgtggtggtgcaggagctgaagagcatggtggccaccaagatcgccaagtacgccgtgcccgacgagatcctggtggtgaagagactgcccaagaccagaagcggcaaggtgatgagaagactgctgagaaagatcatcaccagcgaggcccaggagctgggcgacaccaccaccctggaggaccccagcatcatcgccgagatcctgagcgtgtaccagaagtgcaaggacaagcaggccgccgccaagtag

SEQ ID NO: 71738 - DNA, 1707 bp, Artificial Sequence
  Description of Artificial Sequence: Synthetic coding sequence
atgagaagaagaaaggagagacagccctgggacagattccacttcctgcacttcgccccccacggcagagagctgctggagaccacctgcagactggccaacaccctgaagagacacggcgtgcacagaggcgacagagtggccatctacatgcccgtgagccccctggccgtggccgccatgctggcctgcgccagaatcggcgccgtgcacaccgtgatcttcgccggcttcagcgccgagagcctggccggcagaatcaacgacgccaagtgcaaggtggtgatcaccttcaaccagggcctgagaggcggcagagtggtggagctgaagaagatcgtggacgaggccgtgaagcactgccccaccgtgcagcacgtgctggtggcccacagaaccgacaacaaggtgcacatgggcgacctggacgtgcccctggagcaggagatggccaaggaggaccccgtgtgcgcccccgagagcatgggcagcgaggacatgctgttcatgctgtacaccagcggcagcaccggcatgcccaagggcatcgtgcacacccaggccggctacctgctgtacgccgccctgacccacaagctggtgttcgaccaccagcccggcgacatcttcggctgcgtggccgacatcggctggatcaccggccacagctacgtggtgtacggccccctgtgcaacggcgccaccagcgtgctgttcgagagcacccccgtgtaccccaacgccggcagatactgggagaccgtggagagactgaagatcaaccagttctacggcgcccccaccgccgtgagactgctgctgaagtacggcgacgcctgggtgaagaagtacgacagaagcagcctgagaaccctgggcagcgtgggcgagcccatcaactgcgaggcctgggagtggctgcacagagtggtgggcgacagcagatgcaccctggtggacacctggtggcagaccgagaccggcggcatctgcatcgcccccagacccagcgaggagggcgccgagatcctgcccgccatggccatgagacccttcttcggcatcgtgcccgtgctgatggacgagaagggcagcgtggtggagggcagcaacgtgagcggcgccctgtgcatcagccaggcctggcccggcatggccagaaccatctacggcgaccaccagagattcgtggacgcctacttcaaggcctaccccggctactacttcaccggcgacggcgcctacagaaccgagggcggctactaccagatcaccggcagaatggacgacgtgatcaacatcagcggccacagactgggcaccgccgagatcgaggacgccatcgccgaccaccccgccgtgcccgagagcgccgtgatcggctacccccacgacatcaagggcgaggccgccttcgccttcatcgtggtgaaggacagcgccggcgacagcgacgtggtggtgcaggagctgaagagcatggtggccaccaagatcgccaagtacgccgtgcccgacgagatcctggtggtgaagagactgcccaagaccagaagcggcaaggtgatgagaagactgctgagaaagatcatcaccagcgaggcccaggagctgggcgacaccaccaccctggaggaccccagcatcatcgccgagatcctgagcgtgtaccagaagtgcaaggacaagcaggccgccgccaagtag

SEQ ID NO: 71739 - DNA, 2145 bp, Artificial Sequence
  Description of Artificial Sequence: Synthetic coding sequence
atgggcctgcccgaggagagagtgagaagcggcagcggcagcagaggccaggaggaggccggcgccggcggcagagccagaagctggagccccccccccgaggtgagcagaagcgcccacgtgcccagcctgcagagatacagagagctgcacagaagaagcgtggaggagcccagagagttctggggcgacatcgccaaggagttctactggaagaccccctgccccggccccttcctgagatacaacttcgacgtgaccaagggcaagatcttcatcgagtggatgaagggcgccaccaccaacatctgctacaacgtgctggacagaaacgtgcacgagaagaagctgggcgacaaggtggccttctactgggagggcaacgagcccggcgagaccacccagatcacctaccaccagctgctggtgcaggtgtgccagttcagcaacgtgctgagaaagcagggcatccagaagggcgacagagtggccatctacatgcccatgatccccgagctggtggtggccatgctggcctgcgccagaatcggcgccctgcacagcatcgtgttcgccggcttcagcagcgagagcctgtgcgagagaatcctggacagcagctgcagcctgctgatcaccaccgacgccttctacagaggcgagaagctggtgaacctgaaggagctggccgacgaggccctgcagaagtgccaggagaagggcttccccgtgagatgctgcatcgtggtgaagcacctgggcagagccgagctgggcatgggcgacagcaccagccagagcccccccatcaagagaagctgccccgacgtgcagggcaagctgaaggagaagagcaagagagtgcagccccagatcagctggaaccagggcatcgacctgtggtggcacgagctgatgcaggaggccggcgacgagtgcgagcccgagtggtgcgacgccgaggaccccctgttcatcctgtacaccagcggcagcaccggcaagcccaagggcgtggtgcacaccgtgggcggctacatgctgtacgtggccaccaccttcaagtacgtgttcgacttccacgccgaggacgtgttctggtgcaccgccgacatcggctggatcaccggccacagctacgtgacctacggccccctggccaacggcgccaccagcgtgctgttcgagggcatccccacctaccccgacgtgaacagactgtggagcatcgtggacaagtacaaggtgaccaagttctacaccgcccccaccgccatcagactgctgatgaagttcggcgacgagcccgtgaccaagcacagcagagccagcctgcaggtgctgggcaccgtgggcgagcccatcaaccccgaggcctggctgtggtaccacagagtggtgggcgcccagagatgccccatcgtggacaccttctggcagaccgagaccggcggccacatgctgacccccctgcccggcgccacccccatgaagcccggcagcgccaccttccccttcttcggcgtggcccccgccatcctgaacgagagcggcgaggagctggagggcgaggccgagggctacctggtgttcaagcagccctggcccggcatcatgagaaccgtgtacggcaaccacgagagattcgagaccacctacttcaagaagttccccggctactacgtgaccggcgacggctgccagagagaccaggacggctactactggatcaccggcagaatcgacgacatgctgaacgtgagcggccacctgctgagcaccgccgaggtggagagcgccctggtggagcacgaggccgtggccgaggccgccgtggtgggccacccccaccccgtgaagggcgagtgcctgtactgcttcgtgaccctgtgcgacggccacaccttcagccccaagctgaccgaggagctgaagaagcagatcagagagaagatcggccccatcgccacccccgactacatccagaacgcccccggcctgcccaagaccagaagcggcaagatcatgagaagagtgctgagaaagatcgcccagaacgaccacgacctgggcgacatgagcaccgtggccgaccccagcgtgatcagccacctgttcagccacagatgcctgaccatccagtag

SEQ ID NO: 71740 - DNA, 1956 bp, Artificial Sequence
  Description of Artificial Sequence: Synthetic coding sequence
atgatggtgagatgggccctgctgtgcgagttctggggcgacatcgccaaggagttctactggaagaccccctgccccggccccttcctgagatacaacttcgacgtgaccaagggcaagatcttcatcgagtggatgaagggcgccaccaccaacatctgctacaacgtgctggacagaaacgtgcacgagaagaagctgggcgacaaggtggccttctactgggagggcaacgagcccggcgagaccacccagatcacctaccaccagctgctggtgcaggtgtgccagttcagcaacgtgctgagaaagcagggcatccagaagggcgacagagtggccatctacatgcccatgatccccgagctggtggtggccatgctggcctgcgccagaatcggcgccctgcacagcatcgtgttcgccggcttcagcagcgagagcctgtgcgagagaatcctggacagcagctgcagcctgctgatcaccaccgacgccttctacagaggcgagaagctggtgaacctgaaggagctggccgacgaggccctgcagaagtgccaggagaagggcttccccgtgagatgctgcatcgtggtgaagcacctgggcagagccgagctgggcatgggcgacagcaccagccagagcccccccatcaagagaagctgccccgacgtgcagatcagctggaaccagggcatcgacctgtggtggcacgagctgatgcaggaggccggcgacgagtgcgagcccgagtggtgcgacgccgaggaccccctgttcatcctgtacaccagcggcagcaccggcaagcccaagggcgtggtgcacaccgtgggcggctacatgctgtacgtggccaccaccttcaagtacgtgttcgacttccacgccgaggacgtgttctggtgcaccgccgacatcggctggatcaccggccacagctacgtgacctacggccccctggccaacggcgccaccagcgtgctgttcgagggcatccccacctaccccgacgtgaacagactgtggagcatcgtggacaagtacaaggtgaccaagttctacaccgcccccaccgccatcagactgctgatgaagttcggcgacgagcccgtgaccaagcacagcagagccagcctgcaggtgctgggcaccgtgggcgagcccatcaaccccgaggcctggctgtggtaccacagagtggtgggcgcccagagatgccccatcgtggacaccttctggcagaccgagaccggcggccacatgctgacccccctgcccggcgccacccccatgaagcccggcagcgccaccttccccttcttcggcgtggcccccgccatcctgaacgagagcggcgaggagctggagggcgaggccgagggctacctggtgttcaagcagccctggcccggcatcatgagaaccgtgtacggcaaccacgagagattcgagaccacctacttcaagaagttccccggctactacgtgaccggcgacggctgccagagagaccaggacggctactactggatcaccggcagaatcgacgacatgctgaacgtgagcggccacctgctgagcaccgccgaggtggagagcgccctggtggagcacgaggccgtggccgaggccgccgtggtgggccacccccaccccgtgaagggcgagtgcctgtactgcttcgtgaccctgtgcgacggccacaccttcagccccaagctgaccgaggagctgaagaagcagatcagagagaagatcggccccatcgccacccccgactacatccagaacgcccccggcctgcccaagaccagaagcggcaagatcatgagaagagtgctgagaaagatcgcccagaacgaccacgacctgggcgacatgagcaccgtggccgaccccagcgtgatcagccacctgttcagccacagatgcctgaccatccagtag

SEQ ID NO: 71741 - DNA, 2106 bp, Artificial Sequence
  Description of Artificial Sequence: Synthetic coding sequence
atgggcctgcccgaggagagagtgagaagcggcagcggcagcagaggccaggaggaggccggcgccggcggcagagccagaagctggagccccccccccgaggtgagcagaagcgcccacgtgcccagcctgcagagatacagagagctgcacagaagaagcgtggaggagcccagagagttctggggcgacatcgccaaggagttctactggaagaccccctgccccggccccttcctgagatacaacttcgacgtgaccaagggcaagatcttcatcgagtggatgaagggcgccaccaccaacatctgctacaacgtgctggacagaaacgtgcacgagaagaagctgggcgacaaggtggccttctactgggagggcaacgagcccggcgagaccacccagatcacctaccaccagctgctggtgcaggtgtgccagttcagcaacgtgctgagaaagcagggcatccagaagggcgacagagtggccatctacatgcccatgatccccgagctggtggtggccatgctggcctgcgccagaatcggcgccctgcacagcatcgtgttcgccggcttcagcagcgagagcctgtgcgagagaatcctggacagcagctgcagcctgctgatcaccaccgacgccttctacagaggcgagaagctggtgaacctgaaggagctggccgacgaggccctgcagaagtgccaggagaagggcttccccgtgagatgctgcatcgtggtgaagcacctgggcagagccgagctgggcatgggcgacagcaccagccagagcccccccatcaagagaagctgccccgacgtgcagatcagctggaaccagggcatcgacctgtggtggcacgagctgatgcaggaggccggcgacgagtgcgagcccgagtggtgcgacgccgaggaccccctgttcatcctgtacaccagcggcagcaccggcaagcccaagggcgtggtgcacaccgtgggcggctacatgctgtacgtggccaccaccttcaagtacgtgttcgacttccacgccgaggacgtgttctggtgcaccgccgacatcggctggatcaccggccacagctacgtgacctacggccccctggccaacggcgccaccagcgtgctgttcgagggcatccccacctaccccgacgtgaacagactgtggagcatcgtggacaagtacaaggtgaccaagttctacaccgcccccaccgccatcagactgctgatgaagttcggcgacgagcccgtgaccaagcacagcagagccagcctgcaggtgctgggcaccgtgggcgagcccatcaaccccgaggcctggctgtggtaccacagagtggtgggcgcccagagatgccccatcgtggacaccttctggcagaccgagaccggcggccacatgctgacccccctgcccggcgccacccccatgaagcccggcagcgccaccttccccttcttcggcgtggcccccgccatcctgaacgagagcggcgaggagctggagggcgaggccgagggctacctggtgttcaagcagccctggcccggcatcatgagaaccgtgtacggcaaccacgagagattcgagaccacctacttcaagaagttccccggctactacgtgaccggcgacggctgccagagagaccaggacggctactactggatcaccggcagaatcgacgacatgctgaacgtgagcggccacctgctgagcaccgccgaggtggagagcgccctggtggagcacgaggccgtggccgaggccgccgtggtgggccacccccaccccgtgaagggcgagtgcctgtactgcttcgtgaccctgtgcgacggccacaccttcagccccaagctgaccgaggagctgaagaagcagatcagagagaagatcggccccatcgccacccccgactacatccagaacgcccccggcctgcccaagaccagaagcggcaagatcatgagaagagtgctgagaaagatcgcccagaacgaccacgacctgggcgacatgagcaccgtggccgaccccagcgtgatcagccacctgttcagccacagatgcctgaccatccagtag

SEQ ID NO: 71742 - DNA, 2100 bp, Artificial Sequence
  Description of Artificial Sequence: Synthetic coding sequence
atgggcctgcccgaggagagagtgagaagcggcagcggcagcagaggccaggaggaggccggcgccggcggcagagccagaagctggagccccccccccgaggtgagcagaagcgcccacgtgcccagcctgcagagatacagagagctgcacagaagaagcgtggaggagcccagagagttctggggcgacatcgccaaggagttctactggaagaccccctgccccggccccttcctgagatacaacttcgacgtgaccaagggcaagatcttcatcgagtggatgaagggcgccaccaccaacatctgctacaacgtgctggacagaaacgtgcacgagaagaagctgggcgacaaggtggccttctactgggagggcaacgagcccggcgagaccacccagatcacctaccaccagctgctggtgcaggtgtgccagttcagcaacgtgctgagaaagcagggcatccagaagggcgacagagtggccatctacatgcccatgatccccgagctggtggtggccatgctggcctgcgccagaatcggcgccctgcacagcatcgtgttcgccggcttcagcagcgagagcctgtgcgagagaatcctggacagcagctgcagcctgctgatcaccaccgacgccttctacagaggcgagaagctggtgaacctgaaggagctggccgacgaggccctgcagaagtgccaggagaagggcttccccgtgagatgctgcatcgtggtgaagcacctgggcagagccgagctgggcatgggcgacagcaccagccagagcccccccatcaagagaagctgccccgacgtgcagatcagctggaaccagggcatcgacctgtggtggcacgagctgatgcaggaggccggcgacgagtgcgagcccgagtggtgcgacgccgagcacagcagcagctgcacccccgtggccccccaggccaaccccagagtgtggttcacccagctgggcgccacctgctacgtggccaccaccttcaagtacgtgttcgacttccacgccgaggacgtgttctggtgcaccgccgacatcggctggatcaccggccacagctacgtgacctacggccccctggccaacggcgccaccagcgtgctgttcgagggcatccccacctaccccgacgtgaacagactgtggagcatcgtggacaagtacaaggtgaccaagttctacaccgcccccaccgccatcagactgctgatgaagttcggcgacgagcccgtgaccaagcacagcagagccagcctgcaggtgctgggcaccgtgggcgagcccatcaaccccgaggcctggctgtggtaccacagagtggtgggcgcccagagatgccccatcgtggacaccttctggcagaccgagaccggcggccacatgctgacccccctgcccggcgccacccccatgaagcccggcagcgccaccttccccttcttcggcgtggcccccgccatcctgaacgagagcggcgaggagctggagggcgaggccgagggctacctggtgttcaagcagccctggcccggcatcatgagaaccgtgtacggcaaccacgagagattcgagaccacctacttcaagaagttccccggctactacgtgaccggcgacggctgccagagagaccaggacggctactactggatcaccggcagaatcgacgacatgctgaacgtgagcggccacctgctgagcaccgccgaggtggagagcgccctggtggagcacgaggccgtggccgaggccgccgtggtgggccacccccaccccgtgaagggcgagtgcctgtactgcttcgtgaccctgtgcgacggccacaccttcagccccaagctgaccgaggagctgaagaagcagatcagagagaagatcggccccatcgccacccccgactacatccagaacgcccccggcctgcccaagaccagaagcggcaagatcatgagaagagtgctgagaaagatcgcccagaacgaccacgacctgggcgacatgagcaccgtggccgaccccagcgtgatcagccacctgttcagccacagatgcctgaccatccagtag

SEQ ID NO: 71743 - DNA, 1230 bp, Artificial Sequence
  Description of Artificial Sequence: Synthetic coding sequence
atgcaggaggccggcgacgagtgcgagcccgagtggtgcgacgccgaggaccccctgttcatcctgtacaccagcggcagcaccggcaagcccaagggcgtggtgcacaccgtgggcggctacatgctgtacgtggccaccaccttcaagtacgtgttcgacttccacgccgaggacgtgttctggtgcaccgccgacatcggctggatcaccggccacagctacgtgacctacggccccctggccaacggcgccaccagcgtgctgttcgagggcatccccacctaccccgacgtgaacagactgtggagcatcgtggacaagtacaaggtgaccaagttctacaccgcccccaccgccatcagactgctgatgaagttcggcgacgagcccgtgaccaagcacagcagagccagcctgcaggtgctgggcaccgtgggcgagcccatcaaccccgaggcctggctgtggtaccacagagtggtgggcgcccagagatgccccatcgtggacaccttctggcagaccgagaccggcggccacatgctgacccccctgcccggcgccacccccatgaagcccggcagcgccaccttccccttcttcggcgtggcccccgccatcctgaacgagagcggcgaggagctggagggcgaggccgagggctacctggtgttcaagcagccctggcccggcatcatgagaaccgtgtacggcaaccacgagagattcgagaccacctacttcaagaagttccccggctactacgtgaccggcgacggctgccagagagaccaggacggctactactggatcaccggcagaatcgacgacatgctgaacgtgagcggccacctgctgagcaccgccgaggtggagagcgccctggtggagcacgaggccgtggccgaggccgccgtggtgggccacccccaccccgtgaagggcgagtgcctgtactgcttcgtgaccctgtgcgacggccacaccttcagccccaagctgaccgaggagctgaagaagcagatcagagagaagatcggccccatcgccacccccgactacatccagaacgcccccggcctgcccaagaccagaagcggcaagatcatgagaagagtgctgagaaagatcgcccagaacgaccacgacctgggcgacatgagcaccgtggccgaccccagcgtgatcagccacctgttcagccacagatgcctgaccatccagtag

SEQ ID NO: 71744 - DNA, 114 bp, Artificial Sequence
  Description of Artificial Sequence: Synthetic coding sequence
atgatggtgagatgggccctgctgtgcggcgagtgcagaatcctgggcagacactgccagggcatcctgctggaggacagcatgccctggcccatccccagcgtgcagctgtag

SEQ ID NO: 71745 - DNA, 2061 bp, Artificial Sequence
  Description of Artificial Sequence: Synthetic coding sequence
atgaagcccagctggctgcagtgcagaaaggtgaccagcgccggcggcctgggcggccccctgcccggcagcagccccgccagaggcgccggcgccgccctgagagccctggtggtgcccggccccagaggcggcctgggcggcagaggctgcagagccctgagcagcggcagcggcagcgagtacaagacccacttcgccgccagcgtgaccgaccccgagagattctggggcaaggccgccgagcagatcagctggtacaagccctggaccaagaccctggagaacaagcacagccccagcaccagatggttcgtggagggcatgctgaacatctgctacaacgccgtggacagacacatcgagaacggcaagggcgacaagatcgccatcatctacgacagccccgtgaccaacaccaaggccaccttcacctacaaggaggtgctggagcaggtgagcaagctggccggcgtgctggtgaagcacggcatcaagaagggcgacaccgtggtgatctacatgcccatgatcccccaggccatgtacaccatgctggcctgcgccagaatcggcgccatccacagcctgatcttcggcggcttcgccagcaaggagctgagcagcagaatcgaccacgtgaagcccaaggtggtggtgaccgccagcttcggcatcgagcccggcagaagagtggagtacgtgcccctggtggaggaggccctgaagatcggccagcacaagcccgacaagatcctgatctacaacagacccaacatggaggccgtgcccctggcccccggcagagacctggactgggacgaggagatggccaaggcccagagccacgactgcgtgcccgtgctgagcgagcaccccctgtacatcctgtacaccagcggcaccaccggcctgcccaagggcgtgatcagacccaccggcggctacgccgtgatgctgcactggagcatgagcagcatctacggcctgcagcccggcgaggtgtggtgggccgccagcgacctgggctgggtggtgggccacagctacatctgctacggccccctgctgcacggcaacaccaccgtgctgtacgagggcaagcccgtgggcacccccgacgccggcgcctacttcagagtgctggccgagcacggcgtggccgccctgttcaccgcccccaccgccatcagagccatcagacagcaggaccccggcgccgccctgggcaagcagtacagcctgaccagattcaagaccctgttcgtggccggcgagagatgcgacgtggagaccctggagtggagcaagaacgtgttcagagtgcccgtgctggaccactggtggcagaccgagaccggcagccccatcaccgccagctgcgtgggcctgggcaacagcaagacccccccccccggccaggccggcaagagcgtgcccggctacaacgtgatgatcctggacgacaacatgcagaagctgaaggccagatgcctgggcaacatcgtggtgaagctgcccctgccccccggcgccttcagcggcctgtggaagaaccaggaggccttcaagcacctgtacttcgagaagttccccggctactacgacaccatggacgccggctacatggacgaggagggctacctgtacgtgatgagcagagtggacgacgtgatcaacgtggccggccacagaatcagcgccggcgccatcgaggagagcatcctgagccacggcaccgtggccgactgcgccgtggtgggcaaggaggaccccctgaagggccacgtgcccctggccctgtgcgtgctgagaaaggacatcaacgccaccgaggagcaggtgctggaggagatcgtgaagcacgtgagacagaacatcggccccgtggccgccttcagaaacgccgtgttcgtgaagcagctgcccaagaccagaagcggcaagatccccagaagcgccctgagcgccatcgtgaacggcaagccctacaagatcaccagcaccatcgaggaccccagcatcttcggccacgtggaggagatgctgaagcaggcctag

SEQ ID NO: 71746 - DNA, 1107 bp, Artificial Sequence
  Description of Artificial Sequence: Synthetic coding sequence
atgctgcactggagcatgagcagcatctacggcctgcagcccggcgaggtgtggtgggccgccagcgacctgggctgggtggtgggccacagctacatctgctacggccccctgctgcacggcaacaccaccgtgctgtacgagggcaagcccgtgggcacccccgacgccggcgcctacttcagagtgctggccgagcacggcgtggccgccctgttcaccgcccccaccgccatcagagccatcagacagcaggaccccggcgccgccctgggcaagcagtacagcctgaccagattcaagaccctgttcgtggccggcgagagatgcgacgtggagaccctggagtggagcaagaacgtgttcagagtgcccgtgctggaccactggtggcagaccgagaccggcagccccatcaccgccagctgcgtgggcctgggcaacagcaagacccccccccccggccaggccggcaagagcgtgcccggctacaacgtgatgatcctggacgacaacatgcagaagctgaaggccagatgcctgggcaacatcgtggtgaagctgcccctgccccccggcgccttcagcggcctgtggaagaaccaggaggccttcaagcacctgtacttcgagaagttccccggctactacgacaccatggacgccggctacatggacgaggagggctacctgtacgtgatgagcagagtggacgacgtgatcaacgtggccggccacagaatcagcgccggcgccatcgaggagagcatcctgagccacggcaccgtggccgactgcgccgtggtgggcaaggaggaccccctgaagggccacgtgcccctggccctgtgcgtgctgagaaaggacatcaacgccaccgaggagcaggtgctggaggagatcgtgaagcacgtgagacagaacatcggccccgtggccgccttcagaaacgccgtgttcgtgaagcagctgcccaagaccagaagcggcaagatccccagaagcgccctgagcgccatcgtgaacggcaagccctacaagatcaccagcaccatcgaggaccccagcatcttcggccacgtggaggagatgctgaagcaggcctag

SEQ ID NO: 71747 - DNA, 1266 bp, Artificial Sequence
  Description of Artificial Sequence: Synthetic coding sequence
atggccgccaccctgatcctggagcccgccggcagatgctgctgggacgagcccgtgagaatcgccgtgagaggcctggcccccgagcagcccgtgaccctgagagccagcctgagagacgagaagggcgccctgttccaggcccacgccagatacagagccgacaccctgggcgagctggacctggagagagcccccgccctgggcggcagcttcgccggcctggagcccatgggcctgctgtgggccctggagcccgagaagcccctggtgagactggtgaagagagacgtgagaacccccctggccgtggagctggaggtgctggacggccacgaccccgaccccggcagactgctgtgcagagtgagacacgagagatacttcctgccccccggcgtgagaagagagcccgtgagagccggcagagtgagaggcaccctgttcctgccccccgagcccggccccttccccggcatcgtggacatgttcggcaccggcggcggcctgctggagtacagagccagcctgctggccggcaagggcttcgccgtgatggccctggcctactacaactacgaggacctgcccaagaccatggagaccctgcacctggagtacttcgaggaggccgtgaactacctgctgagccaccccgaggtgaagggccccggcgtgggcctgctgggcatcagcaagggcggcgagctgtgcctgagcatggccagcttcctgaagggcatcaccgccgccgtggtgatcaacggcagcgtggccaacgtgggcggcaccctgagatacaagggcgagaccctgccccccgtgggcgtgaacagaaacagaatcaaggtgaccaaggacggctacgccgacatcgtggacgtgctgaacagccccctggagggccccgaccagaagagcttcatccccgtggagagagccgagagcaccttcctgttcctggtgggccaggacgaccacaactggaagagcgagttctacgccaacgaggcctgcaagagactgcaggcccacggcagaagaaagccccagatcatctgctaccccgagaccggccactacatcgagcccccctacttccccctgtgcagagccagcctgcacgccctggtgggcagccccatcatctggggcggcgagcccagagcccacgccatggcccaggtggacgcctggaagcagctgcagaccttcttccacaagcacctgggcggccacgagggcaccatccccagcaaggtgtag

SEQ ID NO: 71748 - DNA, 1785 bp, Artificial Sequence
  Description of Artificial Sequence: Synthetic coding sequence
atgatccagaacgtgggcaaccacctgagaagaggcctggccagcgtgttcagcaacagaaccagcagaaagagcgccctgagagccggcaacgacagcgccatggccgacggcgagggctacagaaaccccaccgaggtgcagatgagccagctggtgctgccctgccacaccaaccagagaggcgagctgagcgtgggccagctgctgaagtggatcgacaccaccgcctgcctgagcgccgagagacacgccggctgcccctgcgtgaccgccagcatggacgacatctacttcgagcacaccatcagcgtgggccaggtggtgaacatcaaggccaaggtgaacagagccttcaacagcagcatggaggtgggcatccaggtggccagcgaggacctgtgcagcgagaagcagtggaacgtgtgcaaggccctggccaccttcgtggccagaagagagatcaccaaggtgaagctgaagcagatcacccccagaaccgaggaggagaagatggagcacagcgtggccgccgagagaagaagaatgagactggtgtacgccgacaccatcaaggacctgctggccaactgcgccatccagggcgacctggagagcagagactgcagcagaatggtgcccgccgagaagaccagagtggagagcgtggagctggtgctgcccccccacgccaaccaccagggcaacaccttcggcggccagatcatggcctggatggagaacgtggccaccatcgccgccagcagactgtgcagagcccaccccaccctgaaggccatcgagatgttccacttcagaggccccagccaggtgggcgacagactggtgctgaaggccatcgtgaacaacgccttcaagcacagcatggaggtgggcgtgtgcgtggaggcctacagacaggaggccgagacccacagaagacacatcaacagcgccttcatgaccttcgtggtgctggacgccgacgaccagccccagctgctgccctggatcagaccccagcccggcgacggcgagagaagatacagagaggccagcgccagaaagaagatcagactggacagaaagtacatcgtgagctgcaagcagaccgaggtgcccctgagcgtgccctgggaccccagcaaccaggtgtacctgagctacaacaacgtgagcagcctgaagatgctggtggccaaggacaactgggtgctgagcagcgagatcagccaggtgagactgtacaccctggaggacgacaagttcctgagcttccacatggagatggtggtgcacgtggacgccgcccaggccttcctgctgctgagcgacctgagacagagacccgagtgggacaagcactacagaagcgtggagctggtgcagcaggtggacgaggacgacgccatctaccacgtgaccagccccgccctgggcggccacaccaagccccaggacttcgtgatcctggccagcagaagaaagccctgcgacaacggcgacccctacgtgatcgccctgagaagcgtgaccctgcccacccacagagagacccccgagtacagaagaggcgagaccctgtgcagcggcttctgcctgtggagagagggcgaccagctgaccaaggtgagctactacaaccaggccacccccggcgtgctgaactacgtgaccaccaacgtggccggcctgagcagcgagttctacaccaccttcaaggcctgcgagcagttcctgctggacaacagaaacgacctggcccccagcctgcagaccctgtag

SEQ ID NO: 71749 - DNA, 1824 bp, Artificial Sequence
  Description of Artificial Sequence: Synthetic coding sequence
atgatccagaacgtgggcaaccacctgagaagaggcctggccagcgtgttcagcaacagaaccagcagaaagagcgccctgagagccggcaacgacagcgccatggccgacggcgagggctacagaaaccccaccgaggtgcagatgagccagctggtgctgccctgccacaccaaccagagaggcgagctgagcgtgggccagctgctgaagtggatcgacaccaccgcctgcctgagcgccgagagacacgccggctgcccctgcgtgaccgccagcatggacgacatctacttcgagcacaccatcagcgtgggccaggtggtgaacatcaaggccaaggtgaacagagccttcaacagcagcatggaggtgggcatccaggtggccagcgaggacctgtgcagcgagaagcagtggaacgtgtgcaaggccctggccaccttcgtggccagaagagagatcaccaaggtgaagctgaagcagatcacccccagaaccgaggaggagaagatggagcacagcgtggccgccgagagaagaagaatgagactggtgtacgccgacaccatcaaggacctgctggccaactgcgccatccagggcgacctggagagcagagactgcagcagaatggtgcccgccgagaagaccagagtggagagcgtggagctggtgctgcccccccacgccaaccaccagggcaacaccttcggcggccagatcatggcctggatggagaacgtggccaccatcgccgccagcagactgtgcagagcccaccccaccctgaaggccatcgagatgttccacttcagaggccccagccaggtgggcgacagactggtgctgaaggccatcgtgaacaacgccttcaagcacagcatggaggtgggcgtgtgcgtggaggcctacagacaggaggccgagacccacagaagacacatcaacagcgccttcatgaccttcgtggtgctggacgccgacgaccagccccagctgctgccctggatcagaccccagcccggcgacggcgagagaagatacagagaggccagcgccagaaagaagatcagactggacagaaagtacatcgtgagctgcaagcagaccgaggtgcccctgagcgtgccctgggaccccagcaaccaggtgtacctgagctacaacaacgtgagcagcctgaagatgctggtggccaaggacaactgggtgctgagcagcgagatcagccaggtgagactgtacaccctggaggacgacaagttcctgagcttccacatggagatggtggtgcacgtggacgccgcccaggccttcctgctgctgagcgacctgagacagagacccgagtgggacaagcactacagaagcgtggagctggtgcagcaggtggacgaggacgacgccatctaccacgtgaccagccccgccctgggcggccacaccaagccccaggacttcgtgatcctggccagcagaagaaagccctgcgacaacggcgacccctacgtgatcgccctgagaagcgtgaccctgcccacccacagagagacccccgagtacagaagaggcgagaccctgtgcagcggcttctgcctgtggagagagggcgaccagctgaccaagtgctgctgggtgagagtgagcctgaccgagctggtgagcgccagcggcttctacagctggggcctggagagcagaagcaagggcagaagaagcgacggctggaacggcaagctggccggcggccacctgagcaccctgaaggccatccccgtggccaagatcaacagcagattcggctacctgcaggacacctag

SEQ ID NO: 71750 - DNA, 1668 bp, Artificial Sequence
  Description of Artificial Sequence: Synthetic coding sequence
atggagagacccgcccccggcgaggtggtgatgagccaggccatccagcccgcccacgccaccgccagaggcgagctgagcgccggccagctgctgaagtggatcgacaccaccgcctgcctggccgccgagaagcacgccggcgtgagctgcgtgaccgccagcgtggacgacatccagttcgaggagaccgccagagtgggccaggtgatcaccatcaaggccaaggtgaccagagccttcagcaccagcatggagatcagcatcaaggtgatggtgcaggacatgctgaccggcatcgagaagctggtgagcgtggccttcagcaccttcgtggccaagcccgtgggcaaggagaagatccacctgaagcccgtgaccctgctgaccgagcaggaccacgtggagcacaacctggccgccgagagaagaaaggtgagactgcagcacgaggacaccttcaacaacctgatgaaggagagcagcaagttcgacgacctgatcttcgacgaggaggagggcgccgtgagcaccagaggcaccagcgtgcagagcatcgagctggtgctgcccccccacgccaaccaccacggcaacaccttcggcggccagatcatggcctggatggagaccgtggccaccatcagcgccagcagactgtgctgggcccaccccttcctgaagagcgtggacatgttcaagttcagaggccccagcaccgtgggcgacagactggtgttcaccgccatcgtgaacaacaccttccagacctgcgtggaggtgggcgtgagagtggaggccttcgactgccaggagtgggccgagggcagaggcagacacatcaacagcgccttcctgatctacaacgccgccgacgacaaggagaacctgatcaccttccccagaatccagcccatcagcaaggacgacttcagaagatacagaggcgccatcgccagaaagagaatcagactgggcagaaagtacgtgatcagccacaaggaggaggtgcccctgtgcatccactgggacatcagcaagcaggccagcctgagcgacagcaacgtggaggccctgaagaagctggccgccaagagaggctgggaggtgaccagcaccgtggagaagatcaagatctacaccctggaggagcacgacgtgctgagcgtgtgggtggagaagcacgtgggcagccccgcccacctggcctacagactgctgagcgacttcaccaagagacccctgtgggacccccacttcgtgagctgcgaggtgatcgactgggtgagcgaggacgaccagctgtaccacatcacctgccccatcctgaacgacgacaagcccaaggacctggtggtgctggtgagcagaagaaagcccctgaaggacggcaacacctacaccgtggccgtgaagagcgtgatcctgcccagcgtgccccccagcccccagtacatcagaagcgagatcatctgcgccggcttcctgatccacgccatcgacagcaacagctgcatcgtgagctacttcaaccacatgagcgccagcatcctgccctacttcgccggcaacctgggcggctggagcaagagcatcgaggagaccgccgccagctgcatccagttcctggagaacccccccgacgacggcttcgtgagcaccttctag

SEQ ID NO: 71751 - DNA, 1452 bp, Artificial Sequence
  Description of Artificial Sequence: Synthetic coding sequence
atgagcaacaagctgctgagcccccacccccacagcgtggtgctgagaagcgagttcaagatggccagcagccccgccgtgctgagagccagcagactgtaccagtggagcctgaagagcagcgcccagttcctgggcagcccccagctgagacaggtgggccagatcatcagagtgcccgccagaatggccgccaccctgatcctggagcccgccggcagatgctgctgggacgagcccgtgagaatcgccgtgagaggcctggcccccgagcagcccgtgaccctgagagccagcctgagagacgagaagggcgccctgttccaggcccacgccagatacagagccgacaccctgggcgagctggacctggagagagcccccgccctgggcggcagcttcgccggcctggagcccatgggcctgctgtgggccctggagcccgagaagcccctggtgagactggtgaagagagacgtgagaacccccctggccgtggagctggaggtgctggacggccacgaccccgaccccggcagactgctgtgccagaccagacacgagagatacttcctgccccccggcgtgagaagagagcccgtgagagtgggcagagtgagaggcaccctgttcctgccccccgagcccggccccttccccggcatcgtggacatgttcggcaccggcggcggcctgctggagtacagagccagcctgctggccggcaagggcttcgccgtgatggccctggcctactacaactacgaggacctgcccaagaccatggagaccctgcacctggagtacttcgaggaggccatgaactacctgctgagccaccccgaggtgaagggccccggcgtgggcctgctgggcatcagcaagggcggcgagctgtgcctgagcatggccagcttcctgaagggcatcaccgccgccgtggtgatcaacggcagcgtggccaacgtgggcggcaccctgcactacaagggcgagaccctgccccccgtgggcgtgaacagaaacagaatcaaggtgaccaaggacggctacgccgacatcgtggacgtgctgaacagccccctggagggccccgaccagaagagcttcatccccgtggagagagccgagagcaccttcctgttcctggtgggccaggacgaccacaactggaagagcgagttctacgccaacgaggcctgcaagagactgcaggcccacggcagaagaaagccccagatcatctgctaccccgagaccggccactacatcgagcccccctacttccccctgtgcagagccagcctgcacgccctggtgggcagccccatcatctggggcggcgagcccagagcccacgccatggcccaggtggacgcctggaagcagctgcagaccttcttccacaagcacctgggcggccacgagggcaccatccccagcaaggtgtag

SEQ ID NO: 71752 - DNA, 1266 bp, Artificial Sequence
  Description of Artificial Sequence: Synthetic coding sequence
atgagcgccaccctgatcctggagccccccggcagatgctgctggaacgagcccgtgagaatcgccgtgagaggcctggcccccgagcagagagtgaccctgagagccagcctgagagacgagaagggcgccctgttcagagcccacgccagatactgcgccgacgccagaggcgagctggacctggagagagcccccgccctgggcggcagcttcgccggcctggagcccatgggcctgctgtgggccctggagcccgagaagcccttctggagattcctgaagagagacgtgcagatccccttcgtggtggagctggaggtgctggacggccacgaccccgagcccggcagactgctgtgccaggcccagcacgagagacacttcctgccccccggcgtgagaagacagagcgtgagagccggcagagtgagagccaccctgttcctgccccccggccccggccccttccccggcatcatcgacatcttcggcatcggcggcggcctgctggagtacagagccagcctgctggccggccacggcttcgccaccctggccctggcctactacaacttcgaggacctgcccaacaacatggacaacatcagcctggagtacttcgaggaggccgtgtgctacatgctgcagcacccccaggtgaagggccccggcatcggcctgctgggcatcagcctgggcgccgacatctgcctgagcatggccagcttcctgaagaacgtgagcgccaccgtgagcatcaacggcagcggcatcagcggcaacaccgccatcaactacaagcacagcagcatcccccccctgggctacgacctgagaagaatcaaggtggccttcagcggcctggtggacatcgtggacatcagaaacgccctggtgggcggctacaagaaccccagcatgatccccatcgagaaggcccagggccccatcctgctgatcgtgggccaggacgaccacaactggagaagcgagctgtacgcccagaccgtgagcgagagactgcaggcccacggcaaggagaagccccagatcatctgctaccccggcaccggccactacatcgagcccccctacttccccctgtgccccgccagcctgcacagactgctgaacaagcacgtgatctggggcggcgagcccagagcccacagcaaggcccaggaggacgcctggaagcagatcctggccttcttctgcaagcacctgggcggcacccagaagaccgccgtgcccaagctgtag

SEQ ID NO: 71753 - DNA, 624 bp, Artificial Sequence
  Description of Artificial Sequence: Synthetic coding sequence
atgctgcagcaccccaaggtgaagggccccagcatcgccctgctgggcttcagcaagggcggcgacctgtgcctgagcatggccagcttcctgaagggcatcaccgccaccgtgctgatcaacgcctgcgtggccaacaccgtggcccccctgcactacaaggacatgatcatccccaagctggtggacgacctgggcaaggtgaagatcaccaagagcggcttcctgaccttcatggacacctggagcaaccccctggaggagcacaaccaccagagcctggtgcccctggagaaggcccaggtgcccttcctgttcatcgtgggcatggacgaccagagctggaagagcgagttctacgcccagatcgccagcgagagactgcaggcccacggcaaggagagaccccagatcatctgctaccccgagaccggccactgcatcgaccccccctacttcccccccagcagagccagcgtgcacgccgtgctgggcgaggccatcttctacggcggcgagcccaaggcccacagcaaggcccaggtggacgcctggcagcagatccagaccttcttccacaagcacctgaacggcaagaagagcgtgaagcacagcaagatctag

SEQ ID NO: 71754 - DNA, 507 bp, Artificial Sequence
  Description of Artificial Sequence: Synthetic coding sequence
atgctgcagcaccccaaggtgaagggccccagcatcgccctgctgggcttcagcaagggcggcgacctgtgcctgagcatggccagcttcctgaagggcatcaccgccaccgtgctgatcaacgcctgcgtggccaacaccgtggcccccctgcactacaaggacatgatcatccccaagctggtggacgacctgggcaaggtgaagatcaccaagagcggcttcctgaccttcatggacacctggagcaaccccctggaggagcacaaccaccagagcctggtgcccctggagaaggcccaggtgcccttcctgttcatcgtgggcatggacgaccagagctggaagagcgagttctacgcccagatcgccagcgagagactgcaggcccacggcaaggagagaccccagatcatctgctaccccgagaccggccactgcatcgaccccccctacttcccccccagcagagccagcgtgcacgccgtgctgggcgaggccatctag

SEQ ID NO: 71755 - DNA, 1113 bp, Artificial Sequence
  Description of Artificial Sequence: Synthetic coding sequence
atggccagacccggcctgatccacagcgcccccggcctgcccgacacctgcgccctgctgcagccccccgccgccagcgccgccgccgcccccagcatgagcggccccgacgtggagacccccagcgccatccagatctgcagaatcatgagacccgacgacgccaacgtggccggcaacgtgcacggcggcaccatcctgaagatgatcgaggaggccggcgccatcatcagcaccagacactgcaacagccagaacggcgagagatgcgtggccgccctggccagagtggagagaaccgacttcctgagccccatgtgcatcggcgaggtggcccacgtgagcgccgagatcacctacaccagcaagcacagcgtggaggtgcaggtgaacgtgatgagcgagaacatcctgaccggcgccaagaagctgaccaacaaggccaccctgtggtacgtgcccctgagcctgaagaacgtggacaaggtgctggaggtgccccccgtggtgtacagcagacaggagcaggaggaggagggcagaaagagatacgaggcccagaagctggagagaatggagaccaagtggagaaacggcgacatcgtgcagcccgtgctgaaccccgagcccaacaccgtgagctacagccagagcagcctgatccacctggtgggccccagcgactgcaccctgcacggcttcgtgcacggcggcgtgaccatgaagctgatggacgaggtggccggcatcgtggccgccagacactgcaagaccaacatcgtgaccgccagcgtggacgccatcaacttccacgacaagatcagaaagggctgcgtgatcaccatcagcggcagaatgaccttcaccagcaacaagagcatggagatcgaggtgctggtggacgccgaccccgtggtggacagcagccagaagagatacagagccgccagcgccttcttcacctacgtgagcctgagccaggagggcagaagcctgcccgtgccccagctggtgcccgagaccgaggacgagaagaagagattcgaggagggcaagggcagatacctgcagatgaaggccaagagacagggccacgccgagccccagccctag

SEQ ID NO: 71756 - DNA, 990 bp, Artificial Sequence
  Description of Artificial Sequence: Synthetic coding sequence
atggccttccagctgagcagaatcatgagacccgacgacgccaacgtggccggcaacgtgcacggcggcaccatcctgaagatgatcgaggaggccggcgccatcatcagcaccagacactgcaacagccagaacggcgagagatgcgtggccgccctggccagagtggagagaaccgacttcctgagccccatgtgcatcggcgaggtggcccacgtgagcgccgagatcacctacaccagcaagcacagcgtggaggtgcaggtgaacgtgatgagcgagaacatcctgaccggcgccaagaagctgaccaacaaggccaccctgtggtacgtgcccctgagcctgaagaacgtggacaaggtgctggaggtgccccccgtggtgtacagcagacaggagcaggaggaggagggcagaaagagatacgaggcccagaagctggagagaatggagaccaagtggagaaacggcgacatcgtgcagcccgtgctgaaccccgagcccaacaccgtgagctacagccagagcagcctgatccacctggtgggccccagcgactgcaccctgcacggcttcgtgcacggcggcgtgaccatgaagctgatggacgaggtggccggcatcgtggccgccagacactgcaagaccaacatcgtgaccgccagcgtggacgccatcaacttccacgacaagatcagaaagggctgcgtgatcaccatcagcggcagaatgaccttcaccagcaacaagagcatggagatcgaggtgctggtggacgccgaccccgtggtggacagcagccagaagagatacagagccgccagcgccttcttcacctacgtgagcctgagccaggagggcagaagcctgcccgtgccccagctggtgcccgagaccgaggacgagaagaagagattcgaggagggcaagggcagatacctgcagatgaaggccaagagacagggccacgccgagccccagccctag

SEQ ID NO: 71757 - DNA, 1053 bp, Artificial Sequence
  Description of Artificial Sequence: Synthetic coding sequence
atgctgctgctgagaagaagcctgagcctgaacgtgctgagaaaggaggtggacagagcctgcttcggcgagaaggccaagcagatcatgagacccgacgacgccaacgtggccggcaacgtgcacggcggcaccatcctgaagatgatcgaggaggccggcgccatcatcagcaccagacactgcaacagccagaacggcgagagatgcgtggccgccctggccagagtggagagaaccgacttcctgagccccatgtgcatcggcgaggtggcccacgtgagcgccgagatcacctacaccagcaagcacagcgtggaggtgcaggtgaacgtgatgagcgagaacatcctgaccggcgccaagaagctgaccaacaaggccaccctgtggtacgtgcccctgagcctgaagaacgtggacaaggtgctggaggtgccccccgtggtgtacagcagacaggagcaggaggaggagggcagaaagagatacgaggcccagaagctggagagaatggagaccaagtggagaaacggcgacatcgtgcagcccgtgctgaaccccgagcccaacaccgtgagctacagccagagcagcctgatccacctggtgggccccagcgactgcaccctgcacggcttcgtgcacggcggcgtgaccatgaagctgatggacgaggtggccggcatcgtggccgccagacactgcaagaccaacatcgtgaccgccagcgtggacgccatcaacttccacgacaagatcagaaagggctgcgtgatcaccatcagcggcagaatgaccttcaccagcaacaagagcatggagatcgaggtgctggtggacgccgaccccgtggtggacagcagccagaagagatacagagccgccagcgccttcttcacctacgtgagcctgagccaggagggcagaagcctgcccgtgccccagctggtgcccgagaccgaggacgagaagaagagattcgaggagggcaagggcagatacctgcagatgaaggccaagagacagggccacgccgagccccagccctag

SEQ ID NO: 71758 - DNA, 1143 bp, Artificial Sequence
  Description of Artificial Sequence: Synthetic coding sequence
atgaagctgctggccagagccctgagactgtgcgagttcggcagacaggccagcagcagaagactggtggccggccagggctgcgtgggccccagaagaggctgctgcgcccccgtgcaggtggtgggccccagagccgacctgcccccctgcggcgcctgcatcaccggcagaatcatgagacccgacgacgccaacgtggccggcaacgtgcacggcggcaccatcctgaagatgatcgaggaggccggcgccatcatcagcaccagacactgcaacagccagaacggcgagagatgcgtggccgccctggccagagtggagagaaccgacttcctgagccccatgtgcatcggcgaggtggcccacgtgagcgccgagatcacctacaccagcaagcacagcgtggaggtgcaggtgaacgtgatgagcgagaacatcctgaccggcgccaagaagctgaccaacaaggccaccctgtggtacgtgcccctgagcctgaagaacgtggacaaggtgctggaggtgccccccgtggtgtacagcagacaggagcaggaggaggagggcagaaagagatacgaggcccagaagctggagagaatggagaccaagtggagaaacggcgacatcgtgcagcccgtgctgaaccccgagcccaacaccgtgagctacagccagagcagcctgatccacctggtgggccccagcgactgcaccctgcacggcttcgtgcacggcggcgtgaccatgaagctgatggacgaggtggccggcatcgtggccgccagacactgcaagaccaacatcgtgaccgccagcgtggacgccatcaacttccacgacaagatcagaaagggctgcgtgatcaccatcagcggcagaatgaccttcaccagcaacaagagcatggagatcgaggtgctggtggacgccgaccccgtggtggacagcagccagaagagatacagagccgccagcgccttcttcacctacgtgagcctgagccaggagggcagaagcctgcccgtgccccagctggtgcccgagaccgaggacgagaagaagagattcgaggagggcaagggcagatacctgcagatgaaggccaagagacagggccacgccgagccccagccctag

SEQ ID NO: 71759 - DNA, 672 bp, Artificial Sequence
  Description of Artificial Sequence: Synthetic coding sequence
atgctgctgctgagaagaagcctgagcctgaacgtgctgagaaaggaggtggacagagcctgcttcggcgagaaggccaagcagatcatgagacccgacgacgccaacgtggccggcaacgtgcacggcggcaccatcctgaagatgatcgaggaggccggcgccatcatcagcaccagacactgcaacagccagaacggcgagagatgcgtggccgccctggccagagtggagagaaccgacttcctgagccccatgtgcatcggcgaggtggcccacgtgagcgccgagatcacctacaccagcaagcacagcgtggaggtgcaggtgaacgtgatgagcgagaacatcctgaccggcgccaagaagctgaccaacaaggccaccctgtggtacgtgcccctgagcctgaagaacgtggacaaggtgctggaggtgccccccgtggtgtacagcagacaggagcaggaggaggagggcagaaagagatacgaggcccagaagctggagagaatggagaccaagtggagaaacggcgacatcgtgcagcccgtgctgaaccccgagcccaacaccgtgagctacagccagagcagcctgatccacctggtgggccccagcgactgcaccctgcacggcttcgtgcacggcggcggcgtggacttccactag

SEQ ID NO: 71760 - DNA, 798 bp, Artificial Sequence
  Description of Artificial Sequence: Synthetic coding sequence
atgtgcatcggcgaggtggcccacgtgagcgccgagatcacctacaccagcaagcacagcgtggaggtgcaggtgaacgtgatgagcgagaacatcctgaccggcgccaagaagctgaccaacaaggccaccctgtggtacgtgcccctgagcctgaagaacgtggacaaggtgctggaggtgccccccgtggtgtacagcagacaggagcaggaggaggagggcagaaagagatacgaggcccagaagctggagagaatggagaccaagtggagaaacggcgacatcgtgcagcccgtgctgaaccccgagcccaacaccgtgagctacagccagagcagcctgatccacctggtgggccccagcgactgcaccctgcacggcttcgtgcacggcggcgtgaccatgaagctgatggacgaggtggccggcatcgtggccgccagacactgcaagaccaacatcgtgaccgccagcgtggacgccatcaacttccacgacaagatcagaaagggctgcgtgatcaccatcagcggcagaatgaccttcaccagcaacaagagcatggagatcgaggtgctggtggacgccgaccccgtggtggacagcagccagaagagatacagagccgccagcgccttcttcacctacgtgagcctgagccaggagggcagaagcctgcccgtgccccagctggtgcccgagaccgaggacgagaagaagagattcgaggagggcaagggcagatacctgcagatgaaggccaagagacagggccacgccgagccccagccctag

SEQ ID NO: 71761 - DNA, 1308 bp, Artificial Sequence
  Description of Artificial Sequence: Synthetic coding sequence
atggccgcccccctggtgctggtgctggtggtggccgtgaccgtgagagccgccctgttcagaagcagcctggccgagttcatcagcgagagagtggaggtggtgagccccctgagcagctggaagagagtggtggagggcctgagcctgctggacctgggcgtgagcccctacagcggcgccgtgttccacgagacccccctgatcatctacctgttccacttcctgatcgactacgccgagctggtgttcatgatcaccgacgccctgaccgccatcgccctgtacttcgccatccaggacttcaacaaggtggtgttcaagaagcagaagctgctgctggagctggaccagtacgcccccgacgtggccgagctgatcagaacccccatggagatgagatacatccccctgaaggtggccctgttctacctgctgaacccctacaccatcctgagctgcgtggccaagagcacctgcgccatcaacaacaccctgatcgccttcttcatcctgaccaccatcaagggcagcgccttcctgagcgccatcttcctggccctggccacctaccagagcctgtaccccctgaccctgttcgtgcccggcctgctgtacctgctgcagagacagtacatccccgtgaagatgaagagcaaggccttctggatcttcagctgggagtacgccatgatgtacgtgggcagcctggtggtgatcatctgcctgagcttcttcctgctgagcagctgggacttcatccccgccgtgtacggcttcatcctgagcgtgcccgacctgacccccaacatcggcctgttctggtacttcttcgccgagatgttcgagcacttcagcctgttcttcgtgtgcgtgttccagatcaacgtgttcttctacaccatccccctggccatcaagctgaaggagcaccccatcttcttcatgttcatccagatcgccgtgatcgccatcttcaagagctaccccaccgtgggcgacgtggccctgtacatggccttcttccccgtgtggaaccacctgtacagattcctgagaaacatcttcgtgctgacctgcatcatcatcgtgtgcagcctgctgttccccgtgctgtggcacctgtggatctacgccggcagcgccaacagcaacttcttctacgccatcaccctgaccttcaacgtgggccagatcctgctgatcagcgactacttctacgccttcctgagaagagagtactacctgacccacggcctgtacctgaccgccaaggacggcaccgaggccatgctggtgctgaagtag

SEQ ID NO: 71762 - DNA, 342 bp, Artificial Sequence
  Description of Artificial Sequence: Synthetic coding sequence
atgagcagcccccaggcccccgaggacggccagggctgcggcgacagaggcgacccccccggcgacctgagaagcgtgctggtgaccaccgtgctgaacctggagcccctggacgaggacctgttcagaggcagacactactgggtgcccgccaagagactgttcggcggccagatcgtgggccaggccctggtggccgccgccaagagcgtgagcgaggacgtgcacgtgcacagcctgcactgctacttcgtgagagccgagcagatgcccagctgcgtgctgagaagaagccccgccgagaagagcctgtggaccttcaccgtgtgcgacctgtactag

SEQ ID NO: 71763 - DNA, 1320 bp, Artificial Sequence
  Description of Artificial Sequence: Synthetic coding sequence
atgagaagagccgccctgagactgtgcgccctgggcaagggccagctgacccccggcagaggcctgacccagggcccccagaaccccaagaagcagggcatcttccacatccacgaggtgagagacaagctgagagagatcgtgggcgccagcaccaactggagagaccacgtgaaggccatggaggagagaaagctgctgcacagcttcctggccaagagccaggacggcctgccccccagaagaatgaaggacagctacatcgaggtgctgctgcccctgggcagcgagcccgagctgagagagaagtacctgaccgtgcagaacaccgtgagattcggcagaatcctggaggacctggacagcctgggcgtgctgatctgctacatgcacaacaagatccacagcgccaagatgagccccctgagcatcgtgaccgccctggtggacaagatcgacatgtgcaagaagagcctgagccccgagcaggacatcaagttcagcggccacgtgagctgggtgggcaagaccagcatggaggtgaagatgcagatgttccagctgcacggcgacgagttctgccccgtgctggacgccaccttcgtgatggtggccagagacagcgagaacaagggccccgccttcgtgaaccccctgatccccgagagccccgaggaggaggagctgttcagacagggcgagctgaacaagggcagaagaatcgccttcagcagcaccagcctgctgaagatggcccccagcgccgaggagagaaccaccatccacgagatgttcctgagcaccctggaccccaagaccatcagcttcagaagcagagtgctgcccagcaacgccgtgtggatggagaacagcaagctgaagagcctggagatctgccacccccaggagagaaacatcttcaacagaatcttcggcggcttcctgatgagaaaggcctacgagctggcctgggccaccgcctgcagcttcggcggcagcagacccttcgtggtggccgtggacgacatcatgttccagaagcccgtggaggtgggcagcctgctgttcctgagcagccaggtgtgcttcacccagaacaactacatccaggtgagagtgcacagcgaggtggccagcctgcaggagaagcagcacaccaccaccaacgtgttccacttcaccttcatgagcgagaaggaggtgcccctggtgttccccaagacctacggcgagagcatgctgtacctggacggccagagacacttcaacagcatgagcggccccgccaccctgagaaaggactacctggtggagccctag

SEQ ID NO: 71764 - DNA, 1140 bp, Artificial Sequence
  Description of Artificial Sequence: Synthetic coding sequence
atggaggagagaaagctgctgcacagcttcctggccaagagccaggacggcctgccccccagaagaatgaaggacagctacatcgaggtgctgctgcccctgggcagcgagcccgagctgagagagaagtacctgaccgtgcagaacaccgtgagattcggcagaatcctggaggacctggacagcctgggcgtgctgatctgctacatgcacaacaagatccacagcgccaagatgagccccctgagcatcgtgaccgccctggtggacaagatcgacatgtgcaagaagagcctgagccccgagcaggacatcaagttcagcggccacgtgagctgggtgggcaagaccagcatggaggtgaagatgcagatgttccagctgcacggcgacgagttctgccccgtgctggacgccaccttcgtgatggtggccagagacagcgagaacaagggccccgccttcgtgaaccccctgatccccgagagccccgaggaggaggagctgttcagacagggcgagctgaacaagggcagaagaatcgccttcagcagcaccagcctgctgaagatggcccccagcgccgaggagagaaccaccatccacgagatgttcctgagcaccctggaccccaagaccatcagcttcagaagcagagtgctgcccagcaacgccgtgtggatggagaacagcaagctgaagagcctggagatctgccacccccaggagagaaacatcttcaacagaatcttcggcggcttcctgatgagaaaggcctacgagctggcctgggccaccgcctgcagcttcggcggcagcagacccttcgtggtggccgtggacgacatcatgttccagaagcccgtggaggtgggcagcctgctgttcctgagcagccaggtgtgcttcacccagaacaactacatccaggtgagagtgcacagcgaggtggccagcctgcaggagaagcagcacaccaccaccaacgtgttccacttcaccttcatgagcgagaaggaggtgcccctggtgttccccaagacctacggcgagagcatgctgtacctggacggccagagacacttcaacagcatgagcggccccgccaccctgagaaaggactacctggtggagccctag

SEQ ID NO: 71765 - DNA, 1347 bp, Artificial Sequence
  Description of Artificial Sequence: Synthetic coding sequence
atgagaagagccgccctgagactgtgcgccctgggcaagggccagctgacccccggcagaggcctgacccagggcccccagaaccccaagaagcagggcatcttccacatccacgaggcctgcagcagcatccacgtgaaccacgtgagagacaagctgagagagatcgtgggcgccagcaccaactggagagaccacgtgaaggccatggaggagagaaagctgctgcacagcttcctggccaagagccaggacggcctgccccccagaagaatgaaggacagctacatcgaggtgctgctgcccctgggcagcgagcccgagctgagagagaagtacctgaccgtgcagaacaccgtgagattcggcagaatcctggaggacctggacagcctgggcgtgctgatctgctacatgcacaacaagatccacagcgccaagatgagccccctgagcatcgtgaccgccctggtggacaagatcgacatgtgcaagaagagcctgagccccgagcaggacatcaagttcagcggccacgtgagctgggtgggcaagaccagcatggaggtgaagatgcagatgttccagctgcacggcgacgagttctgccccgtgctggacgccaccttcgtgatggtggccagagacagcgagaacaagggccccgccttcgtgaaccccctgatccccgagagccccgaggaggaggagctgttcagacagggcgagctgaacaagggcagaagaatcgccttcagcagcaccagcctgctgaagatggcccccagcgccgaggagagaaccaccatccacgagatgttcctgagcaccctggaccccaagaccatcagcttcagaagcagagtgctgcccagcaacgccgtgtggatggagaacagcaagctgaagagcctggagatctgccacccccaggagagaaacatcttcaacagaatcttcggcggcttcctgatgagaaaggcctacgagctggcctgggccaccgcctgcagcttcggcggcagcagacccttcgtggtggccgtggacgacatcatgttccagaagcccgtggaggtgggcagcctgctgttcctgagcagccaggtgtgcttcacccagaacaactacatccaggtgagagtgcacagcgaggtggccagcctgcaggagaagcagcacaccaccaccaacgtgttccacttcaccttcatgagcgagaaggaggtgcccctggtgttccccaagacctacggcgagagcatgctgtacctggacggccagagacacttcaacagcatgagcggccccgccaccctgagaaaggactacctggtggagccctag

SEQ ID NO: 71766 - DNA, 1269 bp, Artificial Sequence
  Description of Artificial Sequence: Synthetic coding sequence
atgaccgtgttcttcaagaccctgagaaaccactggaagaagaccaccgccggcctgtgcctgctgacctggggcggccactggctgtacggcaagcactgcgacaacctgctgagaagagccgcctgccaggaggcccaggtgttcggcaaccagctgatcccccccaacgcccaggtgaagaaggccaccgtgttcctgaaccccgccgcctgcaagggcaaggccagaaccctgttcgagaagaacgccgcccccatcctgcacctgagcggcatggacgtgaccatcgtgaagaccgactacgagggccaggccaagaagctgctggagctgatggagaacaccgacgtgatcatcgtggccggcggcgacggcaccctgcaggaggtggtgaccggcgtgctgagaagaaccgacgaggccaccttcagcaagatccccatcggcttcatccccctgggcgagaccagcagcctgagccacaccctgttcgccgagagcggcaacaaggtgcagcacatcaccgacgccaccctggccatcgtgaagggcgagaccgtgcccctggacgtgctgcagatcaagggcgagaaggagcagcccgtgttcgccatgaccggcctgagatggggcagcttcagagacgccggcgtgaaggtgagcaagtactggtacctgggccccctgaagatcaaggccgcccacttcttcagcaccctgaaggagtggccccagacccaccaggccagcatcagctacaccggccccaccgagagaccccccaacgagcccgaggagacccccgtgcagagacccagcctgtacagaagaatcctgagaagactggccagctactgggcccagccccaggacgccctgagccaggaggtgagccccgaggtgtggaaggacgtgcagctgagcaccatcgagctgagcatcaccaccagaaacaaccagctggaccccaccagcaaggaggacttcctgaacatctgcatcgagcccgacaccatcagcaagggcgacttcatcaccatcggcagcagaaaggtgagaaaccccaagctgcacgtggagggcaccgagtgcctgcaggccagccagtgcaccctgctgatccccgagggcgccggcggcagcttcagcatcgacagcgaggagtacgaggccatgcccgtggaggtgaagctgctgcccagaaagctgcagttcttctgcgaccccagaaagagagagcagatgctgaccagccccacccagtag

SEQ ID NO: 71767 - DNA, 198 bp, Artificial Sequence
  Description of Artificial Sequence: Synthetic coding sequence
atgaccgtgttcttcaagaccctgagaaaccactggaagaagaccaccgccggcctgtgcctgctgacctggggcggccactggctgtacggcaagcactgcgacaacctgctgagaagagccgcctgccaggaggcccagcactaccaggacgagagcagatgggagcccaccctgagcagaacccccggcagctag

SEQ ID NO: 71768 - DNA, 198 bp, Artificial Sequence; identical to SEQ ID NO: 71767
  Description of Artificial Sequence: Synthetic coding sequence

SEQ ID NO: 71769 - DNA, 735 bp, Artificial Sequence
  Description of Artificial Sequence: Synthetic coding sequence
atgaccgtgttcttcaagaccctgagaaaccactggaagaagaccaccgccggcctgtgcctgctgacctggggcggccactggctgtacggcaagcactgcgacaacctgctgagaagagccgcctgccaggaggcccaggtgttcggcaaccagctgatcccccccaacgcccaggtgaagaaggccaccgtgttcctgaaccccgccgcctgcaagggcaccctgttcgagaagaacgccgcccccatcctgcacctgagcggcatggacgtgaccatcgtgaagaccgactacgagggccaggccaagaagctgctggagctgatggagaacaccgacgtgatcatcgtggccggcggcgacggcaccctgcaggaggtggtgaccggcgtgctgagaagaaccgacgaggccaccttcagcaagatccccatcggcttcatccccctgggcgagaccagcagcctgagccacaccctgttcgccgagagcggcaacaaggtgcagcacatcaccgacgccaccctggccatcgtgaagggcgagaccgtgcccctggacgtgctgcagatcaagggcgagaaggagcagcccgtgttcgccatgaccggcctgagatggggcagcttcagagacgccggcgtgaaggtgagcaagtactggtacctgggccccctgaagatcaaggccgcccacttcttcagcaccctgaagcccttccccaagagatag

SEQ ID NO: 71770 - DNA, 1728 bp, Artificial Sequence
  Description of Artificial Sequence: Synthetic coding sequence
atgcagagcccctggaagatcctgaccgtggcccccctgttcctgctgctgagcctgcagagcagcgccagccccgccaacgacgaccagagcagacccagcctgagcaacggccacacctgcgtgggctgcgtgctggtggtgagcgtgatcgagcagctggcccaggtgcacaacagcaccgtgcaggccagcatggagagactgtgcagctacctgcccgagaagctgttcctgaagaccacctgctacctggtgatcgacaagttcggcagcgacatcatcaagctgctgagcgccgacatgaacgccgacgtggtgtgccacaccctggagttctgcaagcagaacaccggccagcccctgtgccacctgtaccccctgcccaaggagacctggaagttcaccctgcagaaggccagacagatcgtgaagaagagccccatcctgaagtacagcagaagcggcagcgacatctgcagcctgcccgtgctggccaagatctgccagaagatcaagctggccatggagcagagcgtgcccttcaaggacgtggacagcgacaagtacagcgtgttccccaccctgagaggctaccactggagaggcagagactgcaacgacagcgacgagagcgtgtaccccggcagaagacccaacaactgggacgtgcaccaggacagcaactgcaacggcatctggggcgtggaccccaaggacggcgtgccctacgagaagaagttctgcgagggcagccagcccagaggcatcatcctgctgggcgacagcgccggcgcccacttccacatcagccccgagtggatcaccgccagccagatgagcctgaacagcttcatcaacctgcccaccgccctgaccaacgagctggactggccccagctgagcggcgccaccggcttcctggacagcaccgtgggcatcaaggagaagagcatctacctgagactgtggaagagaaaccactgcaaccacagagactaccagaacatcagcagaaacggcgccagcagcagaaacctgaagaagttcatcgagagcctgagcagaaacaaggtgctggactaccccgccatcgtgatctacgccatgatcggcaacgacgtgtgcagcggcaagagcgaccccgtgcccgccatgaccacccccgagaagctgtacagcaacgtgatgcagaccctgaagcacctgaacagccacctgcccaacggcagccacgtgatcctgtacggcctgcccgacggcaccttcctgtgggacaacctgcacaacagataccaccccctgggccagctgaacaaggacatgacctacgcccagctgtacagcttcctgaactgcctgcaggtgagcccctgccacggctggatgagcagcaacaagaccctgagaaccctgaccagcgagagagccgagcagctgagcaacaccctgaagaagatcgccgccagcgagaagttcaccaacttcaacctgttctacatggacttcgccttccacgagatcatccaggagtggcagaagagaggcggccagccctggcagctgatcgagcccgtggacggcttccaccccaacgaggtggccctgctgctgctggccgaccacttctggaagaaggtgcagctgcagtggccccagatcctgggcaaggagaaccccttcaacccccagatcaagcaggtgttcggcgaccagggcggccactag

SEQ ID NO: 71771 - DNA, 1632 bp, Artificial Sequence
  Description of Artificial Sequence: Synthetic coding sequence
atgcagagcccctggaagatcctgaccgtggcccccctgttcctgctgctgagcctgcagagcagcgccagccccgccaacgacgaccagagcagacccagcctgagcaacggccacacctgcgtggagaagctgttcctgaagaccacctgctacctggtgatcgacaagttcggcagcgacatcatcaagctgctgagcgccgacatgaacgccgacgtggtgtgccacaccctggagttctgcaagcagaacaccggccagcccctgtgccacctgtaccccctgcccaaggagacctggaagttcaccctgcagaaggccagacagatcgtgaagaagagccccatcctgaagtacagcagaagcggcagcgacatctgcagcctgcccgtgctggccaagatctgccagaagatcaagctggccatggagcagagcgtgcccttcaaggacgtggacagcgacaagtacagcgtgttccccaccctgagaggctaccactggagaggcagagactgcaacgacagcgacgagagcgtgtaccccggcagaagacccaacaactgggacgtgcaccaggacagcaactgcaacggcatctggggcgtggaccccaaggacggcgtgccctacgagaagaagttctgcgagggcagccagcccagaggcatcatcctgctgggcgacagcgccggcgcccacttccacatcagccccgagtggatcaccgccagccagatgagcctgaacagcttcatcaacctgcccaccgccctgaccaacgagctggactggccccagctgagcggcgccaccggcttcctggacagcaccgtgggcatcaaggagaagagcatctacctgagactgtggaagagaaaccactgcaaccacagagactaccagaacatcagcagaaacggcgccagcagcagaaacctgaagaagttcatcgagagcctgagcagaaacaaggtgctggactaccccgccatcgtgatctacgccatgatcggcaacgacgtgtgcagcggcaagagcgaccccgtgcccgccatgaccacccccgagaagctgtacagcaacgtgatgcagaccctgaagcacctgaacagccacctgcccaacggcagccacgtgatcctgtacggcctgcccgacggcaccttcctgtgggacaacctgcacaacagataccaccccctgggccagctgaacaaggacatgacctacgcccagctgtacagcttcctgaactgcctgcaggtgagcccctgccacggctggatgagcagcaacaagaccctgagaaccctgaccagcgagagagccgagcagctgagcaacaccctgaagaagatcgccgccagcgagaagttcaccaacttcaacctgttctacatggacttcgccttccacgagatcatccaggagtggcagaagagaggcggccagccctggcagctgatcgagcccgtggacggcttccaccccaacgaggtggccctgctgctgctggccgaccacttctggaagaaggtgcagctgcagtggccccagatcctgggcaaggagaaccccttcaacccccagatcaagcaggtgttcggcgaccagggcggccactag

SEQ ID NO: 71772 - DNA, 894 bp, Artificial Sequence
  Description of Artificial Sequence: Synthetic coding sequence
atgaagctgaagaacagcttcatcaacctgcccaccgccctgaccaacgagctggactggccccagctgagcggcgccaccggcttcctggacagcaccgtgggcatcaaggagaagagcatctacctgagactgtggaagagaaaccactgcaaccacagagactaccagaacatcagcagaaacggcgccagcagcagaaacctgaagaagttcatcgagagcctgagcagaaacaaggtgctggactaccccgccatcgtgatctacgccatgatcggcaacgacgtgtgcagcggcaagagcgaccccgtgcccgccatgaccacccccgagaagctgtacagcaacgtgatgcagaccctgaagcacctgaacagccacctgcccaacggcagccacgtgatcctgtacggcctgcccgacggcaccttcctgtgggacaacctgcacaacagataccaccccctgggccagctgaacaaggacatgacctacgcccagctgtacagcttcctgaactgcctgcaggtgagcccctgccacggctggatgagcagcaacaagaccctgagaaccctgaccagcgagagagccgagcagctgagcaacaccctgaagaagatcgccgccagcgagaagttcaccaacttcaacctgttctacatggacttcgccttccacgagatcatccaggagtggcagaagagaggcggccagccctggcagctgatcgagcccgtggacggcttccaccccaacgaggtggccctgctgctgctggccgaccacttctggaagaaggtgcagctgcagtggccccagatcctgggcaaggagaaccccttcaacccccagatcaagcaggtgttcggcgaccagggcggccactag

SEQ ID NO: 71773 - DNA, 2061 bp, Artificial Sequence
  Description of Artificial Sequence: Synthetic coding sequence
atgcagagcccctggaagatcctgaccgtggcccccctgttcctgctgctgagcctgcagagcagcgccagccccgccaacgacgaccagagcagacccagcctgagcaacggccacacctgcgtgggctgcgtgctggtggtgagcgtgatcgagcagctggcccaggtgcacaacagcaccgtgcaggccagcatggagagactgtgcagctacctgcccgagaagctgttcctgaagaccacctgctacctggtgatcgacaagttcggcagcgacatcatcaagctgctgagcgccgacatgaacgccgacgtggtgtgccacaccctggagttctgcaagcagaacaccggccagcccctgtgccacctgtaccccctgcccaaggagacctggaagttcaccctgcagaaggccagacagatcgtgaagaagagccccatcctgaagtacagcagaagcggcagcgacatctgcagcctgcccgtgctggccaagatctgccagaagatcaagctggccatggagcagagcgtgcccttcaaggacgtggacagcgacaagtacagcgtgttccccaccctgagaggctaccactggagaggcagagactgcaacgacagcgacgagagcgtgtaccccggcagaagacccaacaactgggacgtgcaccaggacagcaactgcaacggcatctggggcgtggaccccaaggacggcgtgccctacgagaagaagttctgcgagggcagccagcccagaggcatcatcctgctgggcgacagcgccggcgcccacttccacatcagccccgagtggatcaccgccagccagatgagcctgaacagcttcatcaacctgcccaccgccctgaccaacgagctggactggccccagctgagcggcgccaccggcttcctggacagcaccgtgggcatcaaggagaagagcatctacctgagactgtggaagagaaaccactgcaaccacagagactaccagaacatcagcagaaacggcgccagcagcagaaacctgaagaagttcatcgagagcctgagcagaaacaaggtgctggactaccccgccatcgtgatctacgccatgatcggcaacgacgtgtgcagcggcaagagcgaccccgtgcccgccatgaccacccccgagaagctgtacagcaacgtgatgcagaccctgaagcacctgaacagccacctgcccaacggcagccacgtgatcctgtacggcctgcccgacggcaccttcctgtgggacaacctgcacaacagataccaccccctgggccagctgaacaaggacatgacctacgcccagctgtacagcttcctgaactgcctgcaggtgagcccctgccacggctggatgagcagcaacaagaccctgagaaccctgaccagcgagagagccgagcagctgagcaacaccctgaagaagatcgccgccagcgagaagttcaccaacttcaacctgttctacatggacttcgccttccacgagatcatccaggagtggcagaagagaggcggccagccctggcagctgatcgagcccgtggacggcttccaccccaacgagagaaagagcatcctgctgaagggcatcctgatgaccagccagaccctggacaaccaggagtggacccagctgaccagctggatcaagggcaacctgacctgcgacagcagaaccagagagtggctgtgctgctgctggagaatcatcagcggcaagagatgcagcagcagcggccccaagagctgggagagaagaatcagaagcacccccagactgaacagatgcctggagaccaaggccggcaccgagcccctgagaagcatgcacccctggggcgcccagggcggcagaggcctgggcaagctgatcccccagctgtggggcctgcccagacacagacccaagggcctgttcttcagcagcatcttcaagtgcctgagcctgaacgaggagcacatctggaccaccgtgcagtgctgcgtgctgcccggcagcgtgaccctgcccctgttcctgaagtag

SEQ ID NO: 71774 - DNA, 1992 bp, Artificial Sequence
  Description of Artificial Sequence: Synthetic coding sequence
atgcagagcccctggaagatcctgaccgtggcccccctgttcctgctgctgagcctgcagagcagcgccagccccgccaacgacgaccagagcagacccagcctgagcaacggccacacctgcgtgggctgcgtgctggtggtgagcgtgatcgagcagctggcccaggtgcacaacagcaccgtgcaggccagcatggagagactgtgcagctacctgcccgagaagctgttcctgaagaccacctgctacctggtgatcgacaagttcggcagcgacatcatcaagctgctgagcgccgacatgaacgccgacgtggtgtgccacaccctggagttctgcaagcagaacaccggccagcccctgtgccacctgtaccccctgcccaaggagacctggaagttcaccctgcagaaggccagacagatcgtgaagaagagccccatcctgaagtacagcagaagcggcagcgacatctgcagcctgcccgtgctggccaagatctgccagaagatcaagctggccatggagcagagcgtgcccttcaaggacgtggacagcgacaagtacagcgtgttccccaccctgagaggctaccactggagaggcagagactgcaacgacagcgacgagagcgtgtaccccggcagaagacccaacaactgggacgtgcaccaggacagcaactgcaacggcatctggggcgtggaccccaaggacggcgtgccctacgagaagaagttctgcgagggcagccagcccagaggcatcatcctgctgggcgacagcgccggcgcccacttccacatcagccccgagtggatcaccgccagccagatgagcctgaacagcttcatcaacctgcccaccgccctgaccaacgagctggactggccccagctgagcggcgccaccggcttcctggacagcaccgtgggcatcaaggagaagagcatctacctgagactgtggaagagaaaccactgcaaccacagagactaccagaacatcagcagaaacggcgccagcagcagaaacctgaagaagttcatcgagagcctgagcagaaacaaggtgctggactaccccgccatcgtgatctacgccatgatcggcaacgacgtgtgcagcggcaagagcgaccccgtgcccgccatgaccacccccgagaagctgtacagcaacgtgatgcagaccctgaagcacctgaacagccacctgcccaacggcagccacgtgatcctgtacggcctgcccgacggcaccttcctgtgggacaacctgcacaacagataccaccccctgggccagctgaacaaggacatgacctacgcccagctgtacagcttcctgaactgcctgcaggtgagcccctgccacggctggatgagcagcaacaagaccctgagaaccctgaccagcgagagagccgagcagctgagcaacaccctgaagaagatcgccgccagcgagaagttcaccaacttcaacctgttctacatggacttcgccttccacgagatcatccaggagtggcagaagagaggcggccagccctggcagctgatcgagcccgtggacggcttccaccccaacgagagaaagagcatcctgctgaagggcatcctgatgaccagccagaccctggacaaccaggagtggacccagctgaccagctggatcaagggcaacctgacctgcgacagcagaaccagagagtggctgtgctgctgctggagaatcatcagcggcaagagatgcagcagcagcggccccaagagctgggagagaagaatcagaagcacccccagactgaacagatgcctggagaccaaggccggcaccgagcccctgagaagcatgcacccctggggcgcccagggcggcagaggcctgggcaagctgatcccccagccctacggcggctgccacgtgaccggccccaaggacagcagcagcgccgccagcctgcagatgagcttcagccagtag

SEQ ID NO: 71775 - DNA, 300 bp, Artificial Sequence
  Description of Artificial Sequence: Synthetic coding sequence
atggccgagggcaacaccctgatcagcgtggactacgagatcttcggcaaggtgcagggcgtgttcttcagaaagcacacccaggccgagggcaagaagctgggcctggtgggctgggtgcagaacaccgacagaggcaccgtgcagggccagctgcagggccccatcagcaaggtgagacacatgcaggagtggctggagaccagaggcagccccaagagccacatcgacaaggccaacttcaacaacgagaaggtgatcctgaagctggactacagcgacttccagatcgtgaagtag

SEQ ID NO: 71776 - DNA, 168 bp, Artificial Sequence
  Description of Artificial Sequence: Synthetic coding sequence
atggccgagggcaacaccctgatcagcgtggactacgagatcttcggcaaggtgcagggcgtgttcttcagaaagcacacccaggagatgaccgtggagaacagaatcgccgagacccacagcaagagctgcgtgcccgtgagcttcgccaccagctacgccggctag

SEQ ID NO: 71777 - DNA, 300 bp, Artificial Sequence; identical to SEQ ID NO: 71775
  Description of Artificial Sequence: Synthetic coding sequence

SEQ ID NO: 71778 - DNA, 300 bp, Artificial Sequence
  Description of Artificial Sequence: Synthetic coding sequence
atgagcaccgcccagagcctgaagagcgtggactacgaggtgttcggcagagtgcagggcgtgtgcttcagaatgtacaccgaggacgaggccagaaagatcggcgtggtgggctgggtgaagaacaccagcaagggcaccgtgaccggccaggtgcagggccccgaggacaaggtgaacagcatgaagagctggctgagcaaggtgggcagccccagcagcagaatcgacagaaccaacttcagcaacgagaagaccatcagcaagctggagtacagcaacttcagcatcagatactag

SEQ ID NO: 71779 - DNA, 294 bp, Artificial Sequence
  Description of Artificial Sequence: Synthetic coding sequence
atgtgccccctgcccctggccgccgccgccgtggccgcccccagagcccccctgagactgctgaacagaggcctggccgccgccatgagcaccgcccagagcctgaagagcgtggactacgaggtgttcggcagagtgcagggcgtgtgcttcagaatgtacaccgaggacgaggccagaaagatcggcgtggtgggctgggtgaagaacaccagcaagggcaccgtgaccggccaggtgcagggccccgaggacaaggtgaacagcatgctggagtgcagcggcctgatctag

SEQ ID NO: 71780 - DNA, 2247 bp, Artificial Sequence
  Description of Artificial Sequence: Synthetic coding sequence
atggtgctgctgagagtgctgatcctgctgctgagctgggccgccggcatgggcggccagtacggcaaccccctgaacaagtacatcagacactacgagggcctgagctacaacgtggacagcctgcaccagaagcaccagagagccaagagagccgtgagccacgaggaccagttcctgagactggacttccacgcccacggcagacacttcaacctgagaatgaagagagacaccagcctgttcagcgacgagttcaaggtggagaccagcaacaaggtgctggactacgacaccagccacatctacaccggccacatctacggcgaggagggcagcttcagccacggcagcgtgatcgacggcagattcgagggcttcatccagaccagaggcggcaccttctacgtggagcccgccgagagatacatcaaggacagaaccctgcccttccacagcgtgatctaccacgaggacgacatcaactacccccacaagtacggcccccagggcggctgcgccgaccacagcgtgttcgagagaatgagaaagtaccagatgaccggcgtggaggaggtgacccagatcccccaggaggagcacgccgccaacggccccgagctgctgagaaagaagagaaccaccagcgccgagaagaacacctgccagctgtacatccagaccgaccacctgttcttcaagtactacggcaccagagaggccgtgatcgcccagatcagcagccacgtgaaggccatcgacaccatctaccagaccaccgacttcagcggcatcagaaacatcagcttcatggtgaagagaatcagaatcaacaccaccgccgacgagaaggaccccaccaaccccttcagattccccaacatcggcgtggagaagttcctggagctgaacagcgagcagaaccacgacgactactgcctggcctacgtgttcaccgacagagacttcgacgacggcgtgctgggcctggcctgggtgggcgcccccagcggcagcagcggcggcatctgcgagaagagcaagctgtacagcgacggcaagaagaagagcctgaacaccggcatcatcaccgtgcagaactacggcagccacgtgccccccaaggtgagccacatcaccttcgcccacgaggtgggccacaacttcggcagcccccacgacagcggcaccgagtgcacccccggcgagagcaagaacctgggccagaaggagaacggcaactacatcatgtacgccagagccaccagcggcgacaagctgaacaacaacaagttcagcctgtgcagcatcagaaacatcagccaggtgctggagaagaagagaaacaactgcttcgtggagagcggccagcccatctgcggcaacggcatggtggagcagggcgaggagtgcgactgcggctacagcgaccagtgcaaggacgagtgctgcttcgacgccaaccagcccgagggcagaaagtgcaagctgaagcccggcaagcagtgcagccccagccagggcccctgctgcaccgcccagtgcgccttcaagagcaagagcgagaagtgcagagacgacagcgactgcgccagagagggcatctgcaacggcttcaccgccctgtgccccgccagcgaccccaagcccaacttcaccgactgcaacagacacacccaggtgtgcatcaacggccagtgcgccggcagcatctgcgagaagtacggcctggaggagtgcacctgcgccagcagcgacggcaaggacgacaaggagctgtgccacgtgtgctgcatgaagaagatggaccccagcacctgcgccagcaccggcagcgtgcagtggagcagacacttcagcggcagaaccatcaccctgcagcccggcagcccctgcaacgacttcagaggctactgcgacgtgttcatgagatgcagactggtggacgccgacggccccctggccagactgaagaaggccatcttcagccccgagctgtacgagaacatcgccgagtggatcgtggcccactggtgggccgtgctgctgatgggcatcgccctgatcatgctgatggccggcttcatcaagatctgcagcgtgcacacccccagcagcaaccccaagctgcccccccccaagcccctgcccggcaccctgaagagaagaagacccccccagcccatccagcagccccagagacagagacccagagagagctaccagatgggccacatgagaagatag

SEQ ID NO: 71781 - DNA, 1344 bp, Artificial Sequence
  Description of Artificial Sequence: Synthetic coding sequence
atggtgctgctgagagtgctgatcctgctgctgagctgggccgccggcatgggcgacagagacttcgacgacggcgtgctgggcctggcctgggtgggcgcccccagcggcagcagcggcggcatctgcgagaagagcaagctgtacagcgacggcaagaagaagagcctgaacaccggcatcatcaccgtgcagaactacggcagccacgtgccccccaaggtgagccacatcaccttcgcccacgaggtgggccacaacttcggcagcccccacgacagcggcaccgagtgcacccccggcgagagcaagaacctgggccagaaggagaacggcaactacatcatgtacgccagagccaccagcggcgacaagctgaacaacaacaagttcagcctgtgcagcatcagaaacatcagccaggtgctggagaagaagagaaacaactgcttcgtggagagcggccagcccatctgcggcaacggcatggtggagcagggcgaggagtgcgactgcggctacagcgaccagtgcaaggacgagtgctgcttcgacgccaaccagcccgagggcagaaagtgcaagctgaagcccggcaagcagtgcagccccagccagggcccctgctgcaccgcccagtgcgccttcaagagcaagagcgagaagtgcagagacgacagcgactgcgccagagagggcatctgcaacggcttcaccgccctgtgccccgccagcgaccccaagcccaacttcaccgactgcaacagacacacccaggtgtgcatcaacggccagtgcgccggcagcatctgcgagaagtacggcctggaggagtgcacctgcgccagcagcgacggcaaggacgacaaggagctgtgccacgtgtgctgcatgaagaagatggaccccagcacctgcgccagcaccggcagcgtgcagtggagcagacacttcagcggcagaaccatcaccctgcagcccggcagcccctgcaacgacttcagaggctactgcgacgtgttcatgagatgcagactggtggacgccgacggccccctggccagactgaagaaggccatcttcagccccgagctgtacgagaacatcgccgagtggatcgtggcccactggtgggccgtgctgctgatgggcatcgccctgatcatgctgatggccggcttcatcaagatctgcagcgtgcacacccccagcagcaaccccaagctgcccccccccaagcccctgcccggcaccctgaagagaagaagacccccccagcccatccagcagccccagagacagagacccagagagagctaccagatgggccacatgagaagatag

SEQ ID NO: 71782 - DNA, 2310 bp, Artificial Sequence
  Description of Artificial Sequence: Synthetic coding sequence
atgagactgctgagaagatgggccttcgccgccctgctgctgagcctgctgcccacccccggcctgggcacccagggccccgccggcgccctgagatggggcggcctgccccagctgggcggccccggcgcccccgaggtgaccgagcccagcagactggtgagagagagcagcggcggcgaggtgagaaagcagcagctggacaccagagtgagacaggagccccccggcggcccccccgtgcacctggcccaggtgagcttcgtgatccccgccttcaacagcaacttcaccctggacctggagctgaaccaccacctgctgagcagccagtacgtggagagacacttcagcagagagggcaccacccagcacagcaccggcgccggcgaccactgctactaccagggcaagctgagaggcaacccccacagcttcgccgccctgagcacctgccagggcctgcacggcgtgttcagcgacggcaacctgacctacatcgtggagccccaggaggtggccggcccctggggcgccccccagggccccctgccccacctgatctacagaacccccctgctgcccgaccccctgggctgcagagagcccggctgcctgttcgccgtgcccgcccagagcgccccccccaacagacccagactgagaagaaagagacaggtgagaagaggccaccccaccgtgcacagcgagaccaagtacgtggagctgatcgtgatcaacgaccaccagctgttcgagcagatgagacagagcgtggtgctgaccagcaacttcgccaagagcgtggtgaacctggccgacgtgatctacaaggagcagctgaacaccagaatcgtgctggtggccatggagacctgggccgacggcgacaagatccaggtgcaggacgacctgctggagaccctggccagactgatggtgtacagaagagagggcctgcccgagcccagcgacgccacccacctgttcagcggcagaaccttccagagcaccagcagcggcgccgcctacgtgggcggcatctgcagcctgagccacggcggcggcgtgaacgagtacggcaacatgggcgccatggccgtgaccctggcccagaccctgggccagaacctgggcatgatgtggaacaagcacagaagcagcgccggcgactgcaagtgccccgacatctggctgggctgcatcatggaggacaccggcttctacctgcccagaaagttcagcagatgcagcatcgacgagtacaaccagttcctgcaggagggcggcggcagctgcctgttcaacaagcccctgaagctgctggacccccccgagtgcggcaacggcttcgtggaggccggcgaggagtgcgactgcggcagcgtgcaggagtgcagcagagccggcggcaactgctgcaagaagtgcaccctgacccacgacgccatgtgcagcgacggcctgtgctgcagaagatgcaagtacgagcccagaggcgtgagctgcagagaggccgtgaacgagtgcgacatcgccgagacctgcaccggcgacagcagccagtgcccccccaacctgcacaagctggacggctactactgcgaccacgagcagggcagatgctacggcggcagatgcaagaccagagacagacagtgccaggtgctgtggggccacgccgccgccgacagattctgctacgagaagctgaacgtggagggcaccgagagaggcagctgcggcagaaagggcagcggctgggtgcagtgcagcaagcaggacgtgctgtgcggcttcctgctgtgcgtgaacatcagcggcgcccccagactgggcgacctggtgggcgacatcagcagcgtgaccttctaccaccagggcaaggagctggactgcagaggcggccacgtgcagctggccgacggcagcgacctgagctacgtggaggacggcaccgcctgcggccccaacatgctgtgcctggaccacagatgcctgcccgccagcgccttcaacttcagcacctgccccggcagcggcgagagaagaatctgcagccaccacggcgtgtgcagcaacgagggcaagtgcatctgccagcccgactggaccggcaaggactgcagcatccacaaccccctgcccaccagcccccccaccggcgagaccgagagatacaagggccccagcggcaccaacatcatcatcggcagcatcgccggcgccgtgctggtggccgccatcgtgctgggcggcaccggctggggcttcaagaacatcagaagaggcagaagcggcggcgcctag

SEQ ID NO: 71783 - DNA, 1572 bp, Artificial Sequence
  Description of Artificial Sequence: Synthetic coding sequence
tgctggggcagcggccacctgctgagcagccagtacgtggagagacacttcagcagagagggcaccacccagcacagcaccggcgccggcgaccactgctactaccagggcaagctgagaggcaacccccacagcttcgccgccctgagcacctgccagggcctgcacggcgtgttcagcgacggcaacctgacctacatcgtggagccccaggaggtggccggcccctggggcgccccccagggccccctgccccacctgatctacagaacccccctgctgcccgaccccctgggctgcagagagcccggctgcctgttcgccgtgcccgcccagagcgccccccccaacagacccagactgagaagaaagagacaggtgagaagaggccaccccaccgtgcacagcgagaccaagtacgtggagctgatcgtgatcaacgaccaccagctgttcgagcagatgagacagagcgtggtgctgaccagcaacttcgccaagagcgtggtgaacctggccgacgtgatctacaaggagcagctgaacaccagaatcgtgctggtggccatggagacctgggccgacggcgacaagatccaggtgcaggacgacctgctggagaccctggccagactgatggtgtacagaagagagggcctgcccgagcccagcgacgccacccacctgttcagcggcagaaccttccagagcaccagcagcggcgccgcctacgtgggcggcatctgcagcctgagccacggcggcggcgtgaacgagtacggcaacatgggcgccatggccgtgaccctggcccagaccctgggccagaacctgggcatgatgtggaacaagcacagaagcagcgccggcgactgcaagtgccccgacatctggctgggctgcatcatggaggacaccggcttctacctgcccagaaagttcagcagatgcagcatcgacgagtacaaccagttcctgcaggagggcggcggcagctgcctgttcaacaagcccctgaagctgctggacccccccgagtgcggcaacggcttcgtggaggccggcgaggagtgcgactgcggcagcgtgcaggagtgcagcagagccggcggcaactgctgcaagaagtgcaccctgacccacgacgccatgtgcagcgacggcctgtgctgcagaagatgcaagtacgagcccagaggcgtgagctgcagagaggccgtgaacgagtgcgacatcgccgagacctgcaccggcgacagcagccagtgcccccccaacctgcacaagctggacggctactactgcgaccacgagcagggcagatgctacggcggcagatgcaagaccagagacagacagtgccaggtgctgtggggccacgccgccgccgacagattctgctacgagaagctgaacgtggagggcaccgagagaggcagctgcggcagaaagggcagcggctgggtgcagtgcagcaagcagccccagcagggcagagccgtgtggctgccccccctgtgccagcacctgtggagcagcagcgccagaggccccggcggcagacaccagtag

SEQ ID NO: 71784 - DNA, 1710 bp, Artificial Sequence
  Description of Artificial Sequence: Synthetic coding sequence
atgcagggcaccagactgcccgtgtgctgcgcctgccccgtgggcagcagcaagcccgccgaggccgagaaggagaaggtgagaagaggccaccccaccgtgcacagcgagaccaagtacgtggagctgatcgtgatcaacgaccaccagctgttcgagcagatgagacagagcgtggtgctgaccagcaacttcgccaagagcgtggtgaacctggccgacgtgatctacaaggagcagctgaacaccagaatcgtgctggtggccatggagacctgggccgacggcgacaagatccaggtgcaggacgacctgctggagaccctggccagactgatggtgtacagaagagagggcctgcccgagcccagcgacgccacccacctgttcagcggcagaaccttccagagcaccagcagcggcgccgcctacgtgggcggcatctgcagcctgagccacggcggcggcgtgaacgagtacggcaacatgggcgccatggccgtgaccctggcccagaccctgggccagaacctgggcatgatgtggaacaagcacagaagcagcgccggcgactgcaagtgccccgacatctggctgggctgcatcatggaggacaccggcttctacctgcccagaaagttcagcagatgcagcatcgacgagtacaaccagttcctgcaggagggcggcggcagctgcctgttcaacaagcccctgaagctgctggacccccccgagtgcggcaacggcttcgtggaggccggcgaggagtgcgactgcggcagcgtgcaggagtgcagcagagccggcggcaactgctgcaagaagtgcaccctgacccacgacgccatgtgcagcgacggcctgtgctgcagaagatgcaagtacgagcccagaggcgtgagctgcagagaggccgtgaacgagtgcgacatcgccgagacctgcaccggcgacagcagccagtgcccccccaacctgcacaagctggacggctactactgcgaccacgagcagggcagatgctacggcggcagatgcaagaccagagacagacagtgccaggtgctgtggggccacgccgccgccgacagattctgctacgagaagctgaacgtggagggcaccgagagaggcagctgcggcagaaagggcagcggctgggtgcagtgcagcaagcaggacgtgctgtgcggcttcctgctgtgcgtgaacatcagcggcgcccccagactgggcgacctggtgggcgacatcagcagcgtgaccttctaccaccagggcaaggagctggactgcagaggcggccacgtgcagctggccgacggcagcgacctgagctacgtggaggacggcaccgcctgcggccccaacatgctgtgcctggaccacagatgcctgcccgccagcgccttcaacttcagcacctgccccggcagcggcgagagaagaatctgcagccaccacggcgtgtgcagcaacgagggcaagtgcatctgccagcccgactggaccggcaaggactgcagcatccacaaccccctgcccaccagcccccccaccggcgagaccgagagatacaagggccccagcggcaccaacatcatcatcggcagcatcgccggcgccgtgctggtggccgccatcgtgctgggcggcaccggctggggcttcaagaacatcagaagaggcagaagcggcggcgcctag

SEQ ID NO: 71785 - DNA, 2217 bp, Artificial Sequence
  Description of Artificial Sequence: Synthetic coding sequence
atggccgccagacccctgcccgtgagccccgccagagccctgctgctggccctggccggcgccctgctggccccctgcgaggccagaggcgtgagcctgtggaaccagggcagagccgacgaggtggtgagcgccagcgtgggcagcggcgacctgtggatccccgtgaagagcttcgacagcaagaaccaccccgaggtgctgaacatcagactgcagagagagagcaaggagctgatcatcaacctggagagaaacgagggcctgatcgccagcagcttcaccgagacccactacctgcaggacggcaccgacgtgagcctggccagaaactacaccgtgatcctgggccactgctactaccacggccacgtgagaggctacagcgacagcgccgtgagcctgagcacctgcagcggcctgagaggcctgatcgtgttcgagaacgagagctacgtgctggagcccatgaagagcgccaccaacagatacaagctgttccccgccaagaagctgaagagcgtgagaggcagctgcggcagccaccacaacacccccaacctggccgccaagaacgtgttccccccccccagccagacctgggccagaagacacaagagagagaccctgaaggccaccaagtacgtggagctggtgatcgtggccgacaacagagagttccagagacagggcaaggacctggagaaggtgaagcagagactgatcgagatcgccaaccacgtggacaagttctacagacccctgaacatcagaatcgtgctggtgggcgtggaggtgtggaacgacatggacaagtgcagcgtgagccaggaccccttcaccagcctgcacgagttcctggactggagaaagatgaagctgctgcccagaaagagccacgacaacgcccagctggtgagcggcgtgtacttccagggcaccaccatcggcatggcccccatcatgagcatgtgcaccgccgaccagagcggcggcatcgtgatggaccacagcgacaaccccctgggcgccgccgtgaccctggcccacgagctgggccacaacttcggcatgaaccacgacaccctggacagaggctgcagctgccagatggccgtggagaagggcggctgcatcatgaacgccagcaccggctaccccttccccatggtgttcagcagctgcagcagaaaggacctggagaccagcctggagaagggcatgggcgtgtgcctgttcaacctgcccgaggtgagagagagcttcggcggccagaagtgcggcaacagattcgtggaggagggcgaggagtgcgactgcggcgagcccgaggagtgcatgaacagatgctgcaacgccaccacctgcaccctgaagcccgacgccgtgtgcgcccacggcctgtgctgcgaggactgccagctgaagcccgccggcaccgcctgcagagacagcagcaacagctgcgacctgcccgagttctgcaccggcgccagcccccactgccccgccaacgtgtacctgcacgacggccacagctgccaggacgtggacggctactgctacaacggcatctgccagacccacgagcagcagtgcgtgaccctgtggggccccggcgccaagcccgcccccggcatctgcttcgagagagtgaacagcgccggcgacccctacggcaactgcggcaaggtgagcaagagcagcttcgccaagtgcgagatgagagacgccaagtgcggcaagatccagtgccagggcggcgccagcagacccgtgatcggcaccaacgccgtgagcatcgagaccaacatccccctgcagcagggcggcagaatcctgtgcagaggcacccacgtgtacctgggcgacgacatgcccgaccccggcctggtgctggccggcaccaagtgcgccgacggcaagatctgcctgaacagacagtgccagaacatcagcgtgttcggcgtgcacgagtgcgccatgcagtgccacggcagaggcgtgtgcaacaacagaaagaactgccactgcgaggcccactgggccccccccttctgcgacaagttcggcttcggcggcagcaccgacagcggccccatcagacaggccgaggccagacaggaggccgccgagagcaacagagagagaggccagggccaggagcccgtgggcagccaggagcacgccagcaccgccagcctgaccctgatctag

SEQ ID NO: 71786 - DNA, 2730 bp, Artificial Sequence
  Description of Artificial Sequence: Synthetic coding sequence
atggccgccagacccctgcccgtgagccccgccagagccctgctgctggccctggccggcgccctgctggccccctgcgaggccagaggcgtgagcctgtggaaccagggcagagccgacgaggtggtgagcgccagcgtgggcagcggcgacctgtggatccccgtgaagagcttcgacagcaagaaccaccccgaggtgctgaacatcagactgcagagagagagcaaggagctgatcatcaacctggagagaaacgagggcctgatcgccagcagcttcaccgagacccactacctgcaggacggcaccgacgtgagcctggccagaaactacaccgtgatcctgggccactgctactaccacggccacgtgagaggctacagcgacagcgccgtgagcctgagcacctgcagcggcctgagaggcctgatcgtgttcgagaacgagagctacgtgctggagcccatgaagagcgccaccaacagatacaagctgttccccgccaagaagctgaagagcgtgagaggcagctgcggcagccaccacaacacccccaacctggccgccaagaacgtgttccccccccccagccagacctgggccagaagacacaagagagagaccctgaaggccaccaagtacgtggagctggtgatcgtggccgacaacagagagttccagagacagggcaaggacctggagaaggtgaagcagagactgatcgagatcgccaaccacgtggacaagttctacagacccctgaacatcagaatcgtgctggtgggcgtggaggtgtggaacgacatggacaagtgcagcgtgagccaggaccccttcaccagcctgcacgagttcctggactggagaaagatgaagctgctgcccagaaagagccacgacaacgcccagctggtgagcggcgtgtacttccagggcaccaccatcggcatggcccccatcatgagcatgtgcaccgccgaccagagcggcggcatcgtgatggaccacagcgacaaccccctgggcgccgccgtgaccctggcccacgagctgggccacaacttcggcatgaaccacgacaccctggacagaggctgcagctgccagatggccgtggagaagggcggctgcatcatgaacgccagcaccggctaccccttccccatggtgttcagcagctgcagcagaaaggacctggagaccagcctggagaagggcatgggcgtgtgcctgttcaacctgcccgaggtgagagagagcttcggcggccagaagtgcggcaacagattcgtggaggagggcgaggagtgcgactgcggcgagcccgaggagtgcatgaacagatgctgcaacgccaccacctgcaccctgaagcccgacgccgtgtgcgcccacggcctgtgctgcgaggactgccagctgaagcccgccggcaccgcctgcagagacagcagcaacagctgcgacctgcccgagttctgcaccggcgccagcccccactgccccgccaacgtgtacctgcacgacggccacagctgccaggacgtggacggctactgctacaacggcatctgccagacccacgagcagcagtgcgtgaccctgtggggccccggcgccaagcccgcccccggcatctgcttcgagagagtgaacagcgccggcgacccctacggcaactgcggcaaggtgagcaagagcagcttcgccaagtgcgagatgagagacgccaagtgcggcaagatccagtgccagggcggcgccagcagacccgtgatcggcaccaacgccgtgagcatcgagaccaacatccccctgcagcagggcggcagaatcctgtgcagaggcacccacgtgtacctgggcgacgacatgcccgaccccggcctggtgctggccggcaccaagtgcgccgacggcaagatctgcctgaacagacagtgccagaacatcagcgtgttcggcgtgcacgagtgcgccatgcagtgccacggcagaggcgtgtgcaacaacagaaagaactgccactgcgaggcccactgggccccccccttctgcgacaagttcggcttcggcggcagcaccgacagcggccccatcagacaggccgacaaccagggcctgaccatcggcatcctggtgaccatcctgtgcctgctggccgccggcttcgtggtgtacctgaagagaaagaccctgatcagactgctgttcaccaacaagaagaccaccatcgagaagctgagatgcgtgagacccagcagaccccccagaggcttccagccctgccaggcccacctgggccacctgggcaagggcctgatgagaaagccccccgacagctacccccccaaggacaaccccagaagactgctgcagtgccagaacgtggacatcagcagacccctgaacggcctgaacgtgccccagccccagagcacccagagagtgctgccccccctgcacagagcccccagagcccccagcgtgcccgccagacccctgcccgccaagcccgccctgagacaggcccagggcacctgcaagcccaaccccccccagaagcccctgcccgccgaccccctggccagaaccaccagactgacccacgccctggccagaacccccggccagtgggagaccggcctgagactggcccccctgagacccgccccccagtacccccaccaggtgcccagaagcacccacaccgcctacatcaagtag

SEQ ID NO: 71787 - DNA, 837 bp, Artificial Sequence
  Description of Artificial Sequence: Synthetic coding sequence
atggccgccagacccctgcccgtgagccccgccagagccctgctgctggccctggccggcgccctgctggccccctgcgaggccagaggcgtgagcctgtggaaccagggcagagccgacgaggtggtgagcgccagcgtgggcagcggcgacctgtggatccccgtgaagagcttcgacagcaagaaccaccccgaggtgctgaacatcagactgcagagagagagcaaggagctgatcatcaacctggagagaaacgagggcctgatcgccagcagcttcaccgagacccactacctgcaggacggcaccgacgtgagcctggccagaaactacaccggccactgctactaccacggccacgtgagaggctacagcgacagcgccgtgagcctgagcacctgcagcggcctgagaggcctgatcgtgttcgagaacgagagctacgtgctggagcccatgaagagcgccaccaacagatacaagctgttccccgccaagaagctgaagagcgtgagaggcagctgcggcagccaccacaacacccccaacctggccgccaagaacgtgttccccccccccagccagacctgggccagaagacacaagagagagaccctgaaggccaccaagtacgtggagctggtgatcgtggccgacaacagagagttccagagacagggcaaggacctggagaaggtgaagcagagactgatcgagatcgccaaccacgtggacaagttctacagacccctgaacatcagaatcgtgctggtgggcgtggaggtgtggaacgacatggacaagtgcagcgtgagccaggaccccttcacctag

SEQ ID NO: 71788 - DNA, 2445 bp, Artificial Sequence
  Description of Artificial Sequence: Synthetic coding sequence
atgagactggccctgctgtgggccctgggcctgctgggcgccggcagccccctgcccagctggcccctgcccaacatcggcggcaccgaggagcagcaggccgagagcgagaaggcccccagagagcccctggagccccaggtgctgcaggacgacctgcccatcagcctgaagaaggtgctgcagaccagcctgcccgagcccctgagaatcaagctggagctggacggcgacagccacatcctggagctgctgcagaacagagagctggtgcccggcagacccaccctggtgtggtaccagcccgacggcaccagagtggtgagcgagggccacaccctggagaactgctgctaccagggcagagtgagaggctacgccggcagctgggtgagcatctgcacctgcagcggcctgagaggcctggtggtgctgacccccgagagaagctacaccctggagcagggccccggcgacctgcagggcccccccatcatcagcagaatccaggacctgcacctgcccggccacacctgcgccctgagctggagagagagcgtgcacacccagaagccccccgagcaccccctgggccagagacacatcagaagaagaagagacgtggtgaccgagaccaagaccgtggagctggtgatcgtggccgaccacagcgaggcccagaagtacagagacttccagcacctgctgaacagaaccctggaggtggccctgctgctggacaccttcttcagacccctgaacgtgagagtggccctggtgggcctggaggcctggacccagagagacctggtggagatcagccccaaccccgccgtgaccctggagaacttcctgcactggagaagagcccacctgctgcccagactgccccacgacagcgcccagctggtgaccggcaccagcttcagcggccccaccgtgggcatggccatccagaacagcatctgcagccccgacttcagcggcggcgtgaacatggaccacagcaccagcatcctgggcgtggccagcagcatcgcccacgagctgggccacagcctgggcctggaccacgacctgcccggcaacagctgcccctgccccggccccgcccccgccaagacctgcatcatggaggccagcaccgacttcctgcccggcctgaacttcagcaactgcagcagaagagccctggagaaggccctgctggacggcatgggcagctgcctgttcgagagactgcccagcctgccccccatggccgccttctgcggcaacatgttcgtggagcccggcgagcagtgcgactgcggcttcctggacgactgcgtggacccctgctgcgacagcctgacctgccagctgagacccggcgcccagtgcgccagcgacggcccctgctgccagaactgccagctgagacccagcggctggcagtgcagacccaccagaggcgactgcgacctgcccgagttctgccccggcgacagcagccagtgcccccccgacgtgagcctgggcgacggcgagccctgcgccggcggccaggccgtgtgcatgcacggcagatgcgccagctacgcccagcagtgccagagcctgtggggccccggcgcccagcccgccgcccccctgtgcctgcagaccgccaacaccagaggcaacgccttcggcagctgcggcagaaaccccagcggcagctacgtgagctgcacccccagagacgccatctgcggccagctgcagtgccagaccggcagaacccagcccctgctgggcagcatcagagacctgctgtgggagaccatcgacgtgaacggcaccgagctgaactgcagctgggtgcacctggacctgggcagcgacgtggcccagcccctgctgaccctgcccggcaccgcctgcggccccggcctggtgtgcatcgaccacagatgccagagagtggacctgctgggcgcccaggagtgcagaagcaagtgccacggccacggcgtgtgcgacagcaacagacactgctactgcgaggagggctgggccccccccgactgcaccacccagctgaaggccaccagcagcctgaccaccggcctgctgctgagcctgctggtgctgctggtgctggtgatgctgggcgccagctactggtacagagccagactgcaccagagactgtgccagctgaagggccccacctgccagtacagagccgcccagagcggccccagcgagagacccggccccccccagagagccctgctggccagaggcaccaagagccagggccccgccaagccccccccccccagaaagcccctgcccgccgacccccagggcagatgccccagcggcgacctgcccggccccggcgccggcatcccccccctggtggtgcccagcagacccgccccccccccccccaccgtgagcagcctgtacctgtag

SEQ ID NO: 71789 - DNA, 2520 bp, Artificial Sequence
  Description of Artificial Sequence: Synthetic coding sequence
atgagactggccctgctgtgggccctgggcctgctgggcgccggcagccccctgcccagctggcccctgcccaacatcggcggcaccgaggagcagcaggccgagagcgagaaggcccccagagagcccctggagccccaggtgctgcaggacgacctgcccatcagcctgaagaaggtgctgcagaccagcctgcccgagcccctgagaatcaagctggagctggacggcgacagccacatcctggagctgctgcagaacagagagctggtgcccggcagacccaccctggtgtggtaccagcccgacggcaccagagtggtgagcgagggccacaccctggagaactgctgctaccagggcagagtgagaggctacgccggcagctgggtgagcatctgcacctgcagcggcctgagaggcctggtggtgctgacccccgagagaagctacaccctggagcagggccccggcgacctgcagggcccccccatcatcagcagaatccaggacctgcacctgcccggccacacctgcgccctgagctggagagagagcgtgcacacccagaagccccccgagcaccccctgggccagagacacatcagaagaagaagagacgtggtgaccgagaccaagaccgtggagctggtgatcgtggccgaccacagcgaggcccagaagtacagagacttccagcacctgctgaacagaaccctggaggtggccctgctgctggacaccttcttcagacccctgaacgtgagagtggccctggtgggcctggaggcctggacccagagagacctggtggagatcagccccaaccccgccgtgaccctggagaacttcctgcactggagaagagcccacctgctgcccagactgccccacgacagcgcccagctggtgaccggcaccagcttcagcggccccaccgtgggcatggccatccagaacagcatctgcagccccgacttcagcggcggcgtgaacatggaccacagcaccagcatcctgggcgtggccagcagcatcgcccacgagctgggccacagcctgggcctggaccacgacctgcccggcaacagctgcccctgccccggccccgcccccgccaagacctgcatcatggaggccagcaccgacttcctgcccggcctgaacttcagcaactgcagcagaagagccctggagaaggccctgctggacggcatgggcagctgcctgttcgagagactgcccagcctgccccccatggccgccttctgcggcaacatgttcgtggagcccggcgagcagtgcgactgcggcttcctggacgactgcgtggacccctgctgcgacagcctgacctgccagctgagacccggcgcccagtgcgccagcgacggcccctgctgccagaactgccagctgagacccagcggctggcagtgcagacccaccagaggcgactgcgacctgcccgagttctgccccggcgacagcagccagtgcccccccgacgtgagcctgggcgacggcgagccctgcgccggcggccaggccgtgtgcatgcacggcagatgcgccagctacgcccagcagtgccagagcctgtggggccccggcgcccagcccgccgcccccctgtgcctgcagaccgccaacaccagaggcaacgccttcggcagctgcggcagaaaccccagcggcagctacgtgagctgcacccccagagacgccatctgcggccagctgcagtgccagaccggcagaacccagcccctgctgggcagcatcagagacctgctgtgggagaccatcgacgtgaacggcaccgagctgaactgcagctgggtgcacctggacctgggcagcgacgtggcccagcccctgctgaccctgcccggcaccgcctgcggccccggcctggtgtgcatcgaccacagatgccagagagtggacctgctgggcgcccaggagtgcagaagcaagtgccacggccacggcgtgtgcgacagcaacagacactgctactgcgaggagggctgggccccccccgactgcaccacccagctgaaggccaccagcagcctgaccaccggcctgctgctgagcctgctggtgctgctggtgctggtgatgctgggcgccagctactggtacagagccagactgcaccagagactgtgccagctgaagggccccacctgccagtacagagccgcccagagcggccccagcgagagacccggccccccccagagagccctgctggccagaggcaccaagcaggccagcgccctgagcttccccgccccccccagcagacccctgccccccgaccccgtgagcaagagactgcagagccagggccccgccaagccccccccccccagaaagcccctgcccgccgacccccagggcagatgccccagcggcgacctgcccggccccggcgccggcatcccccccctggtggtgcccagcagacccgccccccccccccccaccgtgagcagcctgtacctgtag

SEQ ID NO: 71790 - DNA, 2592 bp, Artificial Sequence
  Description of Artificial Sequence: Synthetic coding sequence
atgagactggccctgctgtgggccctgggcctgctgggcgccggcagccccctgcccagctggcccctgcccaacatcggcggcaccgaggagcagcaggccgagagcgagaaggcccccagagagcccctggagccccaggtgctgcaggacgacctgcccatcagcctgaagaaggtgctgcagaccagcctgcccgagcccctgagaatcaagctggagctggacggcgacagccacatcctggagctgctgcagaacagagagctggtgcccggcagacccaccctggtgtggtaccagcccgacggcaccagagtggtgagcgagggccacaccctggagaactgctgctaccagggcagagtgagaggctacgccggcagctgggtgagcatctgcacctgcagcggcctgagaggcctggtggtgctgacccccgagagaagctacaccctggagcagggccccggcgacctgcagggcccccccatcatcagcagaatccaggacctgcacctgcccggccacacctgcgccctgagctggagagagagcgtgcacacccagaagccccccgagcaccccctgggccagagacacatcagaagaagaagagacgtggtgaccgagaccaagaccgtggagctggtgatcgtggccgaccacagcgaggcccagaagtacagagacttccagcacctgctgaacagaaccctggaggtggccctgctgctggacaccttcttcagacccctgaacgtgagagtggccctggtgggcctggaggcctggacccagagagacctggtggagatcagccccaaccccgccgtgaccctggagaacttcctgcactggagaagagcccacctgctgcccagactgccccacgacagcgcccagctggtgaccggcaccagcttcagcggccccaccgtgggcatggccatccagaacagcatctgcagccccgacttcagcggcggcgtgaacatggaccacagcaccagcatcctgggcgtggccagcagcatcgcccacgagctgggccacagcctgggcctggaccacgacctgcccggcaacagctgcccctgccccggccccgcccccgccaagacctgcatcatggaggccagcaccgacttcctgcccggcctgaacttcagcaactgcagcagaagagccctggagaaggccctgctggacggcatgggcagctgcctgttcgagagactgcccagcctgccccccatggccgccttctgcggcaacatgttcgtggagcccggcgagcagtgcgactgcggcttcctggacgactgcgtggacccctgctgcgacagcctgacctgccagctgagacccggcgcccagtgcgccagcgacggcccctgctgccagaactgccagctgagacccagcggctggcagtgcagacccaccagaggcgactgcgacctgcccgagttctgccccggcgacagcagccagtgcccccccgacgtgagcctgggcgacggcgagccctgcgccggcggccaggccgtgtgcatgcacggcagatgcgccagctacgcccagcagtgccagagcctgtggggccccggcgcccagcccgccgcccccctgtgcctgcagaccgccaacaccagaggcaacgccttcggcagctgcggcagaaaccccagcggcagctacgtgagctgcacccccagagacgccatctgcggccagctgcagtgccagaccggcagaacccagcccctgctgggcagcatcagagacctgctgtgggagaccatcgacgtgaacggcaccgagctgaactgcagctgggtgcacctggacctgggcagcgacgtggcccagcccctgctgaccctgcccggcaccgcctgcggccccggcctggtgtgcatcgaccacagatgccagagagtggacctgctgggcgcccaggagtgcagaagcaagtgccacggccacggcgtgtgcgacagcaacagacactgctactgcgaggagggctgggccccccccgactgcaccacccagctgaaggccaccagcagcctgaccaccggcctgctgctgagcctgctggtgctgctggtgctggtgatgctgggcgccagctactggtacagagccagactgcaccagagactgtgccagctgaagggccccacctgccagtacagagccgcccagagcggccccagcgagagacccggccccccccagagagccctgctggccagaggcaccaagcaggccagcgccctgagcttccccgccccccccagcagacccctgccccccgaccccgtgagcaagagactgcaggccgagctggccgacagacccaacccccccaccagacccctgcccgccgaccccgtggtgagaagccccaagagccagggccccgccaagccccccccccccagaaagcccctgcccgccgacccccagggcagatgccccagcggcgacctgcccggccccggcgccggcatcccccccctggtggtgcccagcagacccgccccccccccccccaccgtgagcagcctgtacctgtag

SEQ ID NO: 71791 - DNA, 2517 bp, Artificial Sequence
  Description of Artificial Sequence: Synthetic coding sequence
atgagactggccctgctgtgggccctgggcctgctgggcgccggcagccccctgcccagctggcccctgcccaacatcggcggcaccgaggagcagcaggccgagagcgagaaggcccccagagagcccctggagccccaggtgctgcaggacgacctgcccatcagcctgaagaaggtgctgcagaccagcctgcccgagcccctgagaatcaagctggagctggacggcgacagccacatcctggagctgctgcagaacagagagctggtgcccggcagacccaccctggtgtggtaccagcccgacggcaccagagtggtgagcgagggccacaccctggagaactgctgctaccagggcagagtgagaggctacgccggcagctgggtgagcatctgcacctgcagcggcctgagaggcctggtggtgctgacccccgagagaagctacaccctggagcagggccccggcgacctgcagggcccccccatcatcagcagaatccaggacctgcacctgcccggccacacctgcgccctgagctggagagagagcgtgcacacccagaagccccccgagcaccccctgggccagagacacatcagaagaagaagagacgtggtgaccgagaccaagaccgtggagctggtgatcgtggccgaccacagcgaggcccagaagtacagagacttccagcacctgctgaacagaaccctggaggtggccctgctgctggacaccttcttcagacccctgaacgtgagagtggccctggtgggcctggaggcctggacccagagagacctggtggagatcagccccaaccccgccgtgaccctggagaacttcctgcactggagaagagcccacctgctgcccagactgccccacgacagcgcccagctggtgaccggcaccagcttcagcggccccaccgtgggcatggccatccagaacagcatctgcagccccgacttcagcggcggcgtgaacatggaccacagcaccagcatcctgggcgtggccagcagcatcgcccacgagctgggccacagcctgggcctggaccacgacctgcccggcaacagctgcccctgccccggccccgcccccgccaagacctgcatcatggaggccagcaccgacttcctgcccggcctgaacttcagcaactgcagcagaagagccctggagaaggccctgctggacggcatgggcagctgcctgttcgagagactgcccagcctgccccccatggccgccttctgcggcaacatgttcgtggagcccggcgagcagtgcgactgcggcttcctggacgactgcgtggacccctgctgcgacagcctgacctgccagctgagacccggcgcccagtgcgccagcgacggcccctgctgccagaactgccagctgagacccagcggctggcagtgcagacccaccagaggcgactgcgacctgcccgagttctgccccggcgacagcagccagtgcccccccgacgtgagcctgggcgacggcgagccctgcgccggcggccaggccgtgtgcatgcacggcagatgcgccagctacgcccagcagtgccagagcctgtggggccccggcgcccagcccgccgcccccctgtgcctgcagaccgccaacaccagaggcaacgccttcggcagctgcggcagaaaccccagcggcagctacgtgagctgcacccccagagacgccatctgcggccagctgcagtgccagaccggcagaacccagcccctgctgggcagcatcagagacctgctgtgggagaccatcgacgtgaacggcaccgagctgaactgcagctgggtgcacctggacctgggcagcgacgtggcccagcccctgctgaccctgcccggcaccgcctgcggccccggcctggtgtgcatcgaccacagatgccagagagtggacctgctgggcgcccaggagtgcagaagcaagtgccacggccacggcgtgtgcgacagcaacagacactgctactgcgaggagggctgggccccccccgactgcaccacccagctgaaggccaccagcagcctgaccaccggcctgctgctgagcctgctggtgctgctggtgctggtgatgctgggcgccagctactggtacagagccagactgcaccagagactgtgccagctgaagggccccacctgccagtacagagccgcccagagcggccccagcgagagacccggccccccccagagagccctgctggccagaggcaccaaggccgagctggccgacagacccaacccccccaccagacccctgcccgccgaccccgtggtgagaagccccaagagccagggccccgccaagccccccccccccagaaagcccctgcccgccgacccccagggcagatgccccagcggcgacctgcccggccccggcgccggcatcccccccctggtggtgcccagcagacccgccccccccccccccaccgtgagcagcctgtacctgtag

SEQ ID NO: 71792 - DNA, 2319 bp, Artificial Sequence
  Description of Artificial Sequence: Synthetic coding sequence
atgagactggccctgctgtgggccctgggcctgctgggcgccggcagccccctgcccagctggcccctgcccaacatcggcggcaccgaggagcagcaggccgagagcgagaaggcccccagagagcccctggagccccaggtgctgcaggacgacctgcccatcagcctgaagaaggtgctgcagaccagcctgcccgagcccctgagaatcaagctggagctggacggcgacagccacatcctggagctgctgcagaacagagagctggtgcccggcagacccaccctggtgtggtaccagcccgacggcaccagagtggtgagcgagggccacaccctggagaactgctgctaccagggcagagtgagaggctacgccggcagctgggtgagcatctgcacctgcagcggcctgagaggcctggtggtgctgacccccgagagaagctacaccctggagcagggccccggcgacctgcagggcccccccatcatcagcagaatccaggacctgcacctgcccggccacacctgcgccctgagctggagagagagcgtgcacacccagaagccccccgagcaccccctgggccagagacacatcagaagaagaagagacgtggtgaccgagaccaagaccgtggagctggtgatcgtggccgaccacagcgaggcccagaagtacagagacttccagcacctgctgaacagaaccctggaggtggccctgctgctggacaccttcttcagacccctgaacgtgagagtggccctggtgggcctggaggcctggacccagagagacctggtggagatcagccccaaccccgccgtgaccctggagaacttcctgcactggagaagagcccacctgctgcccagactgccccacgacagcgcccagctggtgaccggcaccagcttcagcggccccaccgtgggcatggccatccagaacagcatctgcagccccgacttcagcggcggcgtgaacatggaccacagcaccagcatcctgggcgtggccagcagcatcgcccacgagctgggccacagcctgggcctggaccacgacctgcccggcaacagctgcccctgccccggccccgcccccgccaagacctgcatcatggaggccagcaccgacttcctgcccggcctgaacttcagcaactgcagcagaagagccctggagaaggccctgctggacggcatgggcagctgcctgttcgagagactgcccagcctgccccccatggccgccttctgcggcaacatgttcgtggagcccggcgagcagtgcgactgcggcttcctggacgactgcgtggacccctgctgcgacagcctgacctgccagctgagacccggcgcccagtgcgccagcgacggcccctgctgccagaactgccagctgagacccagcggctggcagtgcagacccaccagaggcgactgcgacctgcccgagttctgccccggcgacagcagccagtgcccccccgacgtgagcctgggcgacggcgagccctgcgccggcggccaggccgtgtgcatgcacggcagatgcgccagctacgcccagcagtgccagagcctgtggggccccggcgcccagcccgccgcccccctgtgcctgcagaccgccaacaccagaggcaacgccttcggcagctgcggcagaaaccccagcggcagctacgtgagctgcacccccagagacgccatctgcggccagctgcagtgccagaccggcagaacccagcccctgctgggcagcatcagagacctgctgtgggagaccatcgacgtgaacggcaccgagctgaactgcagctgggtgcacctggacctgggcagcgacgtggcccagcccctgctgaccctgcccggcaccgcctgcggccccggcctggtgtgcatcgaccacagatgccagagagtggacctgctgggcgcccaggagtgcagaagcaagtgccacggccacggcgtgtgcgacagcaacagacactgctactgcgaggagggctgggccccccccgactgcaccacccagctgaaggccaccagcagcctgaccaccggcctgctgctgagcctgctggtgctgctggtgctggtgatgctgggcgccagctactggtacagagccagactgcaccagagactgtgccagctgaagggccccacctgccagtacagcctgagaggccagcccagcccccacccccagggcagccactgcctgcccacccccagagccggcgcccacagagtgacctgccccgcccagggcctggagagcagaccctag

SEQ ID NO: 71793 - DNA, 1563 bp, Artificial Sequence
  Description of Artificial Sequence: Synthetic coding sequence
atgagactggccctgctgtgggccctgggcctgctgggcgccggcagccccctgcccagctggcccctgcccaacatcggcggcaccgaggagcagcaggccgagagcgagaaggcccccagagagcccctggagccccaggtgctgcaggacgacctgcccatcagcctgaagaaggtgctgcagaccagcctgcccgagcccctgagaatcaagctggagctggacggcgacagccacatcctggagctgctgcagaacagaagcttcctgcccggcctgaacttcagcaactgcagcagaagagccctggagaaggccctgctggacggcatgggcagctgcctgttcgagagactgcccagcctgccccccatggccgccttctgcggcaacatgttcgtggagcccggcgagcagtgcgactgcggcttcctggacgactgcgtggacccctgctgcgacagcctgacctgccagctgagacccggcgcccagtgcgccagcgacggcccctgctgccagaactgccagctgagacccagcggctggcagtgcagacccaccagaggcgactgcgacctgcccgagttctgccccggcgacagcagccagtgcccccccgacgtgagcctgggcgacggcgagccctgcgccggcggccaggccgtgtgcatgcacggcagatgcgccagctacgcccagcagtgccagagcctgtggggccccggcgcccagcccgccgcccccctgtgcctgcagaccgccaacaccagaggcaacgccttcggcagctgcggcagaaaccccagcggcagctacgtgagctgcacccccagagacgccatctgcggccagctgcagtgccagaccggcagaacccagcccctgctgggcagcatcagagacctgctgtgggagaccatcgacgtgaacggcaccgagctgaactgcagctgggtgcacctggacctgggcagcgacgtggcccagcccctgctgaccctgcccggcaccgcctgcggccccggcctggtgtgcatcgaccacagatgccagagagtggacctgctgggcgcccaggagtgcagaagcaagtgccacggccacggcgtgtgcgacagcaacagacactgctactgcgaggagggctgggccccccccgactgcaccacccagctgaaggccaccagcagcctgaccaccggcctgctgctgagcctgctggtgctgctggtgctggtgatgctgggcgccagctactggtacagagccagactgcaccagagactgtgccagctgaagggccccacctgccagtacagagccgcccagagcggccccagcgagagacccggccccccccagagagccctgctggccagaggcaccaagagccagggccccgccaagccccccccccccagaaagcccctgcccgccgacccccagggcagatgccccagcggcgacctgcccggccccggcgccggcatcccccccctggtggtgcccagcagacccgccccccccccccccaccgtgagcagcctgtacctgtag

SEQ ID NO: 71794 - DNA, 2589 bp, Artificial Sequence
  Description of Artificial Sequence: Synthetic coding sequence
atgagactggccctgctgtgggccctgggcctgctgggcgccggcagccccctgcccagctggcccctgcccaacatcggcggcaccgaggagcagcaggccgagagcgagaaggcccccagagagcccctggagccccaggtgctgcaggacgacctgcccatcagcctgaagaaggtgctgcagaccagcctgcccgagcccctgagaatcaagctggagctggacggcgacagccacatcctggagctgctgcagaacagagagctggtgcccggcagacccaccctggtgtggtaccagcccgacggcaccagagtggtgagcgagggccacaccctggagaactgctgctaccagggcagagtgagaggctacgccggcagctgggtgagcatctgcacctgcagcggcctgagaggcctggtggtgctgacccccgagagaagctacaccctggagcagggccccggcgacctgcagggcccccccatcatcagcagaatccaggacctgcacctgcccggccacacctgcgccctgagctggagagagagcgtgcacacccagaagccccccgagcaccccctgggccagagacacatcagaagaagaagagacgtggtgaccgagaccaagaccgtggagctggtgatcgtggccgaccacagcgaggcccagaagtacagagacttccagcacctgctgaacagaaccctggaggtggccctgctgctggacaccttcttcagacccctgaacgtgagagtggccctggtgggcctggaggcctggacccagagagacctggtggagatcagccccaaccccgccgtgaccctggagaacttcctgcactggagaagagcccacctgctgcccagactgccccacgacagcgcccagctggtgaccggcaccagcttcagcggccccaccgtgggcatggccatccagaacagcatctgcagccccgacttcagcggcggcgtgaacatggaccacagcaccagcatcctgggcgtggccagcagcatcgcccacgagctgggccacagcctgggcctggaccacgacctgcccggcaacagctgcccctgccccggccccgcccccgccaagacctgcatcatggaggccagcaccgacttcctgcccggcctgaacttcagcaactgcagcagaagagccctggagaaggccctgctggacggcatgggcagctgcctgttcgagagactgcccagcctgccccccatggccgccttctgcggcaacatgttcgtggagcccggcgagcagtgcgactgcggcttcctggacgactgcgtggacccctgctgcgacagcctgacctgccagctgagacccggcgcccagtgcgccagcgacggcccctgctgccagaactgccagctgagacccagcggctggcagtgcagacccaccagaggcgactgcgacctgcccgagttctgccccggcgacagcagccagtgcccccccgacgtgagcctgggcgacggcgagccctgcgccggcggccaggccgtgtgcatgcacggcagatgcgccagctacgcccagcagtgccagagcctgtggggccccggcgcccagcccgccgcccccctgtgcctgcagaccgccaacaccagaggcaacgccttcggcagctgcggcagaaaccccagcggcagctacgtgagctgcacccccagagacgccatctgcggccagctgcagtgccagaccggcagaacccagcccctgctgggcagcatcagagacctgctgtgggagaccatcgacgtgaacggcaccgagctgaactgcagctgggtgcacctggacctgggcagcgacgtggcccagcccctgctgaccctgcccggcaccgcctgcggccccggcctggtgtgcatcgaccacagatgccagagagtggacctgctgggcgcccaggagtgcagaagcaagtgccacggccacggcgtgtgcgacagcaacagacactgctactgcgaggagggctgggccccccccgactgcaccacccagctgaaggccaccagcagcctgaccaccggcctgctgctgagcctgctggtgctgctggtgctggtgatgctgggcgccagctactggtacagagccagactgcaccagagactgtgccagctgaagggccccacctgccagtacagagccgcccagagcggccccagcgagagacccggccccccccagagagccctgctggccagaggcaccaaggccagcgccctgagcttccccgccccccccagcagacccctgccccccgaccccgtgagcaagagactgcaggccgagctggccgacagacccaacccccccaccagacccctgcccgccgaccccgtggtgagaagccccaagagccagggccccgccaagccccccccccccagaaagcccctgcccgccgacccccagggcagatgccccagcggcgacctgcccggccccggcgccggcatcccccccctggtggtgcccagcagacccgccccccccccccccaccgtgagcagcctgtacctgtag

SEQ ID NO: 71795 - DNA, 2391 bp, Artificial Sequence
  Description of Artificial Sequence: Synthetic coding sequence
atgagactggccctgctgtgggccctgggcctgctgggcgccggcagccccctgcccagctggcccctgcccaacatcggcggcaccgaggagcagcaggccgagagcgagaaggcccccagagagcccctggagccccaggtgctgcaggacgacctgcccatcagcctgaagaaggtgctgcagaccagcctgcccgagcccctgagaatcaagctggagctggacggcgacagccacatcctggagctgctgcagaacagagagctggtgcccggcagacccaccctggtgtggtaccagcccgacggcaccagagtggtgagcgagggccacaccctggagaactgctgctaccagggcagagtgagaggctacgccggcagctgggtgagcatctgcacctgcagcggcctgagaggcctggtggtgctgacccccgagagaagctacaccctggagcagggccccggcgacctgcagggcccccccatcatcagcagaatccaggacctgcacctgcccggccacacctgcgccctgagctggagagagagcgtgcacacccagaagccccccgagcaccccctgggccagagacacatcagaagaagaagagacgtggtgaccgagaccaagaccgtggagctggtgatcgtggccgaccacagcgaggcccagaagtacagagacttccagcacctgctgaacagaaccctggaggtggccctgctgctggacaccttcttcagacccctgaacgtgagagtggccctggtgggcctggaggcctggacccagagagacctggtggagatcagccccaaccccgccgtgaccctggagaacttcctgcactggagaagagcccacctgctgcccagactgccccacgacagcgcccagctggtgaccggcaccagcttcagcggccccaccgtgggcatggccatccagaacagcatctgcagccccgacttcagcggcggcgtgaacatggaccacagcaccagcatcctgggcgtggccagcagcatcgcccacgagctgggccacagcctgggcctggaccacgacctgcccggcaacagctgcccctgccccggccccgcccccgccaagacctgcatcatggaggccagcaccgacttcctgcccggcctgaacttcagcaactgcagcagaagagccctggagaaggccctgctggacggcatgggcagctgcctgttcgagagactgcccagcctgccccccatggccgccttctgcggcaacatgttcgtggagcccggcgagcagtgcgactgcggcttcctggacgactgcgtggacccctgctgcgacagcctgacctgccagctgagacccggcgcccagtgcgccagcgacggcccctgctgccagaactgccagctgagacccagcggctggcagtgcagacccaccagaggcgactgcgacctgcccgagttctgccccggcgacagcagccagtgcccccccgacgtgagcctgggcgacggcgagccctgcgccggcggccaggccgtgtgcatgcacggcagatgcgccagctacgcccagcagtgccagagcctgtggggccccggcgcccagcccgccgcccccctgtgcctgcagaccgccaacaccagaggcaacgccttcggcagctgcggcagaaaccccagcggcagctacgtgagctgcacccccagagacgccatctgcggccagctgcagtgccagaccggcagaacccagcccctgctgggcagcatcagagacctgctgtgggagaccatcgacgtgaacggcaccgagctgaactgcagctgggtgcacctggacctgggcagcgacgtggcccagcccctgctgaccctgcccggcaccgcctgcggccccggcctggtgtgcatcgaccacagatgccagagagtggacctgctgggcgcccaggagtgcagaagcaagtgccacggccacggcgtgtgcgacagcaacagacactgctactgcgaggagggctgggccccccccgactgcaccacccagctgaaggccaccagcagcctgaccaccggcctgctgctgagcctgctggtgctgctggtgctggtgatgctgggcgccagctactggtacagagccagactgcaccagagactgtgccagctgaagggccccacctgccagtacagactggtgctgagcgccagcagaccccccctgcccggcagatgcagactgaccctgtgccccagagacagcagcctgagaggccagcccagcccccacccccagggcagccactgcctgcccacccccagagccggcgcccacagagtgacctgccccgcccagggcctggagagcagaccctag

SEQ ID NO: 71796 - DNA, 2475 bp, Artificial Sequence
  Description of Artificial Sequence: Synthetic coding sequence
atgagactggccctgctgtgggccctgggcctgctgggcgccggcagccccctgcccagctggcccctgcccaacatcgtgctgagctggggcgtgctgggccccgccggcggcaccgaggagcagcaggccgagagcgagaaggcccccagagagcccctggagccccaggtgctgcaggacgacctgcccatcagcctgaagaaggtgctgcagaccagcctgcccgagcccctgagaatcaagctggagctggacggcgacagccacatcctggagctgctgcagaacagagagctggtgcccggcagacccaccctggtgtggtaccagcccgacggcaccagagtggtgagcgagggccacaccctggagaactgctgctaccagggcagagtgagaggctacgccggcagctgggtgagcatctgcacctgcagcggcctgagaggcctggtggtgctgacccccgagagaagctacaccctggagcagggccccggcgacctgcagggcccccccatcatcagcagaatccaggacctgcacctgcccggccacacctgcgccctgagctggagagagagcgtgcacacccagaagccccccgagcaccccctgggccagagacacatcagaagaagaagagacgtggtgaccgagaccaagaccgtggagctggtgatcgtggccgaccacagcgaggcccagaagtacagagacttccagcacctgctgaacagaaccctggaggtggccctgctgctggacaccttcttcagacccctgaacgtgagagtggccctggtgggcctggaggcctggacccagagagacctggtggagatcagccccaaccccgccgtgaccctggagaacttcctgcactggagaagagcccacctgctgcccagactgccccacgacagcgcccagctggtgaccggcaccagcttcagcggccccaccgtgggcatggccatccagaacagcatctgcagccccgacttcagcggcggcgtgaacatggaccacagcaccagcatcctgggcgtggccagcagcatcgcccacgagctgggccacagcctgggcctggaccacgacctgcccggcaacagctgcccctgccccggccccgcccccgccaagacctgcatcatggaggccagcaccgacttcctgcccggcctgaacttcagcaactgcagcagaagagccctggagaaggccctgctggacggcatgggcagctgcctgttcgagagactgcccagcctgccccccatggccgccttctgcggcaacatgttcgtggagcccggcgagcagtgcgactgcggcttcctggacgactgcgtggacccctgctgcgacagcctgacctgccagctgagacccggcgcccagtgcgccagcgacggcccctgctgccagaactgccagctgagacccagcggctggcagtgcagacccaccagaggcgactgcgacctgcccgagttctgccccggcgacagcagccagtgcccccccgacgtgagcctgggcgacggcgagccctgcgccggcggccaggccgtgtgcatgcacggcagatgcgccagctacgcccagcagtgccagagcctgtggggccccggcgcccagcccgccgcccccctgtgcctgcagaccgccaacaccagaggcaacgccttcggcagctgcggcagaaaccccagcggcagctacgtgagctgcacccccagagacgccatctgcggccagctgcagtgccagaccggcagaacccagcccctgctgggcagcatcagagacctgctgtgggagaccatcgacgtgaacggcaccgagctgaactgcagctgggtgcacctggacctgggcagcgacgtggcccagcccctgctgaccctgcccggcaccgcctgcggccccggcctggtgtgcatcgaccacagatgccagagagtggacctgctgggcgcccaggagtgcagaagcaagtgccacggccacggcgtgtgcgacagcaacagacactgctactgcgaggagggctgggccccccccgactgcaccacccagctgaaggccaccagcagcctgaccaccggcctgctgctgagcctgctggtgctgctggtgctggtgatgctgggcgccagctactggtacagagccagactgcaccagagactgtgccagctgaagggccccacctgccagtacagagccgcccagagcggccccagcgagagacccggccccccccagagagccctgctggccagaggcaccaagagccagggccccgccaagccccccccccccagaaagcccctgcccgccgacccccagggcagatgccccagcggcgacctgcccggccccggcgccggcatcccccccctggtggtgcccagcagacccgccccccccccccccaccgtgagcagcctgtacctgtag

SEQ ID NO: 71797 - DNA, 2757 bp, Artificial Sequence
  Description of Artificial Sequence: Synthetic coding sequence
atgcccggcggcgccggcgccgccagactgtgcctgctggccttcgccctgcagcccctgagacccagagccgccagagagcccggctggaccagaggcagcgaggagggcagccccaagctgcagcacgagctgatcatcccccagtggaagaccagcgagagccccgtgagagagaagcaccccctgaaggccgagctgagagtgatggccgagggcagagagctgatcctggacctggagaagaacgagcagctgttcgcccccagctacaccgagacccactacaccagcagcggcaacccccagaccaccaccagaaagctggaggaccactgcttctaccacggcaccgtgagagagaccgagctgagcagcgtgaccctgagcacctgcagaggcatcagaggcctgatcaccgtgagcagcaacctgagctacgtgatcgagcccctgcccgacagcaagggccagcacctgatctacagaagcgagcacctgaagcccccccccggcaactgcggcttcgagcacagcaagcccaccaccagagactgggccctgcagttcacccagcagaccaagaagagacccagaagaatgaagagagaggacctgaacagcatgaagtacgtggagctgtacctggtggccgactacctggagttccagaagaacagaagagaccaggacgccaccaagcacaagctgatcgagatcgccaactacgtggacaagttctacagaagcctgaacatcagaatcgccctggtgggcctggaggtgtggacccacggcaacatgtgcgaggtgagcgagaacccctacagcaccctgtggagcttcctgagctggagaagaaagctgctggcccagaagtaccacgacaacgcccagctgatcaccggcatgagcttccacggcaccaccatcggcctggcccccctgatggccatgtgcagcgtgtaccagagcggcggcgtgaacatggaccacagcgagaacgccatcggcgtggccgccaccatggcccacgagatgggccacaacttcggcatgacccacgacagcgccgactgctgcagcgccagcgccgccgacggcggctgcatcatggccgccgccaccggccaccccttccccaaggtgttcaacggctgcaacagaagagagctggacagatacctgcagagcggcggcggcatgtgcctgagcaacatgcccgacaccagaatgctgtacggcggcagaagatgcggcaacggctacctggaggacggcgaggagtgcgactgcggcgaggaggaggagtgcaacaacccctgctgcaacgccagcaactgcaccctgagacccggcgccgagtgcgcccacggcagctgctgccaccagtgcaagctgctggcccccggcaccctgtgcagagagcaggccagacagtgcgacctgcccgagttctgcaccggcaagagcccccactgccccaccaacttctaccagatggacggcaccccctgcgagggcggccaggcctactgctacaacggcatgtgcctgacctaccaggagcagtgccagcagctgtggggccccggcgccagacccgcccccgacctgtgcttcgagaaggtgaacgtggccggcgacaccttcggcaactgcggcaaggacatgaacggcgagcacagaaagtgcaacatgagagacgccaagtgcggcaagatccagtgccagagcagcgaggccagacccctggagagcaacgccgtgcccatcgacaccaccatcatcatgaacggcagacagatccagtgcagaggcacccacgtgtacagaggccccgaggaggagggcgacatgctggaccccggcctggtgatgaccggcaccaagtgcggctacaaccacatctgcttcgagggccagtgcagaaacaccagcttcttcgagaccgagggctgcggcaagaagtgcaacggccacggcgtgtgcaacaacaaccagaactgccactgcctgcccggctgggccccccccttctgcaacacccccggccacggcggcagcatcgacagcggccccatgccccccgagagcgtgggccccgtggtggccggcgtgctggtggccatcctggtgctggccgtgctgatgctgatgtactactgctgcagacagaacaacaagctgggccagctgaagcccagcgccctgcccagcaagctgagacagcagttcagctgccccttcagagtgagccagaacagcggcaccggccacgccaaccccaccttcaagctgcagaccccccagggcaagagaaaggtgatcaacacccccgagatcctgagaaagcccagccagcccccccccagacccccccccgactacctgagaggcggcagcccccccgcccccctgcccgcccacctgagcagagccgccagaaacagccccggccccggcagccagatcgagagaaccgagagcagcagaagacccccccccagcagacccatcccccccgcccccaactgcatcgtgagccaggacttcagcagacccagacccccccagaaggccctgcccgccaaccccgtgcccggcagaagaagcctgcccagacccggcggcgccagccccctgagaccccccggcgccggcccccagcagagcagacccctggccgccctggcccccaagttccccgagtacagaagccagagagccggcggcatgatcagcagcaagatctag

SEQ ID NO: 71798 - DNA, 2763 bp, Artificial Sequence
  Description of Artificial Sequence: Synthetic coding sequence
atgcccggcggcgccggcgccgccagactgtgcctgctggccttcgccctgcagcccctgagacccagagccgccagagagcccggctggaccatcagcagaggcagcgaggagggcagccccaagctgcagcacgagctgatcatcccccagtggaagaccagcgagagccccgtgagagagaagcaccccctgaaggccgagctgagagtgatggccgagggcagagagctgatcctggacctggagaagaacgagcagctgttcgcccccagctacaccgagacccactacaccagcagcggcaacccccagaccaccaccagaaagctggaggaccactgcttctaccacggcaccgtgagagagaccgagctgagcagcgtgaccctgagcacctgcagaggcatcagaggcctgatcaccgtgagcagcaacctgagctacgtgatcgagcccctgcccgacagcaagggccagcacctgatctacagaagcgagcacctgaagcccccccccggcaactgcggcttcgagcacagcaagcccaccaccagagactgggccctgcagttcacccagcagaccaagaagagacccagaagaatgaagagagaggacctgaacagcatgaagtacgtggagctgtacctggtggccgactacctggagttccagaagaacagaagagaccaggacgccaccaagcacaagctgatcgagatcgccaactacgtggacaagttctacagaagcctgaacatcagaatcgccctggtgggcctggaggtgtggacccacggcaacatgtgcgaggtgagcgagaacccctacagcaccctgtggagcttcctgagctggagaagaaagctgctggcccagaagtaccacgacaacgcccagctgatcaccggcatgagcttccacggcaccaccatcggcctggcccccctgatggccatgtgcagcgtgtaccagagcggcggcgtgaacatggaccacagcgagaacgccatcggcgtggccgccaccatggcccacgagatgggccacaacttcggcatgacccacgacagcgccgactgctgcagcgccagcgccgccgacggcggctgcatcatggccgccgccaccggccaccccttccccaaggtgttcaacggctgcaacagaagagagctggacagatacctgcagagcggcggcggcatgtgcctgagcaacatgcccgacaccagaatgctgtacggcggcagaagatgcggcaacggctacctggaggacggcgaggagtgcgactgcggcgaggaggaggagtgcaacaacccctgctgcaacgccagcaactgcaccctgagacccggcgccgagtgcgcccacggcagctgctgccaccagtgcaagctgctggcccccggcaccctgtgcagagagcaggccagacagtgcgacctgcccgagttctgcaccggcaagagcccccactgccccaccaacttctaccagatggacggcaccccctgcgagggcggccaggcctactgctacaacggcatgtgcctgacctaccaggagcagtgccagcagctgtggggccccggcgccagacccgcccccgacctgtgcttcgagaaggtgaacgtggccggcgacaccttcggcaactgcggcaaggacatgaacggcgagcacagaaagtgcaacatgagagacgccaagtgcggcaagatccagtgccagagcagcgaggccagacccctggagagcaacgccgtgcccatcgacaccaccatcatcatgaacggcagacagatccagtgcagaggcacccacgtgtacagaggccccgaggaggagggcgacatgctggaccccggcctggtgatgaccggcaccaagtgcggctacaaccacatctgcttcgagggccagtgcagaaacaccagcttcttcgagaccgagggctgcggcaagaagtgcaacggccacggcgtgtgcaacaacaaccagaactgccactgcctgcccggctgggccccccccttctgcaacacccccggccacggcggcagcatcgacagcggccccatgccccccgagagcgtgggccccgtggtggccggcgtgctggtggccatcctggtgctggccgtgctgatgctgatgtactactgctgcagacagaacaacaagctgggccagctgaagcccagcgccctgcccagcaagctgagacagcagttcagctgccccttcagagtgagccagaacagcggcaccggccacgccaaccccaccttcaagctgcagaccccccagggcaagagaaaggtgatcaacacccccgagatcctgagaaagcccagccagcccccccccagacccccccccgactacctgagaggcggcagcccccccgcccccctgcccgcccacctgagcagagccgccagaaacagccccggccccggcagccagatcgagagaaccgagagcagcagaagacccccccccagcagacccatcccccccgcccccaactgcatcgtgagccaggacttcagcagacccagacccccccagaaggccctgcccgccaaccccgtgcccggcagaagaagcctgcccagacccggcggcgccagccccctgagaccccccggcgccggcccccagcagagcagacccctggccgccctggcccccaagttccccgagtacagaagccagagagccggcggcatgatcagcagcaagatctag

SEQ ID NO: 71799 - DNA, 1917 bp, Artificial Sequence
  Description of Artificial Sequence: Synthetic coding sequence
atgtgcgaggtgagcgagaacccctacagcaccctgtggagcttcctgagctggagaagaaagctgctggcccagaagtaccacgacaacgcccagctgatcaccggcatgagcttccacggcaccaccatcggcctggcccccctgatggccatgtgcagcgtgtaccagagcggcggcgtgaacatggaccacagcgagaacgccatcggcgtggccgccaccatggcccacgagatgggccacaacttcggcatgacccacgacagcgccgactgctgcagcgccagcgccgccgacggcggctgcatcatggccgccgccaccggccaccccttccccaaggtgttcaacggctgcaacagaagagagctggacagatacctgcagagcggcggcggcatgtgcctgagcaacatgcccgacaccagaatgctgtacggcggcagaagatgcggcaacggctacctggaggacggcgaggagtgcgactgcggcgaggaggaggagtgcaacaacccctgctgcaacgccagcaactgcaccctgagacccggcgccgagtgcgcccacggcagctgctgccaccagtgcaagctgctggcccccggcaccctgtgcagagagcaggccagacagtgcgacctgcccgagttctgcaccggcaagagcccccactgccccaccaacttctaccagatggacggcaccccctgcgagggcggccaggcctactgctacaacggcatgtgcctgacctaccaggagcagtgccagcagctgtggggccccggcgccagacccgcccccgacctgtgcttcgagaaggtgaacgtggccggcgacaccttcggcaactgcggcaaggacatgaacggcgagcacagaaagtgcaacatgagagacgccaagtgcggcaagatccagtgccagagcagcgaggccagacccctggagagcaacgccgtgcccatcgacaccaccatcatcatgaacggcagacagatccagtgcagaggcacccacgtgtacagaggccccgaggaggagggcgacatgctggaccccggcctggtgatgaccggcaccaagtgcggctacaaccacatctgcttcgagggccagtgcagaaacaccagcttcttcgagaccgagggctgcggcaagaagtgcaacggccacggcgtgtgcaacaacaaccagaactgccactgcctgcccggctgggccccccccttctgcaacacccccggccacggcggcagcatcgacagcggccccatgccccccgagagcgtgggccccgtggtggccggcgtgctggtggccatcctggtgctggccgtgctgatgctgatgtactactgctgcagacagaacaacaagctgggccagctgaagcccagcgccctgcccagcaagctgagacagcagttcagctgccccttcagagtgagccagaacagcggcaccggccacgccaaccccaccttcaagctgcagaccccccagggcaagagaaaggtgatcaacacccccgagatcctgagaaagcccagccagcccccccccagacccccccccgactacctgagaggcggcagcccccccgcccccctgcccgcccacctgagcagagccgccagaaacagccccggccccggcagccagatcgagagaaccgagagcagcagaagacccccccccagcagacccatcccccccgcccccaactgcatcgtgagccagaagtgcctgctgccccccgccatgatcctgagagccccccagcccagcggcaccgtggtgtgcctggtgatcagcttcaacatggccttctacagaagcatgagaatcagaatcgagcccggcatcaagaccaagctgctggtgctgctggtgtggaagcagttctag

SEQ ID NO: 71800 - DNA, 2868 bp, Artificial Sequence
  Description of Artificial Sequence: Synthetic coding sequence
atgcccggcggcgccggcgccgccagactgtgcctgctggccttcgccctgcagcccctgagacccagagccgccagagagcccggctggaccagaggcagcgaggagggcagccccaagctgcagcacgagctgatcatcccccagtggaagaccagcgagagccccgtgagagagaagcaccccctgaaggccgagctgagagtgatggccgagggcagagagctgatcctggacctggagaagaacgagcagctgttcgcccccagctacaccgagacccactacaccagcagcggcaacccccagaccaccaccagaaagctggaggaccactgcttctaccacggcaccgtgagagagaccgagctgagcagcgtgaccctgagcacctgcagaggcatcagaggcctgatcaccgtgagcagcaacctgagctacgtgatcgagcccctgcccgacagcaagggccagcacctgatctacagaagcgagcacctgaagcccccccccggcaactgcggcttcgagcacagcaagcccaccaccagagactgggccctgcagttcacccagcagaccaagaagagacccagaagaatgaagagagaggacctgaacagcatgaagtacgtggagctgtacctggtggccgactacctggagttccagaagaacagaagagaccaggacgccaccaagcacaagctgatcgagatcgccaactacgtggacaagttctacagaagcctgaacatcagaatcgccctggtgggcctggaggtgtggacccacggcaacatgtgcgaggtgagcgagaacccctacagcaccctgtggagcttcctgagctggagaagaaagctgctggcccagaagtaccacgacaacgcccagctgatcaccggcatgagcttccacggcaccaccatcggcctggcccccctgatggccatgtgcagcgtgtaccagagcggcggcgtgaacatggaccacagcgagaacgccatcggcgtggccgccaccatggcccacgagatgggccacaacttcggcatgacccacgacagcgccgactgctgcagcgccagcgccgccgacggcggctgcatcatggccgccgccaccggccaccccttccccaaggtgttcaacggctgcaacagaagagagctggacagatacctgcagagcggcggcggcatgtgcctgagcaacatgcccgacaccagaatgctgtacggcggcagaagatgcggcaacggctacctggaggacggcgaggagtgcgactgcggcgaggaggaggagtgcaacaacccctgctgcaacgccagcaactgcaccctgagacccggcgccgagtgcgcccacggcagctgctgccaccagtgcaagctgctggcccccggcaccctgtgcagagagcaggccagacagtgcgacctgcccgagttctgcaccggcaagagcccccactgccccaccaacttctaccagatggacggcaccccctgcgagggcggccaggcctactgctacaacggcatgtgcctgacctaccaggagcagtgccagcagctgtggggccccggcgccagacccgcccccgacctgtgcttcgagaaggtgaacgtggccggcgacaccttcggcaactgcggcaaggacatgaacggcgagcacagaaagtgcaacatgagagacgccaagtgcggcaagatccagtgccagagcagcgaggccagacccctggagagcaacgccgtgcccatcgacaccaccatcatcatgaacggcagacagatccagtgcagaggcacccacgtgtacagaggccccgaggaggagggcgacatgctggaccccggcctggtgatgaccggcaccaagtgcggctacaaccacatctgcttcgagggccagtgcagaaacaccagcttcttcgagaccgagggctgcggcaagaagtgcaacggccacggcgtgtgcaacaacaaccagaactgccactgcctgcccggctgggccccccccttctgcaacacccccggccacggcggcagcatcgacagcggccccatgccccccgagagcgtgggccccgtggtggccggcgtgctggtggccatcctggtgctggccgtgctgatgctgatgtactactgctgcagacagaacaacaagctgggccagctgaagcccagcgccctgcccagcaagctgagacagcagttcagctgccccttcagagtgagccagaacagcggcaccggccacgccaaccccaccttcaagctgcagaccccccagggcaagagaaaggtgatcaacacccccgagatcctgagaaagcccagccagcccccccccagacccccccccgactacctgagaggcggcagcccccccgcccccctgcccgcccacctgagcagagccgccagaaacagccccggccccggcagccagatcgagagaaccgagagcagcagaagacccccccccagcagacccatcccccccgcccccaactgcatcgtgagccaggacttcagcagacccagacccccccagaaggccctgcccgccaaccccgtgcccggcagaagaagcctgcccagacccggcggcgccagccccctgagaccccccggcgccggcccccagcagagcagacccctggccgccctggcccccaaggtgagccccagagaggccctgaaggtgaaggccggcaccagaggcctgcagggcggcagatgcagagtggagaagaccaagcagttcatgctgctggtggtgtggaccgagctgcccgagcagaagcccagagccaagcacagctgcttcctggtgcccgcctag

SEQ ID NO: 71801 - DNA, 2208 bp, Artificial Sequence
  Description of Artificial Sequence: Synthetic coding sequence
atgtggagagtgctgttcctgctgagcggcctgggcggcctgagaatggacagcaacttcgacagcctgcccgtgcagatcaccgtgcccgagaagatcagaagcatcatcaaggagggcatcgagagccaggccagctacaagatcgtgatcgagggcaagccctacaccgtgaacctgatgcagaagaacttcctgccccacaacttcagagtgtacagctacagcggcaccggcatcatgaagcccctggaccaggacttccagaacttctgccactaccagggctacatcgagggctaccccaagagcgtggtgatggtgagcacctgcaccggcctgagaggcgtgctgcagttcgagaacgtgagctacggcatcgagcccctggagagcagcgtgggcttcgagcacgtgatctaccaggtgaagcacaagaaggccgacgtgagcctgtacaacgagaaggacatcgagagcagagacctgagcttcaagctgcagagcgtggagccccagcaggacttcgccaagtacatcgagatgcacgtgatcgtggagaagcagctgtacaaccacatgggcagcgacaccaccgtggtggcccagaaggtgttccagctgatcggcctgaccaacgccatcttcgtgagcttcaacatcaccatcatcctgagcagcctggagctgtggatcgacgagaacaagatcgccaccaccggcgaggccaacgagctgctgcacaccttcctgagatggaagaccagctacctggtgctgagaccccacgacgtggccttcctgctggtgtacagagagaagagcaactacgtgggcgccaccttccagggcaagatgtgcgacgccaactacgccggcggcgtggtgctgcaccccagaaccatcagcctggagagcctggccgtgatcctggcccagctgctgagcctgagcatgggcatcacctacgacgacatcaacaagtgccagtgcagcggcgccgtgtgcatcatgaaccccgaggccatccacttcagcggcgtgaagatcttcagcaactgcagcttcgaggacttcgcccacttcatcagcaagcagaagagccagtgcctgcacaaccagcccagactggaccccttcttcaagcagcaggccgtgtgcggcaacgccaagctggaggccggcgaggagtgcgactgcggcaccgagcaggactgcgccctgatcggcgagacctgctgcgacatcgccacctgcagattcaaggccggcagcaactgcgccgagggcccctgctgcgagaactgcctgttcatgagcaaggagagaatgtgcagacccagcttcgaggagtgcgacctgcccgagtactgcaacggcagcagcgccagctgccccgagaaccactacgtgcagaccggccacccctgcggcctgaaccagtggatctgcatcgacggcgtgtgcatgagcggcgacaagcagtgcaccgacaccttcggcaaggaggtggagttcggccccagcgagtgctacagccacctgaacagcaagaccgacgtgagcggcaactgcggcatcagcgacagcggctacacccagtgcgaggccgacaacctgcagtgcggcaagctgatctgcaagtacgtgggcaagttcctgctgcagatccccagagccaccatcatctacgccaacatcagcggccacctgtgcatcgccgtggagttcgccagcgaccacgccgacagccagaagatgtggatcaaggacggcaccagctgcggcagcaacaaggtgtgcagaaaccagagatgcgtgagcagcagctacctgggctacgactgcaccaccgacaagtgcaacgacagaggcgtgtgcaacaacaagaagcactgccactgcagcgccagctacctgccccccgactgcagcgtgcagagcgacctgtggcccggcggcagcatcgacagcggcaacttcccccccgtggccatccccgccagactgcccgagagaagatacatcgagaacatctaccacagcaagcccatgagatggcccttcttcctgttcatccccttcttcatcatcttctgcgtgctgatcgccatcatggtgaaggtgaacttccagagaaagaagtggagaaccgaggactacagcagcgacgagcagcccgagagcgagagcgagcccaagggctag

SEQ ID NO: 71802 - DNA, 2151 bp, Artificial Sequence
  Description of Artificial Sequence: Synthetic coding sequence
atgtggagagtgctgttcctgctgagcggcctgggcggcctgagaatggacagcaacttcgacagcctgcccgtgcagatcaccgtgcccgagaagatcagaagcatcatcaaggagggcatcgagagccaggccagctacaagatcgtgatcgagggcaagccctacaccgtgaacctgatgcagaagaacttcctgccccacaacttcagagtgtacagctacagcggcaccggcatcatgaagcccctggaccaggacttccagaacttctgccactaccagggctacatcgagggctaccccaagagcgtggtgatggtgagcacctgcaccggcctgagaggcgtgctgcagttcgagaacgtgagctacggcatcgagcccctggagagcagcgtgggcttcgagcacgtgatctaccaggtgaagcacaagaaggccgacgtgagcctgtacaacgagaaggacatcgagagcagagacctgagcttcaagctgcagagcgtggagtacaaccacatgggcagcgacaccaccgtggtggcccagaaggtgttccagctgatcggcctgaccaacgccatcttcgtgagcttcaacatcaccatcatcctgagcagcctggagctgtggatcgacgagaacaagatcgccaccaccggcgaggccaacgagctgctgcacaccttcctgagatggaagaccagctacctggtgctgagaccccacgacgtggccttcctgctggtgtacagagagaagagcaactacgtgggcgccaccttccagggcaagatgtgcgacgccaactacgccggcggcgtggtgctgcaccccagaaccatcagcctggagagcctggccgtgatcctggcccagctgctgagcctgagcatgggcatcacctacgacgacatcaacaagtgccagtgcagcggcgccgtgtgcatcatgaaccccgaggccatccacttcagcggcgtgaagatcttcagcaactgcagcttcgaggacttcgcccacttcatcagcaagcagaagagccagtgcctgcacaaccagcccagactggaccccttcttcaagcagcaggccgtgtgcggcaacgccaagctggaggccggcgaggagtgcgactgcggcaccgagcaggactgcgccctgatcggcgagacctgctgcgacatcgccacctgcagattcaaggccggcagcaactgcgccgagggcccctgctgcgagaactgcctgttcatgagcaaggagagaatgtgcagacccagcttcgaggagtgcgacctgcccgagtactgcaacggcagcagcgccagctgccccgagaaccactacgtgcagaccggccacccctgcggcctgaaccagtggatctgcatcgacggcgtgtgcatgagcggcgacaagcagtgcaccgacaccttcggcaaggaggtggagttcggccccagcgagtgctacagccacctgaacagcaagaccgacgtgagcggcaactgcggcatcagcgacagcggctacacccagtgcgaggccgacaacctgcagtgcggcaagctgatctgcaagtacgtgggcaagttcctgctgcagatccccagagccaccatcatctacgccaacatcagcggccacctgtgcatcgccgtggagttcgccagcgaccacgccgacagccagaagatgtggatcaaggacggcaccagctgcggcagcaacaaggtgtgcagaaaccagagatgcgtgagcagcagctacctgggctacgactgcaccaccgacaagtgcaacgacagaggcgtgtgcaacaacaagaagcactgccactgcagcgccagctacctgccccccgactgcagcgtgcagagcgacctgtggcccggcggcagcatcgacagcggcaacttcccccccgtggccatccccgccagactgcccgagagaagatacatcgagaacatctaccacagcaagcccatgagatggcccttcttcctgttcatccccttcttcatcatcttctgcgtgctgatcgccatcatggtgaaggtgaacttccagagaaagaagtggagaaccgaggactacagcagcgacgagcagcccgagagcgagagcgagcccaagggctag

SEQ ID NO: 71803 - DNA, 2331 bp, Artificial Sequence
  Description of Artificial Sequence: Synthetic coding sequence
atggtgcagctgcaccaggacaccgacccccagatccccaagggccagccctgcaccctgaacagcagcgagggcggcgccagacccgccgtgccccacaccctgttcagcagcgccctggacagatggctgcacaacgacagcttcatcatggccgtgggcgagcccctggtgcacatcagagtgaccctgctgctgctgtggttcggcatgttcctgagcatcagcggccacagccaggccagacccagccagtacttcaccagccccgaggtggtgatccccctgaaggtgatcagcagaggcagaggcgccaaggcccccggctggctgagctacagcctgagattcggcggccagagatacatcgtgcacatgagagtgaacaagctgctgttcgccgcccacctgcccgtgttcacctacaccgagcagcacgccctgctgcaggaccagcccttcatccaggacgactgctactaccacggctacgtggagggcgtgcccgagagcctggtggccctgagcacctgcagcggcggcttcctgggcatgctgcagatcaacgacctggtgtacgagatcaagcccatcagcgtgagcgccaccttcgagcacctggtgtacaagatcgacagcgacgacacccagttcccccccatgagatgcggcctgaccgaggagaagatcgcccaccagatggagctgcagctgagctacaacttcaccctgaagcagagcagcttcgtgggctggtggacccaccagagattcgtggagctggtggtggtggtggacaacatcagatacctgttcagccagagcaacgccaccaccgtgcagcacgaggtgttcaacgtggtgaacatcgtggacagcttctaccaccccctggaggtggacgtgatcctgaccggcatcgacatctggaccgccagcaaccccctgcccaccagcggcgacctggacaacgtgctggaggacttcagcatctggaagaactacaacctgaacaacagactgcagcacgacgtggcccacctgttcatcaaggacacccagggcatgaagctgggcgtggcctacgtgaagggcatctgccagaaccccttcaacaccggcgtggacgtgttcgaggacaacagactggtggtgttcgccatcaccctgggccacgagctgggccacaacctgggcatgcagcacgacacccagtggtgcgtgtgcgagctgcagtggtgcatcatgcacgcctacagaaaggtgaccaccaagttcagcaactgcagctacgcccagtactgggacagcaccatcagcagcggcctgtgcatccagccccccccctaccccggcaacatcttcagactgaagtactgcggcaacctggtggtggaggagggcgaggagtgcgactgcggcaccatcagacagtgcgccaaggacccctgctgcctgctgaactgcaccctgcaccccggcgccgcctgcgccttcggcatctgctgcaaggactgcaagttcctgcccagcggcaccctgtgcagacagcaggtgggcgagtgcgacctgcccgagtggtgcaacggcaccagccaccagtgccccgacgacgtgtacgtgcaggacggcatcagctgcaacgtgaacgccttctgctacgagaagacctgcaacaaccacgacatccagtgcaaggagatcttcggccaggacgccagaagcgccagccagagctgctaccaggagatcaacacccagggcaacagattcggccactgcggcatcgtgggcaccacctacgtgaagtgctggacccccgacatcatgtgcggcagagtgcagtgcgagaacgtgggcgtgatccccaacctgatcgagcacagcaccgtgcagcagttccacctgaacgacaccacctgctggggcaccgactaccacctgggcatggccatccccgacatcggcgaggtgaaggacggcaccgtgtgcggccccgagaagatctgcatcagaaagaagtgcgccagcatggtgcacctgagccaggcctgccagcccaagacctgcaacatgagaggcatctgcaacaacaagcagcactgccactgcaaccacgagtgggcccccccctactgcaaggacaagggctacggcggcagcgccgacagcggccccccccccaagaacaacatggagggcctgaacgtgatgggcaagctgagatacctgagcctgctgtgcctgctgcccctggtggccttcctgctgttctgcctgcacgtgctgttcaagaagagaaccaagagcaaggaggacgaggagggctag

SEQ ID NO: 71804 - DNA, 2169 bp, Artificial Sequence
  Description of Artificial Sequence: Synthetic coding sequence
atggccgtggacggcaccctggtgtacatcagagtgaccctgctgctgctgtggctgggcgtgttcctgagcatcagcggctactgccaggccggccccagccagcacttcaccagccccgaggtggtgatccccctgaaggtgatcagcagaggcagaagcgccaaggcccccggctggctgagctacagcctgagattcggcggccagaagcacgtggtgcacatgagagtgaagaagctgctggtgagcagacacctgcccgtgttcacctacaccgacgacagagccctgctggaggaccagctgttcatccccgacgactgctactaccacggctacgtggaggccgcccccgagagcctggtggtgttcagcgcctgcttcggcggcttcagaggcgtgctgaagatcagcggcctgacctacgagatcgagcccatcagacacagcgccaccttcgagcacctggtgtacaagatcaacagcaacgagacccagttccccgccatgagatgcggcctgaccgagaaggaggtggccagacagcagctggagttcgaggaggccgagaacagcgccctggagcccaagagcgccggcgactggtggacccacgcctggttcctggagctggtggtggtggtgaaccacgacttcttcatctacagccagagcaacatcagcaaggtgcaggaggacgtgttcctggtggtgaacatcgtggacagcatgtacaagcagctgggcacctacatcatcctgatcggcatcgagatctggaaccagggcaacgtgttccccatgaccagcatcgagcaggtgctgaacgacttcagccagtggaagcagatcagcctgagccagctgcagcacgacgccgcccacatgttcatcaagaacagcctgatcagcatcctgggcctggcctacgtggccggcatctgcagaccccccatcgactgcggcgtggacaacttccagggcgacacctggagcctgttcgccaacaccgtggcccacgagctgggccacaccctgggcatgcagcacgacgaggagttctgcttctgcggcgagagaggctgcatcatgaacaccttcagagtgcccgccgagaagttcaccaactgcagctacgccgacttcatgaagaccaccctgaaccagggcagctgcctgcacaacccccccagactgggcgagatcttcatgctgaagagatgcggcaacggcgtggtggagagagaggagcagtgcgactgcggcagcgtgcagcagtgcgagcaggacgcctgctgcctgctgaactgcaccctgagacccggcgccgcctgcgccttcggcctgtgctgcaaggactgcaagttcatgcccagcggcgagctgtgcagacaggaggtgaacgagtgcgacctgcccgagtggtgcaacggcaccagccaccagtgccccgaggacagatacgtgcaggacggcatcccctgcagcgacagcgcctactgctaccagaagagatgcaacaaccacgaccagcactgcagagagatcttcggcaaggacgccaagagcgccagccagaactgctacaaggagatcaacagccagggcaacagattcggccactgcggcatcaacggcaccacctacctgaagtgccacatcagcgacgtgttctgcggcagagtgcagtgcgagaacgtgagagacatccccctgctgcaggaccacttcaccctgcagcacacccacatcaacggcgtgacctgctggggcatcgactaccacctgagaatgaacatcagcgacatcggcgaggtgaaggacggcaccgtgtgcggccccggcaagatctgcatccacaagaagtgcgtgagcctgagcgtgctgagccacgtgtgcctgcccgagacctgcaacatgaagggcatctgcaacaacaagcaccactgccactgcggctacggctggagccccccctactgccagcacagaggctacggcggcagcatcgacagcggccccgccagcgccaagagaggcgtgttcctgcccctgatcgtgatccccagcctgagcgtgctgaccttcctgttcaccgtgggcctgctgatgtacctgagacagtgcagcggccccaaggagaccaaggcccacagcagcggctag

SEQ ID NO: 71805 - DNA, 2721 bp, Artificial Sequence
  Description of Artificial Sequence: Synthetic coding sequence
atgcaggccgccgtggccgtgagcgtgcccttcctgctgctgtgcgtgctgggcacctgcccccccgccagatgcggccaggccggcgacgccagcctgatggagctggagaagagaaaggagaacagattcgtggagagacagagcatcgtgcccctgagactgatctacagaagcggcggcgaggacgagagcagacacgacgccctggacaccagagtgagaggcgacctgggcggcccccagctgacccacgtggaccaggccagcttccaggtggacgccttcggcaccagcttcatcctggacgtggtgctgaaccacgacctgctgagcagcgagtacatcgagagacacatcgagcacggcggcaagaccgtggaggtgaagggcggcgagcactgctactaccagggccacatcagaggcaaccccgacagcttcgtggccctgagcacctgccacggcctgcacggcatgttctacgacggcaaccacacctacctgatcgagcccgaggagaacgacaccacccaggaggacttccacttccacagcgtgtacaagagcagactgttcgagttcagcctggacgacctgcccagcgagttccagcaggtgaacatcacccccagcaagttcatcctgaagcccagacccaagagaagcaagagacagctgagaagataccccagaaacgtggaggaggagaccaagtacatcgagctgatgatcgtgaacgaccacctgatgttcaagaagcacagactgagcgtggtgcacaccaacacctacgccaagagcgtggtgaacatggccgacctgatctacaaggaccagctgaagaccagaatcgtgctggtggccatggagacctgggccaccgacaacaagttcgccatcagcgagaaccccctgatcaccctgagagagttcatgaagtacagaagagacttcatcaaggagaagagcgacgccgtgcacctgttcagcggcagccagttcgagagcagcagaagcggcgccgcctacatcggcggcatctgcagcctgctgaagggcggcggcgtgaacgagttcggcaagaccgacctgatggccgtgaccctggcccagagcctggcccacaacatcggcatcatcagcgacaagagaaagctggccagcggcgagtgcaagtgcgaggacacctggagcggctgcatcatgggcgacaccggctactacctgcccaagaagttcacccagtgcaacatcgaggagtaccacgacttcctgaacagcggcggcggcgcctgcctgttcaacaagcccagcaagctgctggacccccccgagtgcggcaacggcttcatcgagaccggcgaggagtgcgactgcggcacccccgccgagtgcgtgctggagggcgccgagtgctgcaagaagtgcaccctgacccaggacagccagtgcagcgacggcctgtgctgcaagaagtgcaagttccagcccatgggcaccgtgtgcagagaggccgtgaacgactgcgacatcagagagacctgcagcggcaacagcagccagtgcgcccccaacatccacaagatggacggctacagctgcgacggcgtgcagggcatctgcttcggcggcagatgcaagaccagagacagacagtgcaagtacatctggggccagaaggtgaccgccagcgacaagtactgctacgagaagctgaacatcgagggcaccgagaagggcaactgcggcaaggacaaggacacctggatccagtgcaacaagagagacgtgctgtgcggctacctgctgtgcaccaacatcggcaacatccccagactgggcgagctggacggcgagatcaccagcaccctggtggtgcagcagggcagaaccctgaactgcagcggcggccacgtgaagctggaggaggacgtggacctgggctacgtggaggacggcaccccctgcggcccccagatgatgtgcctggagcacagatgcctgcccgtggccagcttcaacttcagcacctgcctgagcagcaaggagggcaccatctgcagcggcaacggcgtgtgcagcaacgagctgaagtgcgtgtgcaacagacactggatcggcagcgactgcaacacctacttcccccacaacgacgacgccaagaccggcatcaccctgagcggcaacggcgtggccggcaccaacatcatcatcggcatcatcgccggcaccatcctggtgctggccctgatcctgggcatcaccgcctggggctacaagaactacagagagcagagacagctgccccagggcgactacgtgaagaagcccggcgacggcgacagcttctacagcgacatcccccccggcgtgagcaccaacagcgccagcagcagcaagaagagaagcaacggcctgagccacagctggagcgagagaatccccgacaccaagcacatcagcgacatctgcgagaacggcagacccagaagcaacagctggcagggcaacctgggcggcaacaagaagaagatcagaggcaagagattcagacccagaagcaacagcaccgagaccctgagccccgccaagagccccagcagcagcaccggcagcatcgccagcagcagaaagtacccctaccccatgccccccctgcccgacgaggacaagaaggtgaacagacagagcgccagactgtgggagaccagcatctag

SEQ ID NO: 71806 - DNA, 2700 bp, Artificial Sequence
  Description of Artificial Sequence: Synthetic coding sequence
atgcaggccgccgtggccgtgagcgtgcccttcctgctgctgtgcgtgctgggcacctgcccccccgccagatgcggccaggccggcgacgccagcctgatggagctggagaagagaaaggagaacagattcgtggagagacagagcatcgtgcccctgagactgatctacagaagcggcggcgaggacgagagcagacacgacgccctggacaccagagtgagaggcgacctgggcggcccccagctgacccacgtggaccaggccagcttccaggtggacgccttcggcaccagcttcatcctggacgtggtgctgaaccacgacctgctgagcagcgagtacatcgagagacacatcgagcacggcggcaagaccgtggaggtgaagggcggcgagcactgctactaccagggccacatcagaggcaaccccgacagcttcgtggccctgagcacctgccacggcctgcacggcatgttctacgacggcaaccacacctacctgatcgagcccgaggagaacgacaccacccaggaggacttccacttccacagcgtgtacaagagcagactgttcgagttcagcctggacgacctgcccagcgagttccagcaggtgaacatcacccccagcaagttcatcctgaagcccagacccaagagaagcaagagacagctgagaagataccccagaaacgtggaggaggagaccaagtacatcgagctgatgatcgtgaacgaccacctgatgttcaagaagcacagactgagcgtggtgcacaccaacacctacgccaagagcgtggtgaacatggccgacctgatctacaaggaccagctgaagaccagaatcgtgctggtggccatggagacctgggccaccgacaacaagttcgccatcagcgagaaccccctgatcaccctgagagagttcatgaagtacagaagagacttcatcaaggagaagagcgacgccgtgcacctgttcagcggcagccagttcgagagcagcagaagcggcgccgcctacatcggcggcatctgcagcctgctgaagggcggcggcgtgaacgagttcggcaagaccgacctgatggccgtgaccctggcccagagcctggcccacaacatcggcatcatcagcgacaagagaaagctggccagcggcgagtgcaagtgcgaggacacctggagcggctgcatcatgggcgacaccggctactacctgcccaagaagttcacccagtgcaacatcgaggagtaccacgacttcctgaacagcggcggcggcgcctgcctgttcaacaagcccagcaagctgctggacccccccgagtgcggcaacggcttcatcgagaccggcgaggagtgcgactgcggcacccccgccgagtgcgtgctggagggcgccgagtgctgcaagaagtgcaccctgacccaggacagccagtgcagcgacggcctgtgctgcaagaagtgcaagttccagcccatgggcaccgtgtgcagagaggccgtgaacgactgcgacatcagagagacctgcagcggcaacagcagccagtgcgcccccaacatccacaagatggacggctacagctgcgacggcgtgcagggcatctgcttcggcggcagatgcaagaccagagacagacagtgcaagtacatctggggccagaaggtgaccgccagcgacaagtactgctacgagaagctgaacatcgagggcaccgagaagggcaactgcggcaaggacaaggacacctggatccagtgcaacaagagagacgtgctgtgcggctacctgctgtgcaccaacatcggcaacatccccagactgggcgagctggacggcgagatcaccagcaccctggtggtgcagcagggcagaaccctgaactgcagcggcggccacgtgaagctggaggaggacgtggacctgggctacgtggaggacggcaccccctgcggcccccagatgatgtgcctggagcacagatgcctgcccgtggccagcttcaacttcagcacctgcctgagcagcaaggagggcaccatctgcagcggcaacggcgtgtgcagcaacgagctgaagtgcgtgtgcaacagacactggatcggcagcgactgcaacacctacttcccccacaacgacgacgccaagaccggcatcaccctgagcggcaacggcgtggccggcaccaacatcatcatcggcatcatcgccggcaccatcctggtgctggccctgatcctgggcatcaccgcctggggctacaacaacatcttcaacttcagaagcaacggcctgagccacagctggagcgagagaatccccgacaccaagcacatcagcgacatctgcgagaacggcagacccagaagcaacagctggcagggcaacctgggcggcaacaagaagaagatcagaggcaagagattcagacccagaagcaacagcaccgagtacctgaacccctggttcaagagagactacaacgtggccaagtgggtggaggacgtgaacaagaacaccgagggcccctacttcagaaccctgagccccgccaagagccccagcagcagcaccggcagcatcgccagcagcagaaagtacccctaccccatgccccccctgcccgacgaggacaagaaggtgaacagacagagcgccagactgtgggagaccagcatctag

SEQ ID NO: 71807 - DNA, 2580 bp, Artificial Sequence
  Description of Artificial Sequence: Synthetic coding sequence
atgcaggccgccgtggccgtgagcgtgcccttcctgctgctgtgcgtgctgggcacctgcccccccgccagatgcggccaggccggcgacgccagcctgatggagctggagaagagaaaggagaacagattcgtggagagacagagcatcgtgcccctgagactgatctacagaagcggcggcgaggacgagagcagacacgacgccctggacaccagagtgagaggcgacctgggcggcccccagctgacccacgtggaccaggccagcttccaggtggacgccttcggcaccagcttcatcctggacgtggtgctgaaccacgacctgctgagcagcgagtacatcgagagacacatcgagcacggcggcaagaccgtggaggtgaagggcggcgagcactgctactaccagggccacatcagaggcaaccccgacagcttcgtggccctgagcacctgccacggcctgcacggcatgttctacgacggcaaccacacctacctgatcgagcccgaggagaacgacaccacccaggaggacttccacttccacagcgtgtacaagagcagactgttcgagttcagcctggacgacctgcccagcgagttccagcaggtgaacatcacccccagcaagttcatcctgaagcccagacccaagagaagcaagagacagctgagaagataccccagaaacgtggaggaggagaccaagtacatcgagctgatgatcgtgaacgaccacctgatgttcaagaagcacagactgagcgtggtgcacaccaacacctacgccaagagcgtggtgaacatggccgacctgatctacaaggaccagctgaagaccagaatcgtgctggtggccatggagacctgggccaccgacaacaagttcgccatcagcgagaaccccctgatcaccctgagagagttcatgaagtacagaagagacttcatcaaggagaagagcgacgccgtgcacctgttcagcggcagccagttcgagagcagcagaagcggcgccgcctacatcggcggcatctgcagcctgctgaagggcggcggcgtgaacgagttcggcaagaccgacctgatggccgtgaccctggcccagagcctggcccacaacatcggcatcatcagcgacaagagaaagctggccagcggcgagtgcaagtgcgaggacacctggagcggctgcatcatgggcgacaccggctactacctgcccaagaagttcacccagtgcaacatcgaggagtaccacgacttcctgaacagcggcggcggcgcctgcctgttcaacaagcccagcaagctgctggacccccccgagtgcggcaacggcttcatcgagaccggcgaggagtgcgactgcggcacccccgccgagtgcgtgctggagggcgccgagtgctgcaagaagtgcaccctgacccaggacagccagtgcagcgacggcctgtgctgcaagaagtgcaagttccagcccatgggcaccgtgtgcagagaggccgtgaacgactgcgacatcagagagacctgcagcggcaacagcagccagtgcgcccccaacatccacaagatggacggctacagctgcgacggcgtgcagggcatctgcttcggcggcagatgcaagaccagagacagacagtgcaagtacatctggggccagaaggtgaccgccagcgacaagtactgctacgagaagctgaacatcgagggcaccgagaagggcaactgcggcaaggacaaggacacctggatccagtgcaacaagagagacgtgctgtgcggctacctgctgtgcaccaacatcggcaacatccccagactgggcgagctggacggcgagatcaccagcaccctggtggtgcagcagggcagaaccctgaactgcagcggcggccacgtgaagctggaggaggacgtggacctgggctacgtggaggacggcaccccctgcggcccccagatgatgtgcctggagcacagatgcctgcccgtggccagcttcaacttcagcacctgcctgagcagcaaggagggcaccatctgcagcggcaacggcgtgtgcagcaacgagctgaagtgcgtgtgcaacagacactggatcggcagcgactgcaacacctacttcccccacaacgacgacgccaagaccggcatcaccctgagcggcaacggcgtggccggcaccaacatcatcatcggcatcatcgccggcaccatcctggtgctggccctgatcctgggcatcaccgcctggggctacaagaactacagagagcagagacagctgccccagggcgactacgtgaagaagcccggcgacggcgacagcttctacagcgacatcccccccggcgtgagcaccaacagcgccagcagcagcaagaagagaagcaacggcctgagccacagctggagcgagagaatccccgacaccaagcacatcagcgacatctgcgagaacggcagacccagaagcaacagctggcagggcaacctgggcggcaacaagaagaagatcagaggcaagagattcagacccagaagcaacagcaccgagtag

SEQ ID NO: 71808 - DNA, 2613 bp, Artificial Sequence
  Description of Artificial Sequence: Synthetic coding sequence
atgcaggccgccgtggccgtgagcgtgcccttcctgctgctgtgcgtgctgggcacctgcccccccgccagatgcggccaggccggcgacgccagcctgatggagctggagaagagaaaggagaacagattcgtggagagacagagcatcgtgcccctgagactgatctacagaagcggcggcgaggacgagagcagacacgacgccctggacaccagagtgagaggcgacctgggcggcccccagctgacccacgtggaccaggccagcttccaggtggacgccttcggcaccagcttcatcctggacgtggtgctgaaccacgacctgctgagcagcgagtacatcgagagacacatcgagcacggcggcaagaccgtggaggtgaagggcggcgagcactgctactaccagggccacatcagaggcaaccccgacagcttcgtggccctgagcacctgccacggcctgcacggcatgttctacgacggcaaccacacctacctgatcgagcccgaggagaacgacaccacccaggaggacttccacttccacagcgtgtacaagagcagactgttcgagttcagcctggacgacctgcccagcgagttccagcaggtgaacatcacccccagcaagttcatcctgaagcccagacccaagagaagcaagagacagctgagaagataccccagaaacgtggaggaggagaccaagtacatcgagctgatgatcgtgaacgaccacctgatgttcaagaagcacagactgagcgtggtgcacaccaacacctacgccaagagcgtggtgaacatggccgacctgatctacaaggaccagctgaagaccagaatcgtgctggtggccatggagacctgggccaccgacaacaagttcgccatcagcgagaaccccctgatcaccctgagagagttcatgaagtacagaagagacttcatcaaggagaagagcgacgccgtgcacctgttcagcggcagccagttcgagagcagcagaagcggcgccgcctacatcggcggcatctgcagcctgctgaagggcggcggcgtgaacgagttcggcaagaccgacctgatggccgtgaccctggcccagagcctggcccacaacatcggcatcatcagcgacaagagaaagctggccagcggcgagtgcaagtgcgaggacacctggagcggctgcatcatgggcgacaccggctactacctgcccaagaagttcacccagtgcaacatcgaggagtaccacgacttcctgaacagcggcggcggcgcctgcctgttcaacaagcccagcaagctgctggacccccccgagtgcggcaacggcttcatcgagaccggcgaggagtgcgactgcggcacccccgccgagtgcgtgctggagggcgccgagtgctgcaagaagtgcaccctgacccaggacagccagtgcagcgacggcctgtgctgcaagaagtgcaagttccagcccatgggcaccgtgtgcagagaggccgtgaacgactgcgacatcagagagacctgcagcggcaacagcagccagtgcgcccccaacatccacaagatggacggctacagctgcgacggcgtgcagggcatctgcttcggcggcagatgcaagaccagagacagacagtgcaagtacatctggggccagaaggtgaccgccagcgacaagtactgctacgagaagctgaacatcgagggcaccgagaagggcaactgcggcaaggacaaggacacctggatccagtgcaacaagagagacgtgctgtgcggctacctgctgtgcaccaacatcggcaacatccccagactgggcgagctggacggcgagatcaccagcaccctggtggtgcagcagggcagaaccctgaactgcagcggcggccacgtgaagctggaggaggacgtggacctgggctacgtggaggacggcaccccctgcggcccccagatgatgtgcctggagcacagatgcctgcccgtggccagcttcaacttcagcacctgcctgagcagcaaggagggcaccatctgcagcggcaacggcgtgtgcagcaacgagctgaagtgcgtgtgcaacagacactggatcggcagcgactgcaacacctacttcccccacaacgacgacgccaagaccggcatcaccctgagcggcaacggcgtggccggcaccaacatcatcatcggcatcatcgccggcaccatcctggtgctggccctgatcctgggcatcaccgcctggggctacaagaactacagagagcagagaagcaacggcctgagccacagctggagcgagagaatccccgacaccaagcacatcagcgacatctgcgagaacggcagacccagaagcaacagctggcagggcaacctgggcggcaacaagaagaagatcagaggcaagagattcagacccagaagcaacagcaccgagaccctgagccccgccaagagccccagcagcagcaccggcagcatcgccagcagcagaaagtacccctaccccatgccccccctgcccgacgaggacaagaaggtgaacagacagagcgccagactgtgggagaccagcatctag

SEQ ID NO: 71809 - DNA, 2700 bp, Artificial Sequence
  Description of Artificial Sequence: Synthetic coding sequence
atgcaggccgccgtggccgtgagcgtgcccttcctgctgctgtgcgtgctgggcacctgcccccccgccagatgcggccaggccggcgacgccagcctgatggagctggagaagagaaaggagaacagattcgtggagagacagagcatcgtgcccctgagactgatctacagaagcggcggcgaggacgagagcagacacgacgccctggacaccagagtgagaggcgacctgggcggcccccagctgacccacgtggaccaggccagcttccaggtggacgccttcggcaccagcttcatcctggacgtggtgctgaaccacgacctgctgagcagcgagtacatcgagagacacatcgagcacggcggcaagaccgtggaggtgaagggcggcgagcactgctactaccagggccacatcagaggcaaccccgacagcttcgtggccctgagcacctgccacggcctgcacggcatgttctacgacggcaaccacacctacctgatcgagcccgaggagaacgacaccacccaggaggacttccacttccacagcgtgtacaagagcagactgttcgagttcagcctggacgacctgcccagcgagttccagcaggtgaacatcacccccagcaagttcatcctgaagcccagacccaagagaagcaagagacagctgagaagataccccagaaacgtggaggaggagaccaagtacatcgagctgatgatcgtgaacgaccacctgatgttcaagaagcacagactgagcgtggtgcacaccaacacctacgccaagagcgtggtgaacatggccgacctgatctacaaggaccagctgaagaccagaatcgtgctggtggccatggagacctgggccaccgacaacaagttcgccatcagcgagaaccccctgatcaccctgagagagttcatgaagtacagaagagacttcatcaaggagaagagcgacgccgtgcacctgttcagcggcagccagttcgagagcagcagaagcggcgccgcctacatcggcggcatctgcagcctgctgaagggcggcggcgtgaacgagttcggcaagaccgacctgatggccgtgaccctggcccagagcctggcccacaacatcggcatcatcagcgacaagagaaagctggccagcggcgagtgcaagtgcgaggacacctggagcggctgcatcatgggcgacaccggctactacctgcccaagaagttcacccagtgcaacatcgaggagtaccacgacttcctgaacagcggcggcggcgcctgcctgttcaacaagcccagcaagctgctggacccccccgagtgcggcaacggcttcatcgagaccggcgaggagtgcgactgcggcacccccgccgagtgcgtgctggagggcgccgagtgctgcaagaagtgcaccctgacccaggacagccagtgcagcgacggcctgtgctgcaagaagtgcaagttccagcccatgggcaccgtgtgcagagaggccgtgaacgactgcgacatcagagagacctgcagcggcaacagcagccagtgcgcccccaacatccacaagatggacggctacagctgcgacggcgtgcagggcatctgcttcggcggcagatgcaagaccagagacagacagtgcaagtacatctggggccagaaggtgaccgccagcgacaagtactgctacgagaagctgaacatcgagggcaccgagaagggcaactgcggcaaggacaaggacacctggatccagtgcaacaagagagacgtgctgtgcggctacctgctgtgcaccaacatcggcaacatccccagactgggcgagctggacggcgagatcaccagcaccctggtggtgcagcagggcagaaccctgaactgcagcggcggccacgtgaagctggaggaggacgtggacctgggctacgtggaggacggcaccccctgcggcccccagatgatgtgcctggagcacagatgcctgcccgtggccagcttcaacttcagcacctgcctgagcagcaaggagggcaccatctgcagcggcaacggcgtgtgcagcaacgagctgaagtgcgtgtgcaacagacactggatcggcagcgactgcaacacctacttcccccacaacgacgacgccaagaccggcatcaccctgagcggcaacggcgtggccggcaccaacatcatcatcggcatcatcgccggcaccatcctggtgctggccctgatcctgggcatcaccgcctggggctacaagaactacagagagcagagaagcaacggcctgagccacagctggagcgagagaatccccgacaccaagcacatcagcgacatctgcgagaacggcagacccagaagcaacagctggcagggcaacctgggcggcaacaagaagaagatcagaggcaagagattcagacccagaagcaacagcaccgagtacctgaacccctggttcaagagagactacaacgtggccaagtgggtggaggacgtgaacaagaacaccgagggcccctacttcagaaccctgagccccgccaagagccccagcagcagcaccggcagcatcgccagcagcagaaagtacccctaccccatgccccccctgcccgacgaggacaagaaggtgaacagacagagcgccagactgtgggagaccagcatctag

SEQ ID NO: 71810 - DNA, 2328 bp, Artificial Sequence
  Description of Artificial Sequence: Synthetic coding sequence
atgctgcagggcctgctgcccgtgagcctgctgctgagcgtggccgtgagcgccatcaaggagctgcccggcgtgaagaagtacgaggtggtgtaccccatcagactgcaccccctgcacaagagagaggccaaggagcccgagcagcaggagcagttcgagaccgagctgaagtacaagatgaccatcaacggcaagatcgccgtgctgtacctgaagaagaacaagaacctgctggcccccggctacaccgagacctactacaacagcaccggcaaggagatcaccaccagcccccagatcatggacgactgctactaccagggccacatcctgaacgagaaggtgagcgacgccagcatcagcacctgcagaggcctgagaggctacttcagccagggcgaccagagatacttcatcgagcccctgagccccatccacagagacggccaggagcacgccctgttcaagtacaaccccgacgagaagaactacgacagcacctgcggcatggacggcgtgctgtgggcccacgacctgcagcagaacatcgccctgcccgccaccaagctggtgaagctgaaggacagaaaggtgcaggagcacgagaagtacatcgagtactacctggtgctggacaacggcgagttcaagagatacaacgagaaccaggacgagatcagaaagagagtgttcgagatggccaactacgtgaacatgctgtacaagaagctgaacacccacgtggccctggtgggcatggagatctggaccgacaaggacaagatcaagatcacccccaacgccagcttcaccctggagaacttcagcaagtggagaggcagcgtgctgagcagaagaaagagacacgacatcgcccagctgatcaccgccaccgagctggccggcaccaccgtgggcctggccttcatgagcaccatgtgcagcccctacagcgtgggcgtggtgcaggaccacagcgacaacctgctgagagtggccggcaccatggcccacgagatgggccacaacttcggcatgttccacgacgactacagctgcaagtgccccagcaccatctgcgtgatggacaaggccctgagcttctacatccccaccgacttcagcagctgcagcagactgagctacgacaagttcttcgaggacaagctgagcaactgcctgttcaacgcccccctgcccaccgacatcatcagcacccccatctgcggcaaccagctggtggagatgggcgaggactgcgactgcggcaccagcgaggagtgcaccaacatctgctgcgacgccaagacctgcaagatcaaggccaccttccagtgcgccctgggcgagtgctgcgagaagtgccagttcaagaaggccggcatggtgtgcagacccgccaaggacgagtgcgacctgcccgagatgtgcaacggcaagagcggcaactgccccgacgacagattccaggtgaacggcttcccctgccaccacggcaagggccactgcctgatgggcacctgccccaccctgcaggagcagtgcaccgagctgtggggccccggcaccgaggtggccgacaagagctgctacaacagaaacgagggcggcagcaagtacggctactgcagaagagtggacgacaccctgatcccctgcaaggccaacgacaccatgtgcggcaagctgttctgccagggcggcagcgacaacctgccctggaagggcagaatcgtgaccttcctgacctgcaagaccttcgaccccgaggacaccagccaggagatcggcatggtggccaacggcaccaagtgcggcgacaacaaggtgtgcatcaacgccgagtgcgtggacatcgagaaggcctacaagagcaccaactgcagcagcaagtgcaagggccacgccgtgtgcgaccacgagctgcagtgccagtgcgaggagggctggatcccccccgactgcgacgacagcagcgtggtgttccacttcagcatcgtggtgggcgtgctgttccccatggccgtgatcttcgtggtggtggccatggtgatcagacaccagagcagcagagagaagcagaagaaggaccagagacccctgagcaccaccggcaccagaccccacaagcagaagagaaagccccagatggtgaaggccgtgcagccccaggagatgagccagatgaagccccacgtgtacgacctgcccgtggagggcaacgagccccccgccagcttccacaaggacaccaacgccctgccccccaccgtgttcaaggacaaccccgtgagcacccccaaggacagcaaccccaaggcctag

SEQ ID NO: 71811 - DNA, 1452 bp, Artificial Sequence
  Description of Artificial Sequence: Synthetic coding sequence
atggagatctggaccgacaaggacaagatcaagatcacccccaacgccagcttcaccctggagaacttcagcaagtggagaggcagcgtgctgagcagaagaaagagacacgacatcgcccagctgatcaccgccaccgagctggccggcaccaccgtgggcctggccttcatgagcaccatgtgcagcccctacagcgtgggcgtggtgcaggaccacagcgacaacctgctgagagtggccggcaccatggcccacgagatgggccacaacttcggcatgttccacgacgactacagctgcaagtgccccagcaccatctgcgtgatggacaaggccctgagcttctacatccccaccgacttcagcagctgcagcagactgagctacgacaagttcttcgaggacaagctgagcaactgcctgttcaacgcccccctgcccaccgacatcatcagcacccccatctgcggcaaccagctggtggagatgggcgaggactgcgactgcggcaccagcgaggagtgcaccaacatctgctgcgacgccaagacctgcaagatcaaggccaccttccagtgcgccctgggcgagtgctgcgagaagtgccagttcaagaaggccggcatggtgtgcagacccgccaaggacgagtgcgacctgcccgagatgtgcaacggcaagagcggcaactgccccgacgacagattccaggtgaacggcttcccctgccaccacggcaagggccactgcctgatgggcacctgccccaccctgcaggagcagtgcaccgagctgtggggccccggcaccgaggtggccgacaagagctgctacaacagaaacgagggcggcagcaagtacggctactgcagaagagtggacgacaccctgatcccctgcaaggccaacgacaccatgtgcggcaagctgttctgccagggcggcagcgacaacctgccctggaagggcagaatcgtgaccttcctgacctgcaagaccttcgaccccgaggacaccagccaggagatcggcatggtggccaacggcaccaagtgcggcgacaacaaggtgtgcatcaacgccgagtgcgtggacatcgagaaggcctacaagagcaccaactgcagcagcaagtgcaagggccacgccgtgtgcgaccacgagctgcagtgccagtgcgaggagggctggatcccccccgactgcgacgacagcagcgtggtgttcagaagactgctgcactgcggctggggcgccgtgcccaacggcggccacttctgcggcggctgctacggcaaccccgcccccgagctgcagagaaaggccgaggagagaagcgaggccaccatctaccactggcaccaggccacccagaccgaggaggagacccccgacggcaagggctgcagcacccccagagacgagagcgacgaggccccctgcgtgtag

SEQ ID NO: 71812 - DNA, 1623 bp, Artificial Sequence
  Description of Artificial Sequence: Synthetic coding sequence
atgctgcagggcctgctgcccgtgagcctgctgctgagcgtggccgtgagcgccatcaaggagctgcccggcgtgaagaagtacgaggtggtgtaccccatcagactgcaccccctgcacaagagagaggccaaggagcccgagcagcaggagcagttcgagaccgagctgaagtacaagatgaccatcaacggcaagatcgccgtgctgtacctgaagaagaacaagaacctgctggcccccggctacaccgagacctactacaacagcaccggcaaggagatcaccaccagcccccagatcatggacgactgctactaccagggccacatcctgaacgagaaggtgagcgacgccagcatcagcacctgcagaggcctgagaggctacttcagccagggcgaccagagatacttcatcgagcccctgagccccatccacagagacggccaggagcacgccctgttcaagtacaaccccgacgagaagaactacgacagcacctgcggcatggacggcgtgctgtgggcccacgacctgcagcagaacatcgccctgcccgccaccaagctggtgaagctgaaggacagaaaggtgcaggagcacgagaagtacatcgagtactacctggtgctggacaacggcgagttcaagagatacaacgagaaccaggacgagatcagaaagagagtgttcgagatggccaactacgtgaacatgctgtacaagaagctgaacacccacgtggccctggtgggcatggagatctggaccgacaaggacaagatcaagatcacccccaacgccagcttcaccctggagaacttcagcaagtggagaggcagcgtgctgagcagaagaaagagacacgacatcgcccagctgatcaccgccaccgagctggccggcaccaccgtgggcctggccttcatgagcaccatgtgcagcccctacagcgtgggcgtggtgcaggaccacagcgacaacctgctgagagtggccggcaccatggcccacgagatgggccacaacttcggcatgttccacgacgactacagctgcaagtgccccagcaccatctgcgtgatggacaaggccctgagcttctacatccccaccgacttcagcagctgcagcagactgagctacgacaagttcttcgaggacaagctgagcaactgcctgttcaacgcccccctgcccaccgacatcatcagcacccccatctgcggcaaccagctggtggagatgggcgaggactgcgactgcggcaccagcgaggagtgcaccaacatctgctgcgacgccaagacctgcaagatcaaggccaccttccagtgcgccctgggcgagtgctgcgagaagtgccagttcaagaaggccggcatggtgtgcagacccgccaaggacgagtgcgacctgcccgagatgtgcaacggcaagagcggcaactgccccgacgacagattccaggtgaacggcttcccctgccaccacggcaagggccactgcctgatgggcacctgccccaccctgcaggagcagtgcaccgagctgtggggccccggcagaagaaccaaccccttcccctgcgcctgcgccaaggagaaccacttcagatag

SEQ ID NO: 71813 - DNA, 924 bp, Artificial Sequence
  Description of Artificial Sequence: Synthetic coding sequence
atggccaactacgtgaacatgctgtacaagaagctgaacacccacgtggccctggtgggcatggagatctggaccgacaaggacaagatcaagatcacccccaacgccagcttcaccctggagaacttcagcaagtggagaggcagcgtgctgagcagaagaaagagacacgacatcgcccagctgatcaccgccaccgagctggccggcaccaccgtgggcctggccttcatgagcaccatgtgcagcccctacagcgtgggcgtggtgcaggaccacagcgacaacctgctgagagtggccggcaccatggcccacgagatgggccacaacttcggcatgttccacgacgactacagctgcaagtgccccagcaccatctgcgtgatggacaaggccctgagcttctacatccccaccgacttcagcagctgcagcagactgagctacgacaagttcttcgaggacaagctgagcaactgcctgttcaacgcccccctgcccaccgacatcatcagcacccccatctgcggcaaccagctggtggagatgggcgaggactgcgactgcggcaccagcgaggagtgcaccaacatctgctgcgacgccaagacctgcaagatcaaggccaccttccagtgcgccctgggcgagtgctgcgagaagtgccagttcaagaaggccggcatggtgtgcagacccgccaaggacgagtgcgacctgcccgagatgtgcaacggcaagagcggcaactgccccgacgacagattccaggtgaacggcttcccctgccaccacggcaagggccactgcctgatgggcacctgccccaccctgcaggagcagtgcaccgagctgtggggccccggcagaagaaccaaccccttcccctgcgcctgcgccaaggagaaccacttcagatag

SEQ ID NO: 71814 - DNA, 2463 bp, Artificial Sequence
  Description of Artificial Sequence: Synthetic coding sequence
atgaagatgctgctgctgctgcactgcctgggcgtgttcctgagctgcagcggccacatccaggacgagcacccccagtaccacagcccccccgacgtggtgatccccgtgagaatcaccggcaccaccagaggcatgaccccccccggctggctgagctacatcctgcccttcggcggccagaagcacatcatccacatcaaggtgaagaagctgctgttcagcaagcacctgcccgtgttcacctacaccgaccagggcgccatcctggaggaccagcccttcgtgcagaacaactgctactaccacggctacgtggagggcgaccccgagagcctggtgagcctgagcacctgcttcggcggcttccagggcatcctgcagatcaacgacttcgcctacgagatcaagcccctggccttcagcaccaccttcgagcacctggtgtacaagatggacagcgaggagaagcagttcagcaccatgagaagcggcttcatgcagaacgagatcacctgcagaatggagttcgaggagatcgacaacagcacccagaagcagagcagctacgtgggctggtggatccacttcagaatcgtggagatcgtggtggtgatcgacaactacctgtacatcagatacgagagaaacgacagcaagctgctggaggacctgtacgtgatcgtgaacatcgtggacagcatcctggacgtgatcggcgtgaaggtgctgctgttcggcctggagatctggaccaacaagaacctgatcgtggtggacgacgtgagaaagagcgtgcacctgtactgcaagtggaagagcgagaacatcacccccagaatgcagcacgacaccagccacctgttcaccaccctgggcctgagaggcctgagcggcatcggcgccttcagaggcatgtgcaccccccacagaagctgcgccatcgtgaccttcatgaacaagaccctgggcaccttcagcatcgccgtggcccaccacctgggccacaacctgggcatgaaccacgacgaggacacctgcagatgcagccagcccagatgcatcatgcacgagggcaacccccccatcaccaagttcagcaactgcagctacggcgacttctgggagtacaccgtggagagaaccaagtgcctgctggagaccgtgcacaccaaggacatcttcaacgtgaagagatgcggcaacggcgtggtggaggagggcgaggagtgcgactgcggccccctgaagcactgcgccaaggacccctgctgcctgagcaactgcaccctgaccgacggcagcacctgcgccttcggcctgtgctgcaaggactgcaagttcctgcccagcggcaaggtgtgcagaaaggaggtgaacgagtgcgacctgcccgagtggtgcaacggcaccagccacaagtgccccgacgacttctacgtggaggacggcatcccctgcaaggagagaggctactgctacgagaagagctgccacgacagaaacgagcagtgcagaagaatcttcggcgccggcgccaacaccgccagcgagacctgctacaaggagctgaacaccctgggcgacagagtgggccactgcggcatcaagaacgccacctacatcaagtgcaacatcagcgacgtgcagtgcggcagaatccagtgcgagaacgtgaccgagatccccaacatgagcgaccacaccaccgtgcactgggccagattcaacgacatcatgtgctggagcaccgactaccacctgggcatgaagggccccgacatcggcgaggtgaaggacggcaccgagtgcggcatcgaccacatctgcatccacagacactgcgtgcacatcaccatcctgaacagcaactgcagccccgccttctgcaacaagagaggcatctgcaacaacaagcaccactgccactgcaactacctgtgggacccccccaactgcctgatcaagggctacggcggcagcgtggacagcggccccccccccaagagaaagaagaagaagaagttctgctacctgtgcatcctgctgctgatcgtgctgttcatcctgctgtgctgcctgtacagactgtgcaagaagagcaagcccatcaagaagcagcaggacgtgcagacccccagcgccaaggaggaggagaagatccagagaagaccccacgagctgcccccccagagccagccctgggtgatgcccagccagagccagccccccgtgacccccagccagagccacccccaggtgatgcccagccagagccagccccccgtgacccccagccagagccagcccagagtgatgcccagccagagccagccccccgtgatgcccagccagagccacccccagctgacccccagccagagccagccccccgtgacccccagccagagacagccccagctgatgcccagccagagccagccccccgtgacccccagctag

SEQ ID NO: 71815 - DNA, 2463 bp, Artificial Sequence; identical to SEQ ID NO: 71814
  Description of Artificial Sequence: Synthetic coding sequence

SEQ ID NO: 71816 - DNA, 2463 bp, Artificial Sequence; identical to SEQ ID NO: 71814
  Description of Artificial Sequence: Synthetic coding sequence

SEQ ID NO: 71817 - DNA, 135 bp, Artificial Sequence
  Description of Artificial Sequence: Synthetic coding sequence
atgaagatgctgctgctgctgcactgcctgggcgtgttcctgagctgcagcggccacatccaggacgagcacccccagtaccacagcccccccgacgtggtgatccccgtgagaatcaccggcaccaccagatag

SEQ ID NO: 71818 - DNA, 273 bp, Artificial Sequence
  Description of Artificial Sequence: Synthetic coding sequence
atgaagatgctgctgctgctgcactgcctgggcgtgttcctgagctgcagcggccacatccaggacgagcacccccagtaccacagcccccccgacgtggtgatccccgtgagaatcaccggcaccaccagaggcatgaccccccccggctggctgagctacatcctgcccttcggcggccagaagcacatcatccacatcaaggtgaagaagctgctgttcagcaagcacctgcccgtgttcacctacaccgaccagggcgccatcctgtag

SEQ ID NO: 71819 - DNA, 45 bp, Artificial Sequence
  Description of Artificial Sequence: Synthetic coding sequence
atgaagatgctgctgctgctgcactgcctgggcgtgttcctgtag

SEQ ID NO: 71820 - DNA, 2463 bp, Artificial Sequence; identical to SEQ ID NO: 71814
  Description of Artificial Sequence: Synthetic coding sequence

SEQ ID NO: 71821 - DNA, 2373 bp, Artificial Sequence
  Description of Artificial Sequence: Synthetic coding sequence
atgagaagcgtgcagatcttcctgagccagtgcagactgctgctgctgctggtgcccaccatgctgctgaagagcctgggcgaggacgtgatcttccaccccgagggcgagttcgacagctacgaggtgaccatccccgagaagctgagcttcagaggcgaggtgcagggcgtggtgagccccgtgagctacctgctgcagctgaagggcaagaagcacgtgctgcacctgtggcccaagagactgctgctgcccagacacctgagagtgttcagcttcaccgagcacggcgagctgctggaggaccacccctacatccccaaggactgcaactacatgggcagcgtgaaggagagcctggacagcaaggccaccatcagcacctgcatgggcggcctgagaggcgtgttcaacatcgacgccaagcactaccagatcgagcccctgaaggccagccccagcttcgagcacgtggtgtacctgctgaagaaggagcagttcggcaaccaggtgtgcggcctgagcgacgacgagatcgagtggcagatggccccctacgagaacaaggccagactgagagacttccccggcagctacaagcaccccaagtacctggagctgatcctgctgttcgaccagagcagatacagattcgtgaacaacaacctgagccaggtgatccacgacgccatcctgctgaccggcatcatggacacctacttccaggacgtgagaatgagaatccacctgaaggccctggaggtgtggaccgacttcaacaagatcagagtgggctaccccgagctggccgaggtgctgggcagattcgtgatctacaagaagagcgtgctgaacgccagactgagcagcgactgggcccacctgtacctgcagagaaagtacaacgacgccctggcctggagcttcggcaaggtgtgcagcctggagtacgccggcagcgtgagcaccctgctggacaccaacatcctggcccccgccacctggagcgcccacgagctgggccacgccgtgggcatgagccacgacgagcagtactgccagtgcagaggcagactgaactgcatcatgggcagcggcagaaccggcttcagcaactgcagctacatcagcttcttcaagcacatcagcagcggcgccacctgcctgaacaacatccccggcctgggctacgtgctgaagagatgcggcaacaagatcgtggaggacaacgaggagtgcgactgcggcagcaccgaggagtgccagaaggacagatgctgccagagcaactgcaagctgcagcccggcgccaactgcagcatcggcctgtgctgccacgactgcagattcagacccagcggctacgtgtgcagacaggagggcaacgagtgcgacctggccgagtactgcgacggcaacagcagcagctgccccaacgacgtgtacaagcaggacggcaccccctgcaagtacgagggcagatgcttcagaaagggctgcagaagcagatacatgcagtgccagagcatcttcggccccgacgccatggaggcccccagcgagtgctacgacgccgtgaacctgatcggcgaccagttcggcaactgcgagatcaccggcatcagaaacttcaagaagtgcgagagcgccaacagcatctgcggcagactgcagtgcatcaacgtggagaccatccccgacctgcccgagcacaccaccatcatcagcacccacctgcaggccgagaacctgatgtgctggggcaccggctaccacctgagcatgaagcccatgggcatccccgacctgggcatgatcaacgacggcaccagctgcggcgagggcagagtgtgcttcaagaagaactgcgtgaacagcagcgtgctgcagttcgactgcctgcccgagaagtgcaacaccagaggcgtgtgcaacaacagaaagaactgccactgcatgtacggctgggccccccccttctgcgaggaggtgggctacggcggcagcatcgacagcggcccccccggcctgctgagaggcgccatccccagcagcatctgggtggtgagcatcatcatgttcagactgatcctgctgatcctgagcgtggtgttcgtgttcttcagacaggtgatcggcaaccacctgaagcccaagcaggagaagatgcccctgagcaaggccaagaccgagcaggaggagagcaagaccaagaccgtgcaggaggagagcaagaccaagaccggccaggaggagagcgaggccaagaccggccaggaggagagcaaggccaagaccggccaggaggagagcaaggccaacatcgagagcaagagacccaaggccaagagcgtgaagaagcagaagaagtag

SEQ ID NO: 71822 - DNA, 2346 bp, Artificial Sequence
  Description of Artificial Sequence: Synthetic coding sequence
atgagaagcgtgcagatcttcctgagccagtgcagactgctgctgctgctggtgcccaccatgctgctgaagagcctgggcgaggacgtgatcttccaccccgagggcgagttcgacagctacgaggtgaccatccccgagaagctgagcttcagaggcgaggtgcagggcgtggtgagccccgtgagctacctgctgcagctgaagggcaagaagcacgtgctgcacctgtggcccaagagactgctgctgcccagacacctgagagtgttcagcttcaccgagcacggcgagctgctggaggaccacccctacatccccaaggactgcaactacatgggcagcgtgaaggagagcctggacagcaaggccaccatcagcacctgcatgggcggcctgagaggcgtgttcaacatcgacgccaagcactaccagatcgagcccctgaaggccagccccagcttcgagcacgtggtgtacctgctgaagaaggagcagttcggcaaccaggtgtgcggcctgagcgacgacgagatcgagtggcagatggccccctacgagaacaaggccagactgagagacttccccggcagctacaagcaccccaagtacctggagctgatcctgctgttcgaccagagcagatacagattcgtgaacaacaacctgagccaggtgatccacgacgccatcctgctgaccggcatcatggacacctacttccaggacgtgagaatgagaatccacctgaaggccctggaggtgtggaccgacttcaacaagatcagagtgggctaccccgagctggccgaggtgctgggcagattcgtgatctacaagaagagcgtgctgaacgccagactgagcagcgactgggcccacctgtacctgcagagaaagtacaacgacgccctggcctggagcttcggcaaggtgtgcagcctggagtacgccggcagcgtgagcaccctgctggacaccaacatcctggcccccgccacctggagcgcccacgagctgggccacgccgtgggcatgagccacgacgagcagtactgccagtgcagaggcagactgaactgcatcatgggcagcggcagaaccggcttcagcaactgcagctacatcagcttcttcaagcacatcagcagcggcgccacctgcctgaacaacatccccggcctgggctacgtgctgaagagatgcggcaacaagatcgtggaggacaacgaggagtgcgactgcggcagcaccgaggagtgccagaaggacagatgctgccagagcaactgcaagctgcagcccggcgccaactgcagcatcggcctgtgctgccacgactgcagattcagacccagcggctacgtgtgcagacaggagggcaacgagtgcgacctggccgagtactgcgacggcaacagcagcagctgccccaacgacgtgtacaagcaggacggcaccccctgcaagtacgagggcagatgcttcagaaagggctgcagaagcagatacatgcagtgccagagcatcttcggccccgacgccatggaggcccccagcgagtgctacgacgccgtgaacctgatcggcgaccagttcggcaactgcgagatcaccggcatcagaaacttcaagaagtgcgagagcgccaacagcatctgcggcagactgcagtgcatcaacgtggagaccatccccgacctgcccgagcacaccaccatcatcagcacccacctgcaggccgagaacctgatgtgctggggcaccggctaccacctgagcatgaagcccatgggcatccccgacctgggcatgatcaacgacggcaccagctgcggcgagggcagagtgtgcttcaagaagaactgcgtgaacagcagcgtgctgcagttcgactgcctgcccgagaagtgcaacaccagaggcgtgtgcaacaacagaaagaactgccactgcatgtacggctgggccccccccttctgcgaggaggtgggctacggcggcagcatcgacagcggcccccccggcctgctgagaggcgccatccccagcagcatctgggtggtgagcatcatcatgttcagactgatcctgctgatcctgagcgtggtgttcgtgttcttcagacaggtgatcggcaaccacctgaagcccaagcaggagaagatgcccctgagcaaggccaagaccgagcaggaggagagcaagaccaagaccgtgcaggaggagagcaagaccaagaccggccaggaggagagcgaggccaagaccggccaggaggagagcaaggccaacatcgagagcaagagacccaaggccaagagcgtgaagaagcagaagaagtag

SEQ ID NO: 71823 - DNA, 540 bp, Artificial Sequence
  Description of Artificial Sequence: Synthetic coding sequence
atgggctggagacccagaagagccagaggcacccccctgctgctgctgctgctgctgctgctgctgtggcccgtgcccggcgccggcgtgctgcagggccacatccccggccagcccgtgaccccccactgggtgctggacggccagccctggagaaccgtgagcctggaggagcccgtgagcaagcccgacatgggcctggtggccctggaggccgagggccaggagctgctgctggagctggagaagaaccagctgctggcccccggctacatcgagacccactacggccccgacggccagcccgtggtgctggcccccaaccacaccgtgagatgcttccacggcctgtgggacgccccccccgagggcagaagagaggccagaagaaccagaaagtacctggagctgtacatcgtggccgaccacaccctgttcctgaccagacacagaaacctgaaccacaccaagcagagactgctggaggtggccaactacgtggaccaggtggtgaacagcgccggcgacgcccacggctag

SEQ ID NO: 71824 - DNA, 336 bp, Artificial Sequence
  Description of Artificial Sequence: Synthetic coding sequence
atgggctggagacccagaagagccagaggcacccccctgctgctgctgctgctgctgctgctgctgtggcccgtgcccggcgccggcgtgctgcagggccacatccccggccagcccgtgaccccccactgggtgctggacggccagccctggagaaccgtgagcctggaggagcccgtgagcaagcccgacatgggcctggtggccctggaggccgagggccaggagctgctgctggagctggagaagaaccagctgctggcccccggctacatcgagacccactacggccccgcccaggagtgcagagacctgtgctgcttcgcccacaactag

SEQ ID NO: 71825 - DNA, 2364 bp, Artificial Sequence
  Description of Artificial Sequence: Synthetic coding sequence
atgggctggagacccagaagagccagaggcacccccctgctgctgctgctgctgctgctgctgctgtggcccgtgcccggcgccggcgtgctgcagggccacatccccggccagcccgtgaccccccactgggtgctggacggccagccctggagaaccgtgagcctggaggagcccgtgagcaagcccgacatgggcctggtggccctggaggccgagggccaggagctgctgctggagctggagaagaaccacagactgctggcccccggctacatcgagacccactacggccccgacggccagcccgtggtgctggcccccaaccacaccgaccactgccactaccagggcagagtgagaggcttccccgacagctgggtggtgctgtgcacctgcagcggcatgagcggcctgatcaccctgagcagaaacgccagctactacctgagaccctggccccccagaggcagcaaggacttcagcacccacgagatcttcagaatggagcagctgctgacctggaagggcacctgcggccacagagaccccggcaacaaggccggcatgaccagcctgcccggcggcccccagagcagaggcagaagagaggccagaagaaccagaaagtacctggagctgtacatcgtggccgaccacaccctgttcctgaccagacacagaaacctgaaccacaccaagcagagactgctggaggtggccaactacgtggaccagctgctgagaaccctggacatccaggtggccctgaccggcctggaggtgtggaccgagagagacagaagcagagtgacccaggacgccaacgccaccctgtgggccttcctgcagtggagaagaggcctgtgggcccagagaccccacgacagcgcccagctgctgaccggcagagccttccagggcgccaccgtgggcctggcccccgtggagggcatgtgcagagccgagagcagcggcggcgtgagcaccgaccacagcgagctgcccatcggcgccgccgccaccatggcccacgagatcggccacagcctgggcctgagccacgaccccgacggctgctgcgtggaggccgccgccgagagcggcggctgcgtgatggccgccgccaccggccaccccttccccagagtgttcagcgcctgcagcagaagacagctgagagccttcttcagaaagggcggcggcgcctgcctgagcaacgcccccgaccccggcctgcccgtgccccccgccctgtgcggcaacggcttcgtggaggccggcgaggagtgcgactgcggccccggccaggagtgcagagacctgtgctgcttcgcccacaactgcagcctgagacccggcgcccagtgcgcccacggcgactgctgcgtgagatgcctgctgaagcccgccggcgccctgtgcagacaggccatgggcgactgcgacctgcccgagttctgcaccggcaccagcagccactgcccccccgacgtgtacctgctggacggcagcccctgcgccagaggcagcggctactgctgggacggcgcctgccccaccctggagcagcagtgccagcagctgtggggccccggcagccaccccgcccccgaggcctgcttccaggtggtgaacagcgccggcgacgcccacggcaactgcggccaggacagcgagggccacttcctgccctgcgccggcagagacgccctgtgcggcaagctgcagtgccagggcggcaagcccagcctgctggccccccacatggtgcccgtggacagcaccgtgcacctggacggccaggaggtgacctgcagaggcgccctggccctgcccagcgcccagctggacctgctgggcctgggcctggtggagcccggcacccagtgcggccccagaatggtgtgcaacagcaaccacaactgccactgcgcccccggctgggccccccccttctgcgacaagcccggcttcggcggcagcatggacagcggccccgtgcaggccgagaaccacgacaccttcctgctggccatgctgctgagcgtgctgctgcccctgctgcccggcgccggcctggcctggtgctgctacagactgcccggcgcccacctgcagagatgcagctggggctgcagaagagaccccgcctgcagcggccccaaggacggcccccacagagaccaccccctgggcggcgtgcaccccatggagctgggccccaccgccaccggccagccctggcccctggaccccgagaacagccacgagcccagcagccaccccgagaagcccctgcccgccgtgagccccgacccccaggccgaccaggtgcagatgcccagaagctgcctgtggtag

SEQ ID NO: 71826 - DNA, 2442 bp, Artificial Sequence
  Description of Artificial Sequence: Synthetic coding sequence
atgggctggagacccagaagagccagaggcacccccctgctgctgctgctgctgctgctgctgctgtggcccgtgcccggcgccggcgtgctgcagggccacatccccggccagcccgtgaccccccactgggtgctggacggccagccctggagaaccgtgagcctggaggagcccgtgagcaagcccgacatgggcctggtggccctggaggccgagggccaggagctgctgctggagctggagaagaaccacagactgctggcccccggctacatcgagacccactacggccccgacggccagcccgtggtgctggcccccaaccacaccgaccactgccactaccagggcagagtgagaggcttccccgacagctgggtggtgctgtgcacctgcagcggcatgagcggcctgatcaccctgagcagaaacgccagctactacctgagaccctggccccccagaggcagcaaggacttcagcacccacgagatcttcagaatggagcagctgctgacctggaagggcacctgcggccacagagaccccggcaacaaggccggcatgaccagcctgcccggcggcccccagagcagaggcagaagagaggccagaagaaccagaaagtacctggagctgtacatcgtggccgaccacaccctgttcctgaccagacacagaaacctgaaccacaccaagcagagactgctggaggtggccaactacgtggaccagctgctgagaaccctggacatccaggtggccctgaccggcctggaggtgtggaccgagagagacagaagcagagtgacccaggacgccaacgccaccctgtgggccttcctgcagtggagaagaggcctgtgggcccagagaccccacgacagcgcccagctgctgaccggcagagccttccagggcgccaccgtgggcctggcccccgtggagggcatgtgcagagccgagagcagcggcggcgtgagcaccgaccacagcgagctgcccatcggcgccgccgccaccatggcccacgagatcggccacagcctgggcctgagccacgaccccgacggctgctgcgtggaggccgccgccgagagcggcggctgcgtgatggccgccgccaccggccaccccttccccagagtgttcagcgcctgcagcagaagacagctgagagccttcttcagaaagggcggcggcgcctgcctgagcaacgcccccgaccccggcctgcccgtgccccccgccctgtgcggcaacggcttcgtggaggccggcgaggagtgcgactgcggccccggccaggagtgcagagacctgtgctgcttcgcccacaactgcagcctgagacccggcgcccagtgcgcccacggcgactgctgcgtgagatgcctgctgaagcccgccggcgccctgtgcagacaggccatgggcgactgcgacctgcccgagttctgcaccggcaccagcagccactgcccccccgacgtgtacctgctggacggcagcccctgcgccagaggcagcggctactgctgggacggcgcctgccccaccctggagcagcagtgccagcagctgtggggccccggcagccaccccgcccccgaggcctgcttccaggtggtgaacagcgccggcgacgcccacggcaactgcggccaggacagcgagggccacttcctgccctgcgccggcagagacgccctgtgcggcaagctgcagtgccagggcggcaagcccagcctgctggccccccacatggtgcccgtggacagcaccgtgcacctggacggccaggaggtgacctgcagaggcgccctggccctgcccagcgcccagctggacctgctgggcctgggcctggtggagcccggcacccagtgcggccccagaatggtgtgccagagcagaagatgcagaaagaacgccttccaggagctgcagagatgcctgaccgcctgccacagccacggcgtgtgcaacagcaaccacaactgccactgcgcccccggctgggccccccccttctgcgacaagcccggcttcggcggcagcatggacagcggccccgtgcaggccgagaaccacgacaccttcctgctggccatgctgctgagcgtgctgctgcccctgctgcccggcgccggcctggcctggtgctgctacagactgcccggcgcccacctgcagagatgcagctggggctgcagaagagaccccgcctgcagcggccccaaggacggcccccacagagaccaccccctgggcggcgtgcaccccatggagctgggccccaccgccaccggccagccctggcccctggaccccgagaacagccacgagcccagcagccaccccgagaagcccctgcccgccgtgagccccgacccccaggccgaccaggtgcagatgcccagaagctgcctgtggtag

SEQ ID NO: 71827 - DNA, 417 bp, Artificial Sequence
  Description of Artificial Sequence: Synthetic coding sequence
atgggctggagacccagaagagccagaggcacccccctgctgctgctgctgctgctgctgctgctgtggcccgtgcccggcgccggcgtgctgcagggccacatccccggccagcccgtgaccccccactgggtgctggacggccagccctggagaaccgtgagcctggaggagcccgtgagcaagcccgacatgggcctggtggccctggaggccgagggccaggagctgctgctggagctggagaagaaccacagactgctggcccccggctacatcgagacccactacggccccgacggccagcccgtggtgctggcccccaaccacaccgtgagatgcttccacggcctgtgggacgccccccccgaggtgcccccccaccacagctacccctacagcagcctgcacagctag

SEQ ID NO: 71828 - DNA, 543 bp, Artificial Sequence
  Description of Artificial Sequence: Synthetic coding sequence
atgggctggagacccagaagagccagaggcacccccctgctgctgctgctgctgctgctgctgctgtggcccgtgcccggcgccggcgtgctgcagggccacatccccggccagcccgtgaccccccactgggtgctggacggccagccctggagaaccgtgagcctggaggagcccgtgagcaagcccgacatgggcctggtggccctggaggccgagggccaggagctgctgctggagctggagaagaaccagctgctggcccccggctacatcgagacccactacggccccgacggccagcccgtggtgctggcccccaaccacaccgtgagatgcttccacggcctgtgggacgccccccccgagggcagaagagaggccagaagaaccagaaagtacctggagctgtacatcgtggccgaccacaccctgttcctgaccagacacagaaacctgaaccacaccaagcagagactgctggaggtggccaactacgtggaccaggagtgcagagacctgtgctgcttcgcccacaactag

SEQ ID NO: 71829 - DNA, 2439 bp, Artificial Sequence
  Description of Artificial Sequence: Synthetic coding sequence
atgggctggagacccagaagagccagaggcacccccctgctgctgctgctgctgctgctgctgctgtggcccgtgcccggcgccggcgtgctgcagggccacatccccggccagcccgtgaccccccactgggtgctggacggccagccctggagaaccgtgagcctggaggagcccgtgagcaagcccgacatgggcctggtggccctggaggccgagggccaggagctgctgctggagctggagaagaaccacagactgctggcccccggctacatcgagacccactacggccccgacggccagcccgtggtgctggcccccaaccacaccgaccactgccactaccagggcagagtgagaggcttccccgacagctgggtggtgctgtgcacctgcagcggcatgagcggcctgatcaccctgagcagaaacgccagctactacctgagaccctggccccccagaggcagcaaggacttcagcacccacgagatcttcagaatggagcagctgctgacctggaagggcacctgcggccacagagaccccggcaacaaggccggcatgaccagcctgcccggcggcccccagagcagaggcagaagagaggccagaagaaccagaaagtacctggagctgtacatcgtggccgaccacaccctgttcctgaccagacacagaaacctgaaccacaccaagcagagactgctggaggtggccaactacgtggaccagctgctgagaaccctggacatccaggtggccctgaccggcctggaggtgtggaccgagagagacagaagcagagtgacccaggacgccaacgccaccctgtgggccttcctgcagtggagaagaggcctgtgggcccagagaccccacgacagcgcccagctgctgaccggcagagccttccagggcgccaccgtgggcctggcccccgtggagggcatgtgcagagccgagagcagcggcggcgtgagcaccgaccacagcgagctgcccatcggcgccgccgccaccatggcccacgagatcggccacagcctgggcctgagccacgaccccgacggctgctgcgtggaggccgccgccgagagcggcggctgcgtgatggccgccgccaccggccaccccttccccagagtgttcagcgcctgcagcagaagacagctgagagccttcttcagaaagggcggcggcgcctgcctgagcaacgcccccgaccccggcctgcccgtgccccccgccctgtgcggcaacggcttcgtggaggccggcgaggagtgcgactgcggccccggccaggagtgcagagacctgtgctgcttcgcccacaactgcagcctgagacccggcgcccagtgcgcccacggcgactgctgcgtgagatgcctgctgaagcccgccggcgccctgtgcagacaggccatgggcgactgcgacctgcccgagttctgcaccggcaccagcagccactgcccccccgacgtgtacctgctggacggcagcccctgcgccagaggcagcggctactgctgggacggcgcctgccccaccctggagcagcagtgccagcagctgtggggccccggcagccaccccgcccccgaggcctgcttccaggtggtgaacagcgccggcgacgcccacggcaactgcggccaggacagcgagggccacttcctgccctgcgccggcagagacgccctgtgcggcaagctgcagtgccagggcggcaagcccagcctgctggccccccacatggtgcccgtggacagcaccgtgcacctggacggccaggaggtgacctgcagaggcgccctggccctgcccagcgcccagctggacctgctgggcctgggcctggtggagcccggcacccagtgcggccccagaatggtgtgccagagcagaagatgcagaaagaacgccttccaggagctgcagagatgcctgaccgcctgccacagccacggcgtgtgcaacagcaaccacaactgccactgcgcccccggctgggccccccccttctgcgacaagcccggcttcggcggcagcatggacagcggccccgtgcaggccgagaaccacgacaccttcctgctggccatgctgctgagcgtgctgctgcccctgctgcccggcgccggcctggcctggtgctgctacagactgcccggcgcccacctgcagagatgcagctggggctgcagaagagaccccgcctgcagcggccccaaggacggcccccacagagaccaccccctgggcggcgtgcaccccatggagctgggccccaccgccaccggccagccctggcccctggaccccgagaacagccacgagcccagcagccaccccgagaagcccctgcccgccgtgagccccgacccccaggaccaggtgcagatgcccagaagctgcctgtggtag

SEQ ID NO: 71830 - DNA, 456 bp, Artificial Sequence
  Description of Artificial Sequence: Synthetic coding sequence
atgggctggagacccagaagagccagaggcacccccctgctgctgctgctgctgctgctgctgctgtggcccgtgcccggcgccggcgtgctgcagggccacatccccggccagcccgtgaccccccactgggtgctggacggccagccctggagaaccgtgagcctggaggagcccgtgagcaagcccgacatgggcctggtggccctggaggccgagggccaggagctgctgctggagctggagaagaaccaggacgccctgtgcggcaagctgcagtgccagggcggcaagcccagcctgctggccccccacatggtgcccgtggacagcaccgtgcacctggacggccaggaggtgacctgcagaggcgccctggccctgcccagcgcccagctggacctgctgggcctgggcctggtggagcccggcacccagtgcggccccagaatgtag

SEQ ID NO: 71831 - DNA, 2079 bp, Artificial Sequence
  Description of Artificial Sequence: Synthetic coding sequence
atgggctggagacccagaagagccagaggcacccccctgctgctgctgctgctgctgctgctgctgtggcccgtgcccggcgccggcgtgctgcagggccacatccccggccagcccgtgaccccccactgggtgctggacggccagccctggagaaccgtgagcctggaggagcccgtgagcaagcccgacatgggcctggtggccctggaggccgagggccaggagctgctgctggagctggagaagaaccacagactgctggcccccggctacatcgagacccactacggccccgacggccagcccgtggtgctggcccccaaccacaccgaccactgccactaccagggcagagtgagaggcttccccgacagctgggtggtgctgtgcacctgcagcggcatgagcggcctgatcaccctgagcagaaacgccagctactacctgagaccctggccccccagaggcagcaaggacttcagcacccacgagatcttcagaatggagcagctgctgacctggaagggcacctgcggccacagagaccccggcaacaaggccggcatgaccagcctgcccggcggcccccagagcagaggcagaagagaggccagaagaaccagaaagtacctggagctgtacatcgtggccgaccacaccctgttcctgaccagacacagaaacctgaaccacaccaagcagagactgctggaggtggccaactacgtggaccagctgctgagaaccctggacatccaggtggccctgaccggcctggaggtgtggaccgagagagacagaagcagaagacagctgagagccttcttcagaaagggcggcggcgcctgcctgagcaacgcccccgaccccggcctgcccgtgccccccgccctgtgcggcaacggcttcgtggaggccggcgaggagtgcgactgcggccccggccaggagtgcagagacctgtgctgcttcgcccacaactgcagcctgagacccggcgcccagtgcgcccacggcgactgctgcgtgagatgcctgctgaagcccgccggcgccctgtgcagacaggccatgggcgactgcgacctgcccgagttctgcaccggcaccagcagccactgcccccccgacgtgtacctgctggacggcagcccctgcgccagaggcagcggctactgctgggacggcgcctgccccaccctggagcagcagtgccagcagctgtggggccccggcagccaccccgcccccgaggcctgcttccaggtggtgaacagcgccggcgacgcccacggcaactgcggccaggacagcgagggccacttcctgccctgcgccggcagagacgccctgtgcggcaagctgcagtgccagggcggcaagcccagcctgctggccccccacatggtgcccgtggacagcaccgtgcacctggacggccaggaggtgacctgcagaggcgccctggccctgcccagcgcccagctggacctgctgggcctgggcctggtggagcccggcacccagtgcggccccagaatggtgtgccagagcagaagatgcagaaagaacgccttccaggagctgcagagatgcctgaccgcctgccacagccacggcgtgtgcaacagcaaccacaactgccactgcgcccccggctgggccccccccttctgcgacaagcccggcttcggcggcagcatggacagcggccccgtgcaggccgagaaccacgacaccttcctgctggccatgctgctgagcgtgctgctgcccctgctgcccggcgccggcctggcctggtgctgctacagactgcccggcgcccacctgcagagatgcagctggggctgcagaagagaccccgcctgcagcggccccaaggacggcccccacagagaccaccccctgggcggcgtgcaccccatggagctgggccccaccgccaccggccagccctggcccctggaccccgagaacagccacgagcccagcagccaccccgagaagcccctgcccgccgtgagccccgacccccaggaccaggtgcagatgcccagaagctgcctgtggtag

SEQ ID NO: 71832 - DNA, 522 bp, Artificial Sequence
  Description of Artificial Sequence: Synthetic coding sequence
atgggctggagacccagaagagccagaggcacccccctgctgctgctgctgctgctgctgctgctgtggcccgtgcccggcgccggcgtgctgcagggccacatccccggccagcccgtgaccccccactgggtgctggacggccagccctggagaaccgtgagcctggaggagcccgtgagcaagcccgacatgggcctggtggccctggaggccgagggccaggagctgctgctggagctggagaagaaccacagactgctggcccccggctacatcgagacccactacggccccgacggccagcccgtggtgctggcccccaaccacaccgtgagatgcttccacggcctgtgggacgccccccccgaggaccactgccactaccagggcagagtgagaggcttccccgacagctgggtggtgctgtgcacctgcagcggcatgagagccggcgagaagagagccggccccggcagcacctggaactgcaccctgtggcagaccaccccctgcagctag

SEQ ID NO: 71833 - DNA, 291 bp, Artificial Sequence
  Description of Artificial Sequence: Synthetic coding sequence
atgggctggagacccagaagagccagaggcacccccctgctgctgctgctgctgctgctgctgctgtggcccgtgcccggcgccggcgtgctgcagggccacatccccggccagcccgtgaccccccactgggtgctggacggccagccctggagaaccgtgagcctggaggagcccgtgagcaagcccgacatgggcctggtggccctggaggccgagggccaggagctgctgctggagctggagaagaaccagttcgccatcgccaccatcaccgccaccgtgctgtag

SEQ ID NO: 71834 - DNA, 2265 bp, Artificial Sequence
  Description of Artificial Sequence: Synthetic coding sequence
atgctgcccggctgcatcttcctgatgatcctgctgatcccccaggtgaaggagaagttcatcctgggcgtggagggccagcagctggtgagacccaagaagctgcccctgatccagaagagagacaccggccacacccacgacgacgacatcctgaagacctacgaggaggagctgctgtacgagatcaagctgaacagaaagaccctggtgctgcacctgctgagaagcagagagttcctgggcagcaactacagcgagaccttctacagcatgaagggcgaggccttcaccagacacccccagatcatggaccactgcttctaccagggcagcatcgtgcacgagtacgacagcgccgccagcatcagcacctgcaacggcctgagaggcttcttcagaatcaacgaccagagatacctgatcgagcccgtgaagtacagcgacgagggcgagcacctggtgttcaagtacaacctgagagtgccctacggcgccaactacagctgcaccgagctgaacttcaccagaaagaccgtgcccggcgacaacgagagcgaggaggacagcaagatcaagggcatccacgacgagaagtacgtggagctgttcatcgtggccgacgacaccgtgtacagaagaaacggccacccccacaacaagctgagaaacagaatctggggcatggtgaacttcgtgaacatgatctacaagaccctgaacatccacgtgaccctggtgggcatcgagatctggacccacgaggacaagatcgagctgtacagcaacatcgagaccaccctgctgagattcagcttctggcaggagaagatcctgaagaccagaaaggacttcgaccacgtggtgctgctgagcggcaagtggctgtacagccacgtgcagggcatcagctaccccggcggcatgtgcctgccctactacagcaccagcatcatcaaggacctgctgcccgacaccaacatcatcgccaacagaatggcccaccagctgggccacaacctgggcatgcagcacgacgagttcccctgcacctgccccagcggcaagtgcgtgatggacagcgacggcagcatccccgccctgaagttcagcaagtgcagccagaaccagtaccaccagtacctgaaggactacaagcccacctgcatgctgaacatccccttcccctacaacttccacgacttccagttctgcggcaacaagaagctggacgagggcgaggagtgcgactgcggccccgcccaggagtgcaccaacccctgctgcgacgcccacacctgcgtgctgaagcccggcttcacctgcgccgagggcgagtgctgcgagagctgccagatcaagaaggccggcagcatctgcagacccgccaaggacgagtgcgacttccccgagatgtgcaccggccacagccccgcctgccccaaggaccagttcagagtgaacggcttcccctgcaagaacagcgagggctactgcttcatgggcaagtgccccaccagagaggaccagtgcagcgagctgttcgacgacgaggccatcgagagccacgacatctgctacaagatgaacaccaagggcaacaagttcggctactgcaagaacaaggagaacagattcctgccctgcgaggagaaggacgtgagatgcggcaagatctactgcaccggcggcgagctgagcagcctgctgggcgaggacaagacctaccacctgaaggacccccagaagaacgccaccgtgaagtgcaagaccatcttcctgtaccacgacagcaccgacatcggcctggtggccagcggcaccaagtgcggcgagggcatggtgtgcaacaacggcgagtgcctgaacatggagaaggtgtacatcagcaccaactgccccagccagtgcaacgagaaccccgtggacggccacggcctgcagtgccactgcgaggagggccaggcccccgtggcctgcgaggagaccctgcacgtgaccaacatcaccatcctggtggtggtgctggtgctggtgatcgtgggcatcggcgtgctgatcctgctggtgagatacagaaagtgcatcaagctgaagcaggtgcagagcccccccaccgagaccctgggcgtggagaacaagggctacttcggcgacgagcagcagatcagaaccgagcccatcctgcccgagatccacttcctgaacaagcccgccagcaaggacagcagaggcatcgccgaccccaaccagagcgccaagtag

SEQ ID NO: 71835 - DNA, 1656 bp, Artificial Sequence
  Description of Artificial Sequence: Synthetic coding sequence
gtgtgccccagaagctacttcctggagggcagaggcagctacagcttcctgagcctgttcagcaccagccccgccccctacagaagaaacggccacccccacaacaagctgagaaacagaatctggggcatggtgaacttcgtgaacatgatctacaagaccctgaacatccacgtgaccctggtgggcatcgagatctggacccacgaggacaagatcgagctgtacagcaacatcgagaccaccctgctgagattcagcttctggcaggagaagatcctgaagaccagaaaggacttcgaccacgtggtgctgctgagcggcaagtggctgtacagccacgtgcagggcatcagctaccccggcggcatgtgcctgccctactacagcaccagcatcatcaaggacctgctgcccgacaccaacatcatcgccaacagaatggcccaccagctgggccacaacctgggcatgcagcacgacgagttcccctgcacctgccccagcggcaagtgcgtgatggacagcgacggcagcatccccgccctgaagttcagcaagtgcagccagaaccagtaccaccagtacctgaaggactacaagcccacctgcatgctgaacatccccttcccctacaacttccacgacttccagttctgcggcaacaagaagctggacgagggcgaggagtgcgactgcggccccgcccaggagtgcaccaacccctgctgcgacgcccacacctgcgtgctgaagcccggcttcacctgcgccgagggcgagtgctgcgagagctgccagatcaagaaggccggcagcatctgcagacccgccaaggacgagtgcgacttccccgagatgtgcaccggccacagccccgcctgccccaaggaccagttcagagtgaacggcttcccctgcaagaacagcgagggctactgcttcatgggcaagtgccccaccagagaggaccagtgcagcgagctgttcgacgacgaggccatcgagagccacgacatctgctacaagatgaacaccaagggcaacaagttcggctactgcaagaacaaggagaacagattcctgccctgcgaggagaaggacgtgagatgcggcaagatctactgcaccggcggcgagctgagcagcctgctgggcgaggacaagacctaccacctgaaggacccccagaagaacgccaccgtgaagtgcaagaccatcttcctgtaccacgacagcaccgacatcggcctggtggccagcggcaccaagtgcggcgagggcatggtgtgcaacaacggcgagtgcctgaacatggagaaggtgtacatcagcaccaactgccccagccagtgcaacgagaaccccgtggacggccacggcctgcagtgccactgcgaggagggccaggcccccgtggcctgcgaggagaccctgcacgtgaccaacatcaccatcctggtggtggtgctggtgctggtgatcgtgggcatcggcgtgctgatcctgctggtgagatacagaaagtgcatcaagctgaagcaggtgcagagcccccccaccgagaccctgggcgtggagaacaagggctacttcggcgacgagcagcagatcagaaccgagcccatcctgcccgagatccacttcctgaactag

SEQ ID NO: 71836 - DNA, 2475 bp, Artificial Sequence
  Description of Artificial Sequence: Synthetic coding sequence
atgagaggcctgggcctgtggctgctgggcgccatgatgctgcccgccatcgcccccagcagaccctgggccctgatggagcagtacgaggtggtgctgccctggagactgcccggccccagagtgagaagagccctgcccagccacctgggcctgcaccccgagagagtgagctacgtgctgggcgccaccggccacaacttcaccctgcacctgagaaagaacagagacctgctgggcagcggctacaccgagacctacaccgccgccaacggcagcgaggtgaccgagcagcccagaggccaggaccactgcttctaccagggccacgtggagggctaccccgacagcgccgccagcctgagcacctgcgccggcctgagaggcttcttccaggtgggcagcgacctgcacctgatcgagcccctggacgagggcggcgagggcggcagacacgccgtgtaccaggccgagcacctgctgcagaccgccggcacctgcggcgtgagcgacgacagcctgggcagcctgctgggccccagaaccgccgccgtgttcagacccagacccggcgacagcctgcccagcagagagaccagatacgtggagctgtacgtggtggtggacaacgccgagttccagatgctgggcagcgaggccgccgtgagacacagagtgctggaggtggtgaaccacgtggacaagctgtaccagaagctgaacttcagagtggtgctggtgggcctggagatctggaacagccaggacagattccacgtgagccccgaccccagcgtgaccctggagaacctgctgacctggcaggccagacagagaaccagaagacacctgcacgacaacgtgcagctgatcaccggcgtggacttcaccggcaccaccgtgggcttcgccagagtgagcgccatgtgcagccacagcagcggcgccgtgaaccaggaccacagcaagaaccccgtgggcgtggcctgcaccatggcccacgagatgggccacaacctgggcatggaccacgacgagaacgtgcagggctgcagatgccaggagagattcgaggccggcagatgcatcatggccggcagcatcggcagcagcttccccagaatgttcagcgactgcagccaggcctacctggagagcttcctggagagaccccagagcgtgtgcctggccaacgcccccgacctgagccacctggtgggcggccccgtgtgcggcaacctgttcgtggagagaggcgagcagtgcgactgcggcccccccgaggactgcagaaacagatgctgcaacagcaccacctgccagctggccgagggcgcccagtgcgcccacggcacctgctgccaggagtgcaaggtgaagcccgccggcgagctgtgcagacccaagaaggacatgtgcgacctggaggagttctgcgacggcagacaccccgagtgccccgaggacgccttccaggagaacggcaccccctgcagcggcggctactgctacaacggcgcctgccccaccctggcccagcagtgccaggccttctggggccccggcggccaggccgccgaggagagctgcttcagctacgacatcctgcccggctgcaaggccagcagatacagagccgacatgtgcggcgtgctgcagtgcaagggcggccagcagcccctgggcagagccatctgcatcgtggacgtgtgccacgccctgaccaccgaggacggcaccgcctacgagcccgtgcccgagggcaccagatgcggccccgagaaggtgtgctggaagggcagatgccaggacctgcacgtgtacagaagcagcaactgcagcgcccagtgccacaaccacggcgtgtgcaaccacaagcaggagtgccactgccacgccggctgggcccccccccactgcgccaagctgctgaccgaggtgcacgccgccagcggcagcctgcccgtgttcgtggtggtggtgctggtgctgctggccgtggtgctggtgaccctggccggcatcatcgtgtacagaaaggccagaagcagaatcctgagcagaaacgtggcccccaagaccaccatgggcagaagcaaccccctgttccaccaggccgccagcagagtgcccgccaagggcggcgcccccgcccccagcagaggcccccaggagctggtgcccaccacccaccccggccagcccgccagacaccccgccagcagcgtggccctgaagagacccccccccgccccccccgtgaccgtgagcagcccccccttccccgtgcccgtgtacaccagacaggcccccaagcaggtgatcaagcccaccttcgccccccccgtgccccccgtgaagcccggcgccggcgccgccaaccccggccccgccgagggcgccgtgggccccaaggtggccctgaagccccccatccagagaaagcagggcgccggcgcccccaccgccccctag

SEQ ID NO: 71837 - DNA, 2202 bp, Artificial Sequence
  Description of Artificial Sequence: Synthetic coding sequence
atgagaggcctgggcctgtggctgctgggcgccatgatgctgcccggccccgcccccagagagggcgagctgagaccctggggccacagagcccagctgcaccccccccccgccgaggagcagggccccgccggcctgagactgcacagagacctgtacggctgccagtggctgagaggcgacggcgccgccagcagagccggccccctgctgctgcccggccccagaagaggcgtgcccggcctgagcagacagccccagcacctgtgcagaccccaggtgggcagcgacctgcacctgatcgagcccctggacgagggcggcgagggcggcagacacgccgtgtaccaggccgagcacctgctgcagaccgccggcacctgcggcgtgagcgacgacagcctgggcagcctgctgggccccagaaccgccgccgtgttcagacccagacccggcgacagcctgcccagcagagagaccagatacgtggagctgtacgtggtggtggacaacgccgagttccagatgctgggcagcgaggccgccgtgagacacagagtgctggaggtggtgaaccacgtggacaagctgtaccagaagctgaacttcagagtggtgctggtgggcctggagatctggaacagccaggacagattccacgtgagccccgaccccagcgtgaccctggagaacctgctgacctggcaggccagacagagaaccagaagacacctgcacgacaacgtgcagctgatcaccggcgtggacttcaccggcaccaccgtgggcttcgccagagtgagcgccatgtgcagccacagcagcggcgccgtgaaccaggaccacagcaagaaccccgtgggcgtggcctgcaccatggcccacgagatgggccacaacctgggcatggaccacgacgagaacgtgcagggctgcagatgccaggagagattcgaggccggcagatgcatcatggccggcagcatcggcagcagcttccccagaatgttcagcgactgcagccaggcctacctggagagcttcctggagagaccccagagcgtgtgcctggccaacgcccccgacctgagccacctggtgggcggccccgtgtgcggcaacctgttcgtggagagaggcgagcagtgcgactgcggcccccccgaggactgcagaaacagatgctgcaacagcaccacctgccagctggccgagggcgcccagtgcgcccacggcacctgctgccaggagtgcaaggtgaagcccgccggcgagctgtgcagacccaagaaggacatgtgcgacctggaggagttctgcgacggcagacaccccgagtgccccgaggacgccttccaggagaacggcaccccctgcagcggcggctactgctacaacggcgcctgccccaccctggcccagcagtgccaggccttctggggccccggcggccaggccgccgaggagagctgcttcagctacgacatcctgcccggctgcaaggccagcagatacagagccgacatgtgcggcgtgctgcagtgcaagggcggccagcagcccctgggcagagccatctgcatcgtggacgtgtgccacgccctgaccaccgaggacggcaccgcctacgagcccgtgcccgagggcaccagatgcggccccgagaaggtgtgcaaccacaagcaggagtgccactgccacgccggctgggcccccccccactgcgccaagctgctgaccgaggtgcacgccgccagcggcagcctgcccgtgttcgtggtggtggtgctggtgctgctggccgtggtgctggtgaccctggccggcatcatcgtgtacagaaaggccagaagcagaatcctgagcagaaacgtggcccccaagaccaccatgggcagaagcaaccccctgttccaccaggccgccagcagagtgcccgccaagggcggcgcccccgcccccagcagaggcccccaggagctggtgcccaccacccaccccggccagcccgccagacaccccgccagcagcgtggccctgaagagacccccccccgccccccccgtgaccgtgagcagcccccccttccccgtgcccgtgtacaccagacaggcccccaagcagggcgccgtgggccccaaggtggccctgaagccccccatccagagaaagcagggcgccggcgcccccaccgccccctag

SEQ ID NO: 71838 - DNA, 2229 bp, Artificial Sequence
  Description of Artificial Sequence: Synthetic coding sequence
atgagaggcctgggcctgtggctgctgggcgccatgatgctgcccgccatcgcccccagcagaccctgggccctgatggagcagtacgaggtggtgctgccctggagactgcccggccccagagtgagaagagccctgcccagccacctgggcctgcaccccgagagagtgagctacgtgctgggcgccaccggccacaacttcaccctgcacctgagaaagaacagagacctgctgggcagcggctacaccgagacctacaccgccgccaacggcagcgaggtgaccgagcagcccagaggccaggaccactgcttctaccagggccacgtggagggctaccccgacagcgccgccagcctgagcacctgcgccggcctgagaggcttcttccaggtgggcagcgacctgcacctgatcgagcccctggacgagggcggcgagggcggcagacacgccgtgtaccaggccgagcacctgctgcagaccgccggcacctgcggcgtgagcgacgacagcctgggcagcctgctgggccccagaaccgccgccgtgttcagacccagacccggcgacagcctgcccagcagagagaccagatacgtggagctgtacgtggtggtggacaacgccgagttccagatgctgggcagcgaggccgccgtgagacacagagtgctggaggtggtgaaccacgtggacaagctgtaccagaagctgaacttcagagtggtgctggtgggcctggagatctggaacagccaggacagattccacgtgagccccgaccccagcgtgaccctggagaacctgctgacctggcaggccagacagagaaccagaagacacctgcacgacaacgtgcagctgatcaccggcgtggacttcaccggcaccaccgtgggcttcgccagagtgagcgccatgtgcagccacagcagcggcgccgtgaaccaggaccacagcaagaaccccgtgggcgtggcctgcaccatggcccacgagatgggccacaacctgggcatggaccacgacgagaacgtgcagggctgcagatgccaggagagattcgaggccggcagatgcatcatggccggcagcatcggcagcagcttccccagaatgttcagcgactgcagccaggcctacctggagagcttcctggagagaccccagagcgtgtgcctggccaacgcccccgacctgagccacctggtgggcggccccgtgtgcggcaacctgttcgtggagagaggcgagcagtgcgactgcggcccccccgaggactgcagaaacagatgctgcaacagcaccacctgccagctggccgagggcgcccagtgcgcccacggcacctgctgccaggagtgcaaggtgaagcccgccggcgagctgtgcagacccaagaaggacatgtgcgacctggaggagttctgcgacggcagacaccccgagtgccccgaggacgccttccaggagaacggcaccccctgcagcggcggctactgctacaacggcgcctgccccaccctggcccagcagtgccaggccttctggggccccggcggccaggccgccgaggagagctgcttcagctacgacatcctgcccggctgcaaggccagcagatacagagccgacatgtgcggcgtgctgcagtgcaagggcggccagcagcccctgggcagagccatctgcatcgtggacgtgtgccacgccctgaccaccgaggacggcaccgcctacgagcccgtgcccgagggcaccagatgcggccccgagaaggtgtgctggaagggcagatgccaggacctgcacgtgtacagaagcagcaactgcagcgcccagtgccacaaccacggcgtgtgcaaccacaagcaggagtgccactgccacgccggctgggcccccccccactgcgccaagctgctgaccgaggtgcacgccggctgccagcccagagccggccagggcagaggcagcagccccatccagggcccccccagagccggcccccaccacccccccggccccgccagacccacccccggcctgctgggcggcagcgaggaggccgccccctgcagcagcggccactgcgtgcagcccaccctgcccagcagctgcctgcaccccgccggcaccaaggccggccaccaggccaacgtgagaacccccagcgcccccagccagaccagaggctggtgcggccagccctggagcagctag

SEQ ID NO: 71839 - DNA, 2460 bp, Artificial Sequence
  Description of Artificial Sequence: Synthetic coding sequence
atgggcagcggcgccagattccccagcggcaccctgagagtgagatggctgctgctgctgggcctggtgggccccgtgctgggcgccgccagacccggcttccagcagaccagccacctgagcagctacgagatcatcaccccctggagactgaccagagagagaagagaggcccccagaccctacagcaagcaggtgagctacgtgatccaggccgagggcaaggagcacatcatccacctggagagaaacaaggacctgctgcccgaggacttcgtggtgtacacctacaacaaggagggcaccctgatcaccgaccaccccaacatccagaaccactgccactacagaggctacgtggagggcgtgcacaacagcagcatcgccctgagcgactgcttcggcctgagaggcctgctgcacctggagaacgccagctacggcatcgagcccctgcagaacagcagccacttcgagcacatcatctacagaatggacgacgtgtacaaggagcccctgaagtgcggcgtgagcaacaaggacatcgagaaggagaccgccaaggacgaggaggaggagccccccagcatgacccagctgctgagaagaagaagagccgtgctgccccagaccagatacgtggagctgttcatcgtggtggacaaggagagatacgacatgatgggcagaaaccagaccgccgtgagagaggagatgatcctgctggccaactacctggacagcatgtacatcatgctgaacatcagaatcgtgctggtgggcctggagatctggaccaacggcaacctgatcaacatcgtgggcggcgccggcgacgtgctgggcaacttcgtgcagtggagagagaagttcctgatcaccagaagaagacacgacagcgcccagctggtgctgaagaagggcttcggcggcaccgccggcatggccttcgtgggcaccgtgtgcagcagaagccacgccggcggcatcaacgtgttcggccagatcaccgtggagaccttcgccagcatcgtggcccacgagctgggccacaacctgggcatgaaccacgacgacggcagagactgcagctgcggcgccaagagctgcatcatgaacagcggcgccagcggcagcagaaacttcagcagctgcagcgccgaggacttcgagaagctgaccctgaacaagggcggcaactgcctgctgaacatccccaagcccgacgaggcctacagcgcccccagctgcggcaacaagctggtggacgccggcgaggagtgcgactgcggcacccccaaggagtgcgagctggacccctgctgcgagggcagcacctgcaagctgaagagcttcgccgagtgcgcctacggcgactgctgcaaggactgcagattcctgcccggcggcaccctgtgcagaggcaagaccagcgagtgcgacgtgcccgagtactgcaacggcagcagccagttctgccagcccgacgtgttcatccagaacggctacccctgccagaacaacaaggcctactgctacaacggcatgtgccagtactacgacgcccagtgccaggtgatcttcggcagcaaggccaaggccgcccccaaggactgcttcatcgaggtgaacagcaagggcgacagattcggcaactgcggcttcagcggcaacgagtacaagaagtgcgccaccggcaacgccctgtgcggcaagctgcagtgcgagaacgtgcaggagatccccgtgttcggcatcgtgcccgccatcatccagacccccagcagaggcaccaagtgctggggcgtggacttccagctgggcagcgacgtgcccgaccccggcatggtgaacgagggcaccaagtgcggcgccggcaagatctgcagaaacttccagtgcgtggacgccagcgtgctgaactacgactgcgacgtgcagaagaagtgccacggccacggcgtgtgcaacagcaacaagaactgccactgcgagaacggctgggccccccccaactgcgagaccaagggctacggcggcagcgtggacagcggccccacctacaacgagatgaacaccgccctgagagacggcctgctggtgttcttcttcctgatcgtgcccctgatcgtgtgcgccatcttcatcttcatcaagagagaccagctgtggagaagctacttcagaaagaagagaagccagacctacgagagcgacggcaagaaccaggccaaccccagcagacagcccggcagcgtgcccagacacgtgagccccgtgaccccccccagagaggtgcccatctacgccaacagattcgccgtgcccacctacgccgccaagcagccccagcagttccccagcagacccccccccccccagcccaaggtgagcagccagggcaacctgatccccgccagacccgcccccgccccccccctgtacagcagcctgacctag

SEQ ID NO: 71840 - DNA, 2904 bp, Artificial Sequence
  Description of Artificial Sequence: Synthetic coding sequence
atgcagagagccgtgcccgagggcttcggcagaagaaagctgggcagcgacatgggcaacgccgagagagcccccggcagcagaagcttcggccccgtgcccaccctgctgctgctggccgccgccctgctggccgtgagcgacgccctgggcagacccagcgaggaggacgaggagctggtggtgcccgagctggagagagcccccggccacggcaccaccagactgagactgcacgccttcgaccagcagctggacctggagctgagacccgacagcagcttcctggcccccggcttcaccctgcagaacgtgggcagaaagagcggcagcgagacccccctgcccgagaccgacctggcccactgcttctacagcggcaccgtgaacggcgaccccagcagcgccgccgccctgagcctgtgcgagggcgtgagaggcgccttctacctgctgggcgaggcctacttcatccagcccctgcccgccgccagcgagagactggccaccgccgcccccggcgagaagccccccgcccccctgcagttccacctgctgagaagaaacagacagggcgacgtgggcggcacctgcggcgtggtggacgacgagcccagacccaccggcaaggccgagaccgaggacgaggacgagggcaccgagggcgaggacgagggcgcccagtggagcccccaggaccccgccctgcagggcgtgggccagcccaccggcaccggcagcatcagaaagaagagattcgtgagcagccacagatacgtggagaccatgctggtggccgaccagagcatggccgagttccacggcagcggcctgaagcactacctgctgaccctgttcagcgtggccgccagactgtacaagcaccccagcatcagaaacagcgtgagcctggtggtggtgaagatcctggtgatccacgacgagcagaagggccccgaggtgaccagcaacgccgccctgaccctgagaaacttctgcaactggcagaagcagcacaacccccccagcgacagagacgccgagcactacgacaccgccatcctgttcaccagacaggacctgtgcggcagccagacctgcgacaccctgggcatggccgacgtgggcaccgtgtgcgaccccagcagaagctgcagcgtgatcgaggacgacggcctgcaggccgccttcaccaccgcccacgagctgggccacgtgttcaacatgccccacgacgacgccaagcagtgcgccagcctgaacggcgtgaaccaggacagccacatgatggccagcatgctgagcaacctggaccacagccagccctggagcccctgcagcgcctacatgatcaccagcttcctggacaacggccacggcgagtgcctgatggacaagccccagaaccccatccagctgcccggcgacctgcccggcaccagctacgacgccaacagacagtgccagttcaccttcggcgaggacagcaagcactgccccgacgccgccagcacctgcagcaccctgtggtgcaccggcaccagcggcggcgtgctggtgtgccagaccaagcacttcccctgggccgacggcaccagctgcggcgagggcaagtggtgcatcaacggcaagtgcgtgaacaagaccgacagaaagcacttcgacacccccttccacggcagctggggcatgtggggcccctggggcgactgcagcagaacctgcggcggcggcgtgcagtacaccatgagagagtgcgacaaccccgtgcccaagaacggcggcaagtactgcgagggcaagagagtgagatacagaagctgcaacctggaggactgccccgacaacaacggcaagaccttcagagaggagcagtgcgaggcccacaacgagttcagcaaggccagcttcggcagcggccccgccgtggagtggatccccaagtacgccggcgtgagccccaaggacagatgcaagctgatctgccaggccaagggcatcggctacttcttcgtgctgcagcccaaggtggtggacggcaccccctgcagccccgacagcaccagcgtgtgcgtgcagggccagtgcgtgaaggccggctgcgacagaatcatcgacagcaagaagaagttcgacaagtgcggcgtgtgcggcggcaacggcagcacctgcaagaagatcagcggcagcgtgaccagcgccaagcccggctaccacgacatcatcaccatccccaccggcgccaccaacatcgaggtgaagcagagaaaccagagaggcagcagaaacaacggcagcttcctggccatcaaggccgccgacggcacctacatcctgaacggcgactacaccctgagcaccctggagcaggacatcatgtacaagggcgtggtgctgagatacagcggcagcagcgccgccctggagagaatcagaagcttcagccccctgaaggagcccctgaccatccaggtgctgaccgtgggcaacgccctgagacccaagatcaagtacacctacttcgtgaagaagaagaaggagagcttcaacgccatccccaccttcagcgcctgggtgatcgaggagtggggcgagtgcagcaagagctgcgagctgggctggcagagaagactggtggagtgcagagacatcaacggccagcccgccagcgagtgcgccaaggaggtgaagcccgccagcaccagaccctgcgccgaccacccctgcccccagtggcagctgggcgagtggagcagctgcagcaagacctgcggcaagggctacaagaagagaagcctgaagtgcctgagccacgacggcggcgtgctgagccacgagagctgcgaccccctgaagaagcccaagcacttcatcgacttctgcaccatggccgagtgcagctag

SEQ ID NO: 71841 - DNA, 3312 bp, Artificial Sequence
  Description of Artificial Sequence: Synthetic coding sequence
atggcccccgcctgccagatcctgagatgggccctggccctgggcctgggcctgatgttcgaggtgacccacgccttcagaagccaggacgagttcctgagcagcctggagagctacgagatcgccttccccaccagagtggaccacaacggcgccctgctggccttcagcccccccccccccagaagacagagaagaggcaccggcgccaccgccgagagcagactgttctacaaggtggccagccccagcacccacttcctgctgaacctgaccagaagcagcagactgctggccggccacgtgagcgtggagtactggaccagagagggcctggcctggcagagagccgccagaccccactgcctgtacgccggccacctgcagggccaggccagcaccagccacgtggccatcagcacctgcggcggcctgcacggcctgatcgtggccgacgaggaggagtacctgatcgagcccctgcacggcggccccaagggcagcagaagccccgaggagagcggcccccacgtggtgtacaagagaagcagcctgagacacccccacctggacaccgcctgcggcgtgagagacgagaagccctggaagggcagaccctggtggctgagaaccctgaagcccccccccgccagacccctgggcaacgagaccgagagaggccagcccggcctgaagagaagcgtgagcagagagagatacgtggagaccctggtggtggccgacaagatgatggtggcctaccacggcagaagagacgtggagcagtacgtgctggccatcatgaacatcgtggccaagctgttccaggacagcagcctgggcagcaccgtgaacatcctggtgaccagactgatcctgctgaccgaggaccagcccaccctggagatcacccaccacgccggcaagagcctggacagcttctgcaagtggcagaagagcatcgtgaaccacagcggccacggcaacgccatccccgagaacggcgtggccaaccacgacaccgccgtgctgatcaccagatacgacatctgcatctacaagaacaagccctgcggcaccctgggcctggcccccgtgggcggcatgtgcgagagagagagaagctgcagcgtgaacgaggacatcggcctggccaccgccttcaccatcgcccacgagatcggccacaccttcggcatgaaccacgacggcgtgggcaacagctgcggcgccagaggccaggaccccgccaagctgatggccgcccacatcaccatgaagaccaaccccttcgtgtggagcagctgcagcagagactacatcaccagcttcctggacagcggcctgggcctgtgcctgaacaacagaccccccagacaggacttcgtgtaccccaccgtggcccccggccaggcctacgacgccgacgagcagtgcagattccagcacggcgtgaagagcagacagtgcaagtacggcgaggtgtgcagcgagctgtggtgcctgagcaagagcaacagatgcatcaccaacagcatccccgccgccgagggcaccctgtgccagacccacaccatcgacaagggctggtgctacaagagagtgtgcgtgcccttcggcagcagacccgagggcgtggacggcgcctggggcccctggaccccctggggcgactgcagcagaacctgcggcggcggcgtgagcagcagcagcagacactgcgacagccccagacccaccatcggcggcaagtactgcctgggcgagagaagaagacacagaagctgcaacaccgacgactgcccccccggcagccaggacttcagagaggtgcagtgcagcgagttcgacagcatccccttcagaggcaagttctacaagtggaagacctacagaggcggcggcgtgaaggcctgcagcctgacctgcctggccgagggcttcaacttctacaccgagagagccgccgccgtggtggacggcaccccctgcagacccgacaccgtggacatctgcgtgagcggcgagtgcaagcacgtgggctgcgacagagtgctgggcagcgacctgagagaggacaagtgcagagtgtgcggcggcgacggcagcgcctgcgagaccatcgagggcgtgttcagccccgccagccccggcgccggctacgaggacgtggtgtggatccccaagggcagcgtgcacatcttcatccaggacctgaacctgagcctgagccacctggccctgaagggcgaccaggagagcctgctgctggagggcctgcccggcaccccccagccccacagactgcccctggccggcaccaccttccagctgagacagggccccgaccaggtgcagagcctggaggccctgggccccatcaacgccagcctgatcgtgatggtgctggccagaaccgagctgcccgccctgagatacagattcaacgcccccatcgccagagacagcctgcccccctacagctggcactacgccccctggaccaagtgcagcgcccagtgcgccggcggcagccaggtgcaggccgtggagtgcagaaaccagctggacagcagcgccgtggccccccactactgcagcgcccacagcaagctgcccaagagacagagagcctgcaacaccgagccctgcccccccgactgggtggtgggcaactggagcctgtgcagcagaagctgcgacgccggcgtgagaagcagaagcgtggtgtgccagagaagagtgagcgccgccgaggagaaggccctggacgacagcgcctgcccccagcccagaccccccgtgctggaggcctgccacggccccacctgcccccccgagtgggccgccctggactggagcgagtgcacccccagctgcggccccggcctgagacacagagtggtgctgtgcaagagcgccgaccacagagccaccctgccccccgcccactgcagccccgccgccaagccccccgccaccatgagatgcaacctgagaagatgcccccccgccagatgggtggccggcgagtggggcgagtgcagcgcccagtgcggcgtgggccagagacagagaagcgtgagatgcaccagccacaccggccaggccagccacgagtgcaccgaggccctgagaccccccaccacccagcagtgcgaggccaagtgcgacagccccacccccggcgacggccccgaggagtgcaaggacgtgaacaaggtggcctactgccccctggtgctgaagttccagttctgcagcagagcctacttcagacagatgtgctgcaagacctgccacggccactag

SEQ ID NO: 71842 - DNA, 2544 bp, Artificial Sequence
  Description of Artificial Sequence: Synthetic coding sequence
caggacgacggcggcctgagcagagcccccggctgcggcgccgtgtgccccggccaccacgagcactgccaggtggccaagctgttccaggacagcagcctgggcagcaccgtgaacatcctggtgaccagactgatcctgctgaccgaggaccagcccaccctggagatcacccaccacgccggcaagagcctggacagcttctgcaagtggcagaagagcatcgtgaaccacagcggccacggcaacgccatccccgagaacggcgtggccaaccacgacaccgccgtgctgatcaccagatacgacatctgcatctacaagaacaagccctgcggcaccctgggcctggcccccgtgggcggcatgtgcgagagagagagaagctgcagcgtgaacgaggacatcggcctggccaccgccttcaccatcgcccacgagatcggccacaccttcggcatgaaccacgacggcgtgggcaacagctgcggcgccagaggccaggaccccgccaagctgatggccgcccacatcaccatgaagaccaaccccttcgtgtggagcagctgcagcagagactacatcaccagcttcctggacagcggcctgggcctgtgcctgaacaacagaccccccagacaggacttcgtgtaccccaccgtggcccccggccaggcctacgacgccgacgagcagtgcagattccagcacggcgtgaagagcagacagtgcaagtacggcgaggtgtgcagcgagctgtggtgcctgagcaagagcaacagatgcatcaccaacagcatccccgccgccgagggcaccctgtgccagacccacaccatcgacaagggctggtgctacaagagagtgtgcgtgcccttcggcagcagacccgagggcgtggacggcgcctggggcccctggaccccctggggcgactgcagcagaacctgcggcggcggcgtgagcagcagcagcagacactgcgacagccccagacccaccatcggcggcaagtactgcctgggcgagagaagaagacacagaagctgcaacaccgacgactgcccccccggcagccaggacttcagagaggtgcagtgcagcgagttcgacagcatccccttcagaggcaagttctacaagtggaagacctacagaggcggcggcgtgaaggcctgcagcctgacctgcctggccgagggcttcaacttctacaccgagagagccgccgccgtggtggacggcaccccctgcagacccgacaccgtggacatctgcgtgagcggcgagtgcaagcacgtgggctgcgacagagtgctgggcagcgacctgagagaggacaagtgcagagtgtgcggcggcgacggcagcgcctgcgagaccatcgagggcgtgttcagccccgccagccccggcgccggctacgaggacgtggtgtggatccccaagggcagcgtgcacatcttcatccaggacctgaacctgagcctgagccacctggccctgaagggcgaccaggagagcctgctgctggagggcctgcccggcaccccccagccccacagactgcccctggccggcaccaccttccagctgagacagggccccgaccaggtgcagagcctggaggccctgggccccatcaacgccagcctgatcgtgatggtgctggccagaaccgagctgcccgccctgagatacagattcaacgcccccatcgccagagacagcctgcccccctacagctggcactacgccccctggaccaagtgcagcgcccagtgcgccggcggcagccaggtgcaggccgtggagtgcagaaaccagctggacagcagcgccgtggccccccactactgcagcgcccacagcaagctgcccaagagacagagagcctgcaacaccgagccctgcccccccgactgggtggtgggcaactggagcctgtgcagcagaagctgcgacgccggcgtgagaagcagaagcgtggtgtgccagagaagagtgagcgccgccgaggagaaggccctggacgacagcgcctgcccccagcccagaccccccgtgctggaggcctgccacggccccacctgcccccccgagtgggccgccctggactggagcgaggtgagcagacccctgcccagcagacccctgggctgccccggcggcgtgagcaccgagacccccctgagaggcctgcaggtgagctgccccctgctgaccagccactggggcagcaccctgagcaccaagagacccttccagctgcagtgcacccccagctgcggccccggcctgagacacagagtggtgctgtgcaagagcgccgaccacagagccaccctgccccccgcccactgcagccccgccgccaagccccccgccaccatgagatgcaacctgagaagatgcccccccgccagatgggtggccggcgagtggggcgagtgcagcgcccagtgcggcgtgggccagagacagagaagcgtgagatgcaccagccacaccggccaggccagccacgagtgcaccgaggcctag

SEQ ID NO: 71843 - DNA, 4530 bp, Artificial Sequence
  Description of Artificial Sequence: Synthetic coding sequence
atgccctgcgcccagagaagctggctggccaacctgagcgtggtggcccagctgctgaacttcggcgccctgtgctacggcagacagccccagcccggccccgtgagattccccgacagaagacaggagcacttcatcaagggcctgcccgagtaccacgtggtgggccccgtgagagtggacgccagcggccacttcctgagctacggcctgcactaccccatcaccagcagcagaagaaagagagacctggacggcagcgaggactgggtgtactacagaatcagccacgaggagaaggacctgttcttcaacctgaccgtgaaccagggcttcctgagcaacagctacatcatggagaagagatacggcaacctgagccacgtgaagatgatggccagcagcgcccccctgtgccacctgagcggcaccgtgctgcagcagggcaccagagtgggcaccgccgccctgagcgcctgccacggcctgaccggcttcttccagctgccccacggcgacttcttcatcgagcccgtgaagaagcaccccctggtggagggcggctaccacccccacatcgtgtacagaagacagaaggtgcccgagaccaaggagcccacctgcggcctgaaggacagcgtgaacatcagccagaagcaggagctgtggagagagaagtgggagagacacaacctgcccagcagaagcctgagcagaagaagcatcagcaaggagagatgggtggagaccctggtggtggccgacaccaagatgatcgagtaccacggcagcgagaacgtggagagctacatcctgaccatcatgaacatggtgaccggcctgttccacaaccccagcatcggcaacgccatccacatcgtggtggtgagactgatcctgctggaggaggaggagcagggcctgaagatcgtgcaccacgccgagaagaccctgagcagcttctgcaagtggcagaagagcatcaaccccaagagcgacctgaaccccgtgcaccacgacgtggccgtgctgctgaccagaaaggacatctgcgccggcttcaacagaccctgcgagaccctgggcctgagccacctgagcggcatgtgccagccccacagaagctgcaacatcaacgaggacagcggcctgcccctggccttcaccatcgcccacgagctgggccacagcttcggcatccagcacgacggcaaggagaacgactgcgagcccgtgggcagacacccctacatcatgagcagacagctgcagtacgaccccacccccctgacctggagcaagtgcagcgaggagtacatcaccagattcctggacagaggctggggcttctgcctggacgacatccccaagaagaagggcctgaagagcaaggtgatcgcccccggcgtgatctacgacgtgcaccaccagtgccagctgcagtacggccccaacgccaccttctgccaggaggtggagaacgtgtgccagaccctgtggtgcagcgtgaagggcttctgcagaagcaagctggacgccgccgccgacggcacccagtgcggcgagaagaagtggtgcatggccggcaagtgcatcaccgtgggcaagaagcccgagagcatccccggcggctggggcagatggagcccctggagccactgcagcagaacctgcggcgccggcgtgcagagcgccgagagactgtgcaacaaccccgagcccaagttcggcggcaagtactgcaccggcgagagaaagagatacagactgtgcaacgtgcacccctgcagaagcgaggcccccaccttcagacagatgcagtgcagcgagttcgacaccgtgccctacaagaacgagctgtaccactggttccccatcttcaaccccggctacgtggacatcggcctgatccccaagggcgccagagacatcagagtgatggagatcgagggcgccggcaacttcctggccatcagaagcgaggaccccgagaagtactacctgaacggcggcttcatcatccagtggaacggcaactacaagctggccggcaccgtgttccagtacgacagaaagggcgacctggagaagctgatggccaccggccccaccaacgagagcgtgtggatccagctgctgttccaggtgaccaaccccggcatcaagtacgagtacaccatccagaaggacggcctggacaacgacgtggagcagcagatgtacttctggcagtacggccactggaccgagtgcagcgtgacctgcggcaccggcatcagaagacagaccgcccactgcatcaagaagggcagaggcatggtgaaggccaccttctgcgaccccgagacccagcccaacggcagacagaagaagtgccacgagaaggcctgcccccccagatggtgggccggcgagtgggaggcctgcagcgccacctgcggcccccacggcgagaagaagagaaccgtgctgtgcatccagaccatggtgagcgacgagcaggccctgccccccaccgactgccagcacctgctgaagcccaagaccctgctgagctgcaacagagacatcctgtgccccagcgactggaccgtgggcaactggagcgagtgcagcgtgagctgcggcggcggcgtgagaatcagaagcgtgacctgcgccaagaaccacgacgagccctgcgacgtgaccagaaagcccaacagcagagccctgtgcggcctgcagcagtgccccagcagcagaagagtgctgaagcccaacaagggcaccatcagcaacggcaagaacccccccaccctgaagcccgtgcccccccccaccagcagacccagaatgctgaccacccccaccggccccgagagcatgagcaccagcacccccgccatcagcagccccagccccaccaccgccagcaaggagggcgacctgggcggcaagcagtggcaggacagcagcacccagcccgagctgagcagcagatacctgatcagcaccggcagcaccagccagcccatcctgaccagccagagcctgagcatccagcccagcgaggagaacgtgagcagcagcgacaccggccccaccagcgagggcggcctggtggccaccaccaccagcggcagcggcctgagcagcagcagaaaccccatcacctggcccgtgacccccttctacaacaccctgaccaagggccccgagatggagatccacagcggcagcggcgaggagagagagcagcccgaggacaaggacgagagcaaccccgtgatctggaccaagatcagagtgcccggcaacgacgcccccgtggagagcaccgagatgcccctggccccccccctgacccccgacctgagcagagagagctggtggccccccttcagcaccgtgatggagggcctgctgcccagccagagacccaccaccagcgagaccggcacccccagagtggagggcatggtgaccgagaagcccgccaacaccctgctgcccctgggcggcgaccaccagcccgagcccagcggcaagaccgccaacagaaaccacctgaagctgcccaacaacatgaaccagaccaagagcagcgagcccgtgctgaccgaggaggacgccaccagcctgatcaccgagggcttcctgctgaacgccagcaactacaagcagctgaccaacggccacggcagcgcccactggatcgtgggcaactggagcgagtgcagcaccacctgcggcctgggcgcctactggagaagagtggagtgcagcacccagatggacagcgactgcgccgccatccagagacccgaccccgccaagagatgccacctgagaccctgcgccggctggaaggtgggcaactggagcaagtgcagcagaaactgcagcggcggcttcaagatcagagagatccagtgcgtggacagcagagaccacagaaacctgagacccttccactgccagttcctggccggcatccccccccccctgagcatgagctgcaaccccgagccctgcgaggcctggcaggtggagccctggagccagtgcagcagaagctgcggcggcggcgtgcaggagagaggcgtgttctgccccggcggcctgtgcgactggaccaagagacccaccagcaccatgagctgcaacgagcacctgtgctgccactgggccaccggcaactgggacctgtgcagcaccagctgcggcggcggcttccagaagagaaccgtgcagtgcgtgcccagcgagggcaacaagaccgaggaccaggaccagtgcctgtgcgaccacaagcccagaccccccgagttcaagaagtgcaaccagcaggcctgcaagaagagcgccgacctgctgtgcaccaaggacaagctgagcgccagcttctgccagaccctgaaggccatgaagaagtgcagcgtgcccaccgtgagagccgagtgctgcttcagctgcccccagacccacatcacccacacccagagacagagaagacagagactgctgcagaagagcaaggagctgtag

SEQ ID NO: 71844 - DNA, 4785 bp, Artificial Sequence
  Description of Artificial Sequence: Synthetic coding sequence
atgccctgcgcccagagaagctggctggccaacctgagcgtggtggcccagctgctgaacttcggcgccctgtgctacggcagacagccccagcccggccccgtgagattccccgacagaagacaggagcacttcatcaagggcctgcccgagtaccacgtggtgggccccgtgagagtggacgccagcggccacttcctgagctacggcctgcactaccccatcaccagcagcagaagaaagagagacctggacggcagcgaggactgggtgtactacagaatcagccacgaggagaaggacctgttcttcaacctgaccgtgaaccagggcttcctgagcaacagctacatcatggagaagagatacggcaacctgagccacgtgaagatgatggccagcagcgcccccctgtgccacctgagcggcaccgtgctgcagcagggcaccagagtgggcaccgccgccctgagcgcctgccacggcctgaccggcttcttccagctgccccacggcgacttcttcatcgagcccgtgaagaagcaccccctggtggagggcggctaccacccccacatcgtgtacagaagacagaaggtgcccgagaccaaggagcccacctgcggcctgaaggacagcgtgaacatcagccagaagcaggagctgtggagagagaagtgggagagacacaacctgcccagcagaagcctgagcagaagaagcatcagcaaggagagatgggtggagaccctggtggtggccgacaccaagatgatcgagtaccacggcagcgagaacgtggagagctacatcctgaccatcatgaacatggtgaccggcctgttccacaaccccagcatcggcaacgccatccacatcgtggtggtgagactgatcctgctggaggaggaggagcagggcctgaagatcgtgcaccacgccgagaagaccctgagcagcttctgcaagtggcagaagagcatcaaccccaagagcgacctgaaccccgtgcaccacgacgtggccgtgctgctgaccagaaaggacatctgcgccggcttcaacagaccctgcgagaccctgggcctgagccacctgagcggcatgtgccagccccacagaagctgcaacatcaacgaggacagcggcctgcccctggccttcaccatcgcccacgagctgggccacagcttcggcatccagcacgacggcaaggagaacgactgcgagcccgtgggcagacacccctacatcatgagcagacagctgcagtacgaccccacccccctgacctggagcaagtgcagcgaggagtacatcaccagattcctggacagaggctggggcttctgcctggacgacatccccaagaagaagggcctgaagagcaaggtgatcgcccccggcgtgatctacgacgtgcaccaccagtgccagctgcagtacggccccaacgccaccttctgccaggaggtggagaacgtgtgccagaccctgtggtgcagcgtgaagggcttctgcagaagcaagctggacgccgccgccgacggcacccagtgcggcgagaagaagtggtgcatggccggcaagtgcatcaccgtgggcaagaagcccgagagcatccccggcggctggggcagatggagcccctggagccactgcagcagaacctgcggcgccggcgtgcagagcgccgagagactgtgcaacaaccccgagcccaagttcggcggcaagtactgcaccggcgagagaaagagatacagactgtgcaacgtgcacccctgcagaagcgaggcccccaccttcagacagatgcagtgcagcgagttcgacaccgtgccctacaagaacgagctgtaccactggttccccatcttcaaccccgcccacccctgcgagctgtactgcagacccatcgacggccagttcagcgagaagatgctggacgccgtgatcgacggcaccccctgcttcgagggcggcaacagcagaaacgtgtgcatcaacggcatctgcaagatggtgggctgcgactacgagatcgacagcaacgccaccgaggacagatgcggcgtgtgcctgggcgacggcagcagctgccagaccgtgagaaagatgttcaagcagaaggagggcagcggctacgtggacatcggcctgatccccaagggcgccagagacatcagagtgatggagatcgagggcgccggcaacttcctggccatcagaagcgaggaccccgagaagtactacctgaacggcggcttcatcatccagtggaacggcaactacaagctggccggcaccgtgttccagtacgacagaaagggcgacctggagaagctgatggccaccggccccaccaacgagagcgtgtggatccagctgctgttccaggtgaccaaccccggcatcaagtacgagtacaccatccagaaggacggcctggacaacgacgtggagcagcagatgtacttctggcagtacggccactggaccgagtgcagcgtgacctgcggcaccggcatcagaagacagaccgcccactgcatcaagaagggcagaggcatggtgaaggccaccttctgcgaccccgagacccagcccaacggcagacagaagaagtgccacgagaaggcctgcccccccagatggtgggccggcgagtgggaggcctgcagcgccacctgcggcccccacggcgagaagaagagaaccgtgctgtgcatccagaccatggtgagcgacgagcaggccctgccccccaccgactgccagcacctgctgaagcccaagaccctgctgagctgcaacagagacatcctgtgccccagcgactggaccgtgggcaactggagcgagtgcagcgtgagctgcggcggcggcgtgagaatcagaagcgtgacctgcgccaagaaccacgacgagccctgcgacgtgaccagaaagcccaacagcagagccctgtgcggcctgcagcagtgccccagcagcagaagagtgctgaagcccaacaagggcaccatcagcaacggcaagaacccccccaccctgaagcccgtgcccccccccaccagcagacccagaatgctgaccacccccaccggccccgagagcatgagcaccagcacccccgccatcagcagccccagccccaccaccgccagcaaggagggcgacctgggcggcaagcagtggcaggacagcagcacccagcccgagctgagcagcagatacctgatcagcaccggcagcaccagccagcccatcctgaccagccagagcctgagcatccagcccagcgaggagaacgtgagcagcagcgacaccggccccaccagcgagggcggcctggtggccaccaccaccagcggcagcggcctgagcagcagcagaaaccccatcacctggcccgtgacccccttctacaacaccctgaccaagggccccgagatggagatccacagcggcagcggcgaggagagagagcagcccgaggacaaggacgagagcaaccccgtgatctggaccaagatcagagtgcccggcaacgacgcccccgtggagagcaccgagatgcccctggccccccccctgacccccgacctgagcagagagagctggtggccccccttcagcaccgtgatggagggcctgctgcccagccagagacccaccaccagcgagaccggcacccccagagtggagggcatggtgaccgagaagcccgccaacaccctgctgcccctgggcggcgaccaccagcccgagcccagcggcaagaccgccaacagaaaccacctgaagctgcccaacaacatgaaccagaccaagagcagcgagcccgtgctgaccgaggaggacgccaccagcctgatcaccgagggcttcctgctgaacgccagcaactacaagcagctgaccaacggccacggcagcgcccactggatcgtgggcaactggagcgagtgcagcaccacctgcggcctgggcgcctactggagaagagtggagtgcagcacccagatggacagcgactgcgccgccatccagagacccgaccccgccaagagatgccacctgagaccctgcgccggctggaaggtgggcaactggagcaagtgcagcagaaactgcagcggcggcttcaagatcagagagatccagtgcgtggacagcagagaccacagaaacctgagacccttccactgccagttcctggccggcatccccccccccctgagcatgagctgcaaccccgagccctgcgaggcctggcaggtggagccctggagccagtgcagcagaagctgcggcggcggcgtgcaggagagaggcgtgttctgccccggcggcctgtgcgactggaccaagagacccaccagcaccatgagctgcaacgagcacctgtgctgccactgggccaccggcaactgggacctgtgcagcaccagctgcggcggcggcttccagaagagaaccgtgcagtgcgtgcccagcgagggcaacaagaccgaggaccaggaccagtgcctgtgcgaccacaagcccagaccccccgagttcaagaagtgcaaccagcaggcctgcaagaagagcgccgacctgctgtgcaccaaggacaagctgagcgccagcttctgccagaccctgaaggccatgaagaagtgcagcgtgcccaccgtgagagccgagtgctgcttcagctgcccccagacccacatcacccacacccagagacagagaagacagagactgctgcagaagagcaaggagctgtag

SEQ ID NO: 71845 - DNA, 699 bp, Artificial Sequence
  Description of Artificial Sequence: Synthetic coding sequence
atgccctgcgcccagagaagctggctggccaacctgagcgtggtggcccagctgctgaacttcggcgccctgtgctacggcagacagccccagcccggccccgtgagattccccgacagaagacaggagcacttcatcaagggcctgcccgagtaccacgtggtgggccccgtgagagtggacgccagcggccacttcctgagctacggcctgcactaccccatcaccagcagcagaagaaagagagacctggacggcagcgaggactgggtgtactacagaatcagccacgaggagaaggacctgttcttcaacctgaccgtgaaccagggcttcctgagcaacagctacatcatggagaagagatacggcaacctgagccacgtgaagatgatggccagcagcgcccccctgtgccacctgagcggcaccgtgctgcagcagggcaccagagtgggcaccgccgccctgagcgcctgccacggcctgaccggcttcttccagctgccccacggcgacttcttcatcgagcccgtgaagaagcaccccctggtggagggcggctaccacccccacatcgtgtacagaagacagaaggtgcccgagaccaaggagcccacctgcggcctgaagggcatcgtgacccacatgagcagctgggtggaggagagcgtgctgttcttctggctgttctactag

SEQ ID NO: 71846 - DNA, 3675 bp, Artificial Sequence
  Description of Artificial Sequence: Synthetic coding sequence
atgaagcccagagccagaggctggagaggcctggccgccctgtggatgctgctggcccaggtggccgagcaggcccccgcctgcgccatgggccccgccgccgccgcccccggcagccccagcgtgcccagaccccccccccccgccgagagacccggctggatggagaagggcgagtacgacctggtgagcgcctacgaggtggaccacagaggcgactacgtgagccacgagatcatgcaccaccagagaagaagaagagccgtgcccgtgagcgaggtggagagcctgcacctgagactgaagggcagcagacacgacttccacatggacctgagaaccagcagcagcctggtggcccccggcttcatcgtgcagaccctgggcaagaccggcaccaagagcgtgcagaccctgccccccgaggacttctgcttctaccagggcagcctgagaagccacagaaacagcagcgtggccctgagcacctgccagggcctgagcggcatgatcagaaccgaggaggccgactacttcctgagacccctgcccagccacctgagctggaagctgggcagagccgcccagggcagcagccccagccacgtgctgtacaagagaagcaccgagccccacgcccccggcgccagcgaggtgctggtgaccagcagaacctgggagctggcccaccagcccctgcacagcagcgacctgagactgggcctgccccagaagcagcacttctgcggcagaagaaagaagtacatgccccagccccccaaggaggacctgttcatcctgcccgacgagtacaagagctgcctgagacacaagagaagcctgctgagaagccacagaaacgaggagctgaacgtggagaccctggtggtggtggacaagaagatgatgcagaaccacggccacgagaacatcaccacctacgtgctgaccatcctgaacatggtgagcgccctgttcaaggacggcaccatcggcggcaacatcaacatcgccatcgtgggcctgatcctgctggaggacgagcagcccggcctggtgatcagccaccacgccgaccacaccctgagcagcttctgccagtggcagagcggcctgatgggcaaggacggcaccagacacgaccacgccatcctgctgaccggcctggacatctgcagctggaagaacgagccctgcgacaccctgggcttcgcccccatcagcggcatgtgcagcaagtacagaagctgcaccatcaacgaggacaccggcctgggcctggccttcaccatcgcccacgagagcggccacaacttcggcatgatccacgacggcgagggcaacatgtgcaagaagagcgagggcaacatcatgagccccaccctggccggcagaaacggcgtgttcagctggagcccctgcagcagacagtacctgcacaagttcctgagcaccgcccaggccatctgcctggccgaccagcccaagcccgtgaaggagtacaagtaccccgagaagctgcccggcgagctgtacgacgccaacacccagtgcaagtggcagttcggcgagaaggccaagctgtgcatgctggacttcaagaaggacatctgcaaggccctgtggtgccacagaatcggcagaaagtgcgagaccaagttcatgcccgccgccgagggcaccatctgcggccacgacatgtggtgcagaggcggccagtgcgtgaagtacggcgacgagggccccaagcccacccacggccactggagcgactggagcagctggagcccctgcagcagaacctgcggcggcggcgtgagccacagaagcagactgtgcaccaaccccaagcccagccacggcggcaagttctgcgagggcagcaccagaaccctgaagctgtgcaacagccagaagtgccccagagacagcgtggacttcagagccgcccagtgcgccgagcacaacagcagaagattcagaggcagacactacaagtggaagccctacacccaggtggaggaccaggacctgtgcaagctgtactgcatcgccgagggcttcgacttcttcttcagcctgagcaacaaggtgaaggacggcaccccctgcagcgaggacagcagaaacgtgtgcatcgacggcatctgcgagagagtgggctgcgacaacgtgctgggcagcgacgccgtggaggacgtgtgcggcgtgtgcaacggcaacaacagcgcctgcaccatccacagaggcctgtacaccaagcaccaccacaccaaccagtactaccacatggtgaccatccccagcggcgccagaagcatcagaatctacgagatgaacgtgagcaccagctacatcagcgtgagaaacgccctgagaagatactacctgaacggccactggaccgtggactggcccggcagatacaagttcagcggcaccaccttcgactacagaagaagctacaacgagcccgagaacctgatcgccaccggccccaccaacgagaccctgatcgtggagctgctgttccagggcagaaaccccggcgtggcctgggagtacagcatgcccagactgggcaccgagaagcagccccccgcccagcccagctacacctgggccatcgtgagaagcgagtgcagcgtgagctgcggcggcggccagatgaccgtgagagagggctgctacagagacctgaagttccaggtgaacatgagcttctgcaaccccaagaccagacccgtgaccggcctggtgccctgcaaggtgagcgcctgcccccccagctggagcgtgggcaactggagcgcctgcagcagaacctgcggcggcggcgcccagagcagacccgtgcagtgcaccagaagagtgcactacgacagcgagcccgtgcccgccagcctgtgcccccagcccgcccccagcagcagacaggcctgcaacagccagagctgcccccccgcctggagcgccggcccctgggccgagtgcagccacacctgcggcaagggctggagaaagagagccgtggcctgcaagagcaccaaccccagcgccagagcccagctgctgcccgacgccgtgtgcaccagcgagcccaagcccagaatgcacgaggcctgcctgctgcagagatgccacaagcccaagaagctgcagtggctggtgagcgcctggagccagtgcagcgtgacctgcgagagaggcacccagaagagattcctgaagtgcgccgagaagtacgtgagcggcaagtacagagagctggccagcaagaagtgcagccacctgcccaagcccagcctggagctggagagagcctgcgcccccctgccctgccccagacacccccccttcgccgccgccggccccagcagaggcagctggttcgccagcccctggagccagtgcaccgccagctgcggcggcggcgtgcagaccagaagcgtgcagtgcctggccggcggcagacccgccagcggctgcctgctgcaccagaagcccagcgccagcctggcctgcaacacccacttctgccccatcgccgagaagaaggacgccttctgcaaggactacttccactggtgctacctggtgccccagcacggcatgtgcagccacaagttctacggcaagcagtgctgcaagacctgcagcaagagcaacctgtag

SEQ ID NO: 71847 - DNA, 2787 bp, Artificial Sequence
  Description of Artificial Sequence: Synthetic coding sequence
atgaagcccagagccagaggctggagaggcctggccgccctgtggatgctgctggcccaggtggccgagcaggcccccgcctgcgccatgggccccgccgccgccgcccccggcagccccagcgtgcccagaccccccccccccgccgagagacccggctggatggagaagggcgagtacgacctggtgagcgcctacgaggtggaccacagaggcgactacgtgagccacgagatcatgcaccaccagagaagaagaagagccgtgcccgtgagcgaggtggagagcctgcacctgagactgaagggcagcagacacgacttccacatggacctgagaaccagcagcagcctggtggcccccggcttcatcgtgcagaccctgggcaagaccggcaccaagagcgtgcagaccctgccccccgaggacttctgcttctaccagggcagcctgagaagccacagaaacagcagcgtggccctgagcacctgccagggcctgagcggcatgatcagaaccgaggaggccgactacttcctgagacccctgcccagccacctgagctggaagctgggcagagccgcccagggcagcagccccagccacgtgctgtacaagagaagcaccgagccccacgcccccggcgccagcgaggtgctggtgaccagcagaacctgggagctggcccaccagcccctgcacagcagcgacctgagactgggcctgccccagaagcagcacttctgcggcagaagaaagaagtacatgccccagccccccaaggaggacctgttcatcctgcccgacgagtacaagagctgcctgagacacaagagaagcctgctgagaagccacagaaacgaggagctgaacgtggagaccctggtggtggtggacaagaagatgatgcagaaccacggccacgagaacatcaccacctacgtgctgaccatcctgaacatggtgagcgccctgttcaaggacggcaccatcggcggcaacatcaacatcgccatcgtgggcctgatcctgctggaggacgagcagcccggcctggtgatcagccaccacgccgaccacaccctgagcagcttctgccagtggcagagcggcctgatgggcaaggacggcaccagacacgaccacgccatcctgctgaccggcctggacatctgcagctggaagaacgagccctgcgacaccctgggcttcgcccccatcagcggcatgtgcagcaagtacagaagctgcaccatcaacgaggacaccggcctgggcctggccttcaccatcgcccacgagagcggccacaacttcggcatgatccacgacggcgagggcaacatgtgcaagaagagcgagggcaacatcatgagccccaccctggccggcagaaacggcgtgttcagctggagcccctgcagcagacagtacctgcacaagttcctgagcaccgcccaggccatctgcctggccgaccagcccaagcccgtgaaggagtacaagtaccccgagaagctgcccggcgagctgtacgacgccaacacccagtgcaagtggcagttcggcgagaaggccaagctgtgcatgctggacttcaagaaggacatctgcaaggccctgtggtgccacagaatcggcagaaagtgcgagaccaagttcatgcccgccgccgagggcaccatctgcggccacgacatgtggtgcagaggcggccagtgcgtgaagtacggcgacgagggccccaagcccacccacggccactggagcgactggagcagctggagcccctgcagcagaacctgcggcggcggcgtgagccacagaagcagactgtgcaccaaccccaagcccagccacggcggcaagttctgcgagggcagcaccagaaccctgaagctgtgcaacagccagaagtgccccagagacagcgtggacttcagagccgcccagtgcgccgagcacaacagcagaagattcagaggcagacactacaagtggaagccctacacccaggtggaggaccaggacctgtgcaagctgtactgcatcgccgagggcttcgacttcttcttcagcctgagcaacaaggtgaaggacggcaccccctgcagcgaggacagcagaaacgtgtgcatcgacggcatctgcgagagagtgggctgcgacaacgtgctgggcagcgacgccgtggaggacgtgtgcggcgtgtgcaacggcaacaacagcgcctgcaccatccacagaggcctgtacaccaagcaccaccacaccaaccagtactaccacatggtgaccatccccagcggcgccagaagcatcagaatctacgagatgaacgtgagcaccagctacatcagcgtgagaaacgccctgagaagatactacctgaacggccactggaccgtggactggcccggcagatacaagttcagcggcaccaccttcgactacagaagaagctacaacgagcccgagaacctgatcgccaccggccccaccaacgagaccctgatcgtggagctgctgttccagggcagaaaccccggcgtggcctgggagtacagcatgcccagactgggcaccgagaagcagccccccgcccagcccagctacacctgggccatcgtgagaagcgagtgcagcgtgagctgcggcggcggccagatgaccgtgagagagggctgctacagagacttcctgtacttcatgttctacctgagccagctgttcgccagcgagtgccccttcaagaacaccctgctgcacgccttcctgtgcaagtag

SEQ ID NO: 71848 - DNA, 3288 bp, Artificial Sequence
  Description of Artificial Sequence: Synthetic coding sequence
atgtgcgacggcgccctgctgccccccctggtgctgcccgtgctgctgctgctggtgtggggcctggaccccggcaccgccgtgggcgacgccgccgccgacgtggaggtggtgctgccctggagagtgagacccgacgacgtgcacctgccccccctgcccgccgcccccggccccagaagaagaagaagacccagaaccccccccgccgcccccagagccagacccggcgagagagccctgctgctgcacctgcccgccttcggcagagacctgtacctgcagctgagaagagacctgagattcctgagcagaggcttcgaggtggaggaggccggcgccgccagaagaagaggcagacccgccgagctgtgcttctacagcggcagagtgctgggccaccccggcagcctggtgagcctgagcgcctgcggcgccgccggcggcctggtgggcctgatccagctgggccaggagcaggtgctgatccagcccctgaacaacagccagggccccttcagcggcagagagcacctgatcagaagaaagtggagcctgacccccagccccagcgccgaggcccagagacccgagcagctgtgcaaggtgctgaccgagaagaagaagcccacctggggcagacccagcagagactggagagagagaagaaacgccatcagactgaccagcgagcacaccgtggagaccctggtggtggccgacgccgacatggtgcagtaccacggcgccgaggccgcccagagattcatcctgaccgtgatgaacatggtgtacaacatgttccagcaccagagcctgggcatcaagatcaacatccaggtgaccaagctggtgctgctgagacagagacccgccaagctgagcatcggccaccacggcgagagaagcctggagagcttctgccactggcagaacgaggagtacggcggcgccagatacctgggcaacaaccaggtgcccggcggcaaggacgacccccccctggtggacgccgccgtgttcgtgaccagaaccgacttctgcgtgcacaaggacgagccctgcgacaccgtgggcatcgcctacctgggcggcgtgtgcagcgccaagagaaagtgcgtgctggccgaggacaacggcctgaacctggccttcaccatcgcccacgagctgggccacaacctgggcatgaaccacgacgacgaccacagcagctgcgccggcagaagccacatcatgagcggcgagtgggtgaagggcagaaaccccagcgacctgagctggagcagctgcagcagagacgacctggagaacttcctgaagagcaaggtgagcacctgcctgctggtgaccgaccccagaagccagcacaccgtgagactgccccacaagctgcccggcatgcactacagcgccaacgagcagtgccagatcctgttcggcatgaacgccaccttctgcagaaacatggagcacctgatgtgcgccggcctgtggtgcctggtggagggcgacaccagctgcaagaccaagctggacccccccctggacggcaccgagtgcggcgccgacaagtggtgcagagccggcgagtgcgtgagcaagacccccatccccgagcacgtggacggcgactggagcccctggggcgcctggagcatgtgcagcagaacctgcggcaccggcgccagattcagacagagaaagtgcgacaaccccccccccggccccggcggcacccactgccccggcgccagcgtggagcacgccgtgtgcgagaacctgccctgccccaagggcctgcccagcttcagagaccagcagtgccaggcccacgacagactgagccccaagaagaagggcctgctgaccgccgtggtggtggacgacaagccctgcgagctgtactgcagccccctgggcaaggagagccccctgctggtggccgacagagtgctggacggcaccccctgcggcccctacgagaccgacctgtgcgtgcacggcaagtgccagaagatcggctgcgacggcatcatcggcagcgccgccaaggaggacagatgcggcgtgtgcagcggcgacggcaagacctgccacctggtgaagggcgacttcagccacgccagaggcaccgccctgaaggacagcggcaagggcagcatcaacagcgactggaagatcgagctgcccggcgagttccagatcgccggcaccaccgtgagatacgtgagaagaggcctgtgggagaagatcagcgccaagggccccaccaagctgcccctgcacctgatggtgctgctgttccacgaccaggactacggcatccactacgagtacaccgtgcccgtgaacagaaccgccgagaaccagagcgagcccgagaagccccaggacagcctgttcatctggacccacagcggctgggagggctgcagcgtgcagtgcggcggcggcgagagaagaaccatcgtgagctgcaccagaatcgtgaacaagaccaccaccctggtgaacgacagcgactgcccccaggccagcagacccgagccccaggtgagaagatgcaacctgcacccctgccagagcagatgggtggccggcccctggagcccctgcagcgccacctgcgagaagggcttccagcacagagaggtgacctgcgtgtaccagctgcagaacggcacccacgtggccaccagacccctgtactgccccggccccagacccgccgccgtgcagagctgcgagggccaggactgcctgagcatctgggaggccagcgagtggagccagtgcagcgccagctgcggcaagggcgtgtggaagagaaccgtggcctgcaccaacagccagggcaagtgcgacgccagcaccagacccagagccgaggaggcctgcgaggactacagcggctgctacgagtggaagaccggcgactggagcacctgcagcagcacctgcggcaagggcctgcagagcagagtggtgcagtgcatgcacaaggtgaccggcagacacggcagcgagtgccccgccctgagcaagcccgccccctacagacagtgctaccaggaggtgtgcaacgacagaatcaacgccaacaccatcaccagccccagactggccgccctgacctacaagtgcaccagagaccagtggaccgtgtactgcagagtgatcagagagaagaacctgtgccaggacatgagatggtaccagagatgctgccagacctgcagagacttctacgccaacaagatgagacagcccccccccaacagctag

SEQ ID NO: 71849 - DNA, 3666 bp, Artificial Sequence
  Description of Artificial Sequence: Synthetic coding sequence
atggagtgcgccctgctgctggcctgcgccttccccgccgccggcagcggcccccccagaggcctggccggcctgggcagagtggccaaggccctgcagctgtgctgcctgtgctgcgccagcgtggccgccgccctggccagcgacagcagcagcggcgccagcggcctgaacgacgactacgtgttcgtgacccccgtggaggtggacagcgccggcagctacatcagccacgacatcctgcacaacggcagaaagaagagaagcgcccagaacgccagaagcagcctgcactacagattcagcgccttcggccaggagctgcacctggagctgaagcccagcgccatcctgagcagccacttcatcgtgcaggtgctgggcaaggacggcgccagcgagacccagaagcccgaggtgcagcagtgcttctaccagggcttcatcagaaacgacagcagcagcagcgtggccgtgagcacctgcgccggcctgagcggcctgatcagaaccagaaagaacgagttcctgatcagccccctgccccagctgctggcccaggagcacaactacagcagccccgccggccaccacccccacgtgctgtacaagagaaccgccgaggagaagatccagagatacagaggctaccccggcagcggcagaaactaccccggctacagccccagccacatcccccacgccagccagagcagagagaccgagtaccaccacagaagactgcagaagcagcacttctgcggcagaagaaagaagtacgcccccaagccccccaccgaggacacctacctgagattcgacgagtacggcagcagcggcagacccagaagaagcgccggcaagagccagaagggcctgaacgtggagaccctggtggtggccgacaagaagatggtggagaagcacggcaagggcaacgtgaccacctacatcctgaccgtgatgaacatggtgagcggcctgttcaaggacggcaccatcggcagcgacatcaacgtggtggtggtgagcctgatcctgctggagcaggagcccggcggcctgctgatcaaccaccacgccgaccagagcctgaacagcttctgccagtggcagagcgccctgatcggcaagaacggcaagagacacgaccacgccatcctgctgaccggcttcgacatctgcagctggaagaacgagccctgcgacaccctgggcttcgcccccatcagcggcatgtgcagcaagtacagaagctgcaccatcaacgaggacaccggcctgggcctggccttcaccatcgcccacgagagcggccacaacttcggcatgatccacgacggcgagggcaacccctgcagaaaggccgagggcaacatcatgagccccaccctgaccggcaacaacggcgtgttcagctggagcagctgcagcagacagtacctgaagaagttcctgagcaccccccaggccggctgcctggtggacgagcccaagcaggccggccagtacaagtaccccgacaagctgcccggccagatctacgacgccgacacccagtgcaagtggcagttcggcgccaaggccaagctgtgcagcctgggcttcgtgaaggacatctgcaagagcctgtggtgccacagagtgggccacagatgcgagaccaagttcatgcccgccgccgagggcaccgtgtgcggcctgagcatgtggtgcagacagggccagtgcgtgaagttcggcgagctgggccccagacccatccacggccagtggagcgcctggagcaagtggagcgagtgcagcagaacctgcggcggcggcgtgaagttccaggagagacactgcaacaaccccaagccccagtacggcggcctgttctgccccggcagcagcagaatctaccagctgtgcaacatcaacccctgcaacgagaacagcctggacttcagagcccagcagtgcgccgagtacaacagcaagcccttcagaggctggttctaccagtggaagccctacaccaaggtggaggaggaggacagatgcaagctgtactgcaaggccgagaacttcgagttcttcttcgccatgagcggcaaggtgaaggacggcaccccctgcagccccaacaagaacgacgtgtgcatcgacggcgtgtgcgagctggtgggctgcgaccacgagctgggcagcaaggccgtgagcgacgcctgcggcgtgtgcaagggcgacaacagcacctgcaagttctacaagggcctgtacctgaaccagcacaaggccaacgagtactaccccgtggtgctgatccccgccggcgccagaagcatcgagatccaggagctgcaggtgagcagcagctacctggccgtgagaagcctgagccagaagtactacctgaccggcggctggagcatcgactggcccggcgagttccccttcgccggcaccaccttcgagtaccagagaagcttcaacagacccgagagactgtacgcccccggccccaccaacgagaccctggtgttcgagatcctgatgcagggcaagaaccccggcatcgcctggaagtacgccctgcccaaggtgatgaacggcaccccccccgccaccaagagacccgcctacacctggagcatcgtgcagagcgagtgcagcgtgagctgcggcggcggctacatcaacgtgaaggccatctgcctgagagaccagaacacccaggtgaacagcagcttctgcagcgccaagaccaagcccgtgaccgagcccaagatctgcaacgccttcagctgccccgcctactggatgcccggcgagtggagcacctgcagcaaggcctgcgccggcggccagcagagcagaaagatccagtgcgtgcagaagaagcccttccagaaggaggaggccgtgctgcacagcctgtgccccgtgagcacccccacccaggtgcaggcctgcaacagccacgcctgccccccccagtggagcctgggcccctggagccagtgcagcaagacctgcggcagaggcgtgagaaagagagagctgctgtgcaagggcagcgccgccgagaccctgcccgagagccagtgcaccagcctgcccagacccgagctgcaggagggctgcgtgctgggcagatgccccaagaacagcagactgcagtgggtggccagcagctggagcgagtgcagcgccacctgcggcctgggcgtgagaaagagagagatgaagtgcagcgagaagggcttccagggcaagctgatcaccttccccgagagaagatgcagaaacatcaagaagcccaacctggacctggaggagacctgcaacagaagagcctgccccgcccaccccgtgtacaacatggtggccggctggtacagcctgccctggcagcagtgcaccgtgacctgcggcggcggcgtgcagaccagaagcgtgcactgcgtgcagcagggcagacccagcagcagctgcctgctgcaccagaagccccccgtgctgagagcctgcaacaccaacttctgccccgcccccgagaagagagaggaccccagctgcgtggacttcttcaactggtgccacctggtgccccagcacggcgtgtgcaaccacaagttctacggcaagcagtgctgcaagagctgcaccagaaagatctag

SEQ ID NO: 71850 - DNA, 825 bp, Artificial Sequence
  Description of Artificial Sequence: Synthetic coding sequence
atggagtgcgccctgctgctggcctgcgccttccccgccgccggcagcggcccccccagaggcctggccggcctgggcagagtggccaaggccctgcagctgtgctgcctgtgctgcgccagcgtggccgccgccctggccagcgacagcagcagcggcgccagcggcctgaacgacgactacgtgttcgtgacccccgtggaggtggacagcgccggcagctacatcagccacgacatcctgcacaacggcagaaagaagagaagcgcccagaacgccagaagcagcctgcactacagattcagcgccttcggccaggagctgcacctggagctgaagcccagcgccatcctgagcagccacttcatcgtgcaggtgctgggcaaggacggcgccagcgagacccagaagcccgaggtgcagcagtgcttctaccagggcttcatcagaaacgacagcagcagcagcgtggccgtgagcacctgcgccggcctgagcggcctgatcagaaccagaaagaacgagttcctgatcagccccctgccccagctgctggcccaggagcacaactacagcagccccgccggccaccacccccacgtgctgtacaagagaaccgccgaggagaagatccagagatacagaggctaccccggcagcggcagaaactaccccggctacagccccagccacatcccccacgccagccagagcagagagaccgagtaccaccacagaagactgcagaagcagcacttctgcggcagaagaaagaagtgcatctgcagccaggccagccacagaggccacctgagcaaggtgtag

SEQ ID NO: 71851 - DNA, 3636 bp, Artificial Sequence
  Description of Artificial Sequence: Synthetic coding sequence
atggacccccccgccggcgccgccagaagactgctgtgccccgccctgctgctgctgctgctgctgctgcccccccccctgctgccccccccccccccccccgccaacgccagactggccgccgccgccgacccccccggcggccccctgggccacggcgccgagagaatcctggccgtgcccgtgagaaccgacgcccagggcagactggtgagccacgtggtgagcgccgccaccagcagagccggcgtgagagccagaagagccgcccccgtgagaacccccagcttccccggcggcaacgaggaggagcccggcagccacctgttctacaacgtgaccgtgttcggcagagacctgcacctgagactgagacccaacgccagactggtggcccccggcgccaccatggagtggcagggcgagaagggcaccaccagagtggagcccctgctgggcagctgcctgtacgtgggcgacgtggccggcctggccgaggccagcagcgtggccctgagcaactgcgacggcctggccggcctgatcagaatggaggaggaggagttcttcatcgagcccctggagaagggcctggccgcccaggaggccgagcagggcagagtgcacgtggtgtacagaagaccccccaccagcccccccctgggcggcccccaggccctggacaccggcgccagcctggacagcctggacagcctgagcagagccctgggcgtgctggaggagcacgccaacagcagcagaagaagagccagaagacacgccgccgacgacgactacaacatcgaggtgctgctgggcgtggacgacagcgtggtgcagttccacggcaaggagcacgtgcagaagtacctgctgaccctgatgaacatcgtgaacgagatctaccacgacgagagcctgggcgcccacatcaacgtggtgctggtgagaatcatcctgctgagctacggcaagagcatgagcctgatcgagatcggcaaccccagccagagcctggagaacgtgtgcagatgggcctacctgcagcagaagcccgacaccggccacgacgagtaccacgaccacgccatcttcctgaccagacaggacttcggccccagcggcatgcagggctacgcccccgtgaccggcatgtgccaccccgtgagaagctgcaccctgaaccacgaggacggcttcagcagcgccttcgtggtggcccacgagaccggccacgtgctgggcatggagcacgacggccagggcaacagatgcggcgacgaggtgagactgggcagcatcatggcccccctggtgcaggccgccttccacagattccactggagcagatgcagccagcaggagctgagcagatacctgcacagctacgactgcctgctggacgaccccttcgcccacgactggcccgccctgccccagctgcccggcctgcactacagcatgaacgagcagtgcagattcgacttcggcctgggctacatgatgtgcaccgccttcagaaccttcgacccctgcaagcagctgtggtgcagccaccccgacaacccctacttctgcaagaccaagaagggcccccccctggacggcaccatgtgcgcccccggcaagcactgcttcaagggccactgcatctggctgacccccgacatcctgaagagagacggcagctggggcgcctggagccccttcggcagctgcagcagaacctgcggcaccggcgtgaagttcagaaccagacagtgcgacaacccccaccccgccaacggcggcagaacctgcagcggcctggcctacgacttccagctgtgcagcagacaggactgccccgacagcctggccgacttcagagaggagcagtgcagacagtgggacctgtacttcgagcacggcgacgcccagcaccactggctgccccacgagcacagagacgccaaggagagatgccacctgtactgcgagagcagagagaccggcgaggtggtgagcatgaagagaatggtgcacgacggcaccagatgcagctacaaggacgccttcagcctgtgcgtgagaggcgactgcagaaaggtgggctgcgacggcgtgatcggcagcagcaagcaggaggacaagtgcggcgtgtgcggcggcgacaacagccactgcaaggtggtgaagggcaccttcaccagaagccccaagaagcacggctacatcaagatgttcgagatccccgccggcgccagacacctgctgatccaggaggtggacgccaccagccaccacctggccgtgaagaacctggagaccggcaagttcatcctgaacgaggagaacgacgtggacgccagcagcaagaccttcatcgccatgggcgtggagtgggagtacagagacgaggacggcagagagaccctgcagaccatgggccccctgcacggcaccatcaccgtgctggtgatccccgtgggcgacaccagagtgagcctgacctacaagtacatgatccacgaggacagcctgaacgtggacgacaacaacgtgctggaggaggacagcgtggtgtacgagtgggccctgaagaagtggagcccctgcagcaagccctgcggcggcggcagccagttcaccaagtacggctgcagaagaagactggaccacaagatggtgcacagaggcttctgcgccgccctgagcaagcccaaggccatcagaagagcctgcaacccccaggagtgcagccagcccgtgtgggtgaccggcgagtgggagccctgcagccagacctgcggcagaaccggcatgcaggtgagaagcgtgagatgcatccagcccctgcacgacaacaccaccagaagcgtgcacgccaagcactgcaacgacgccagacccgagagcagaagagcctgcagcagagagctgtgccccggcagatggagagccggcccctggagccagtgcagcgtgacctgcggcaacggcacccaggagagacccgtgctgtgcagaaccgccgacgacagcttcggcatctgccaggaggagagacccgagaccgccagaacctgcagactgggcccctgccccagaaacatcagcgaccccagcaagaagagctacgtggtgcagtggctgagcagacccgaccccgacagccccatcagaaagatcagcagcaagggccactgccagggcgacaagagcatcttctgcagaatggaggtgctgagcagatactgcagcatccccggctacaacaagctgtgctgcaagagctgcaacctgtacaacaacctgaccaacgtggagggcagaatcgagcccccccccggcaagcacaacgacatcgacgtgttcatgcccaccctgcccgtgcccaccgtggccatggaggtgagacccagccccagcacccccctggaggtgcccctgaacgccagcagcaccaacgccaccgaggaccaccccgagaccaacgccgtggacgagccctacaagatccacggcctggaggacgaggtgcagccccccaacctgatccccagaagacccagcccctacgagaagaccagaaaccagagaatccaggagctgatcgacgagatgagaaagaaggagatgctgggcaagttctag

SEQ ID NO: 71852 - DNA, 1701 bp, Artificial Sequence
  Description of Artificial Sequence: Synthetic coding sequence
atggacccccccgccggcgccgccagaagactgctgtgccccgccctgctgctgctgctgctgctgctgcccccccccctgctgccccccccccccccccccgccaacgccagactggccgccgccgccgacccccccggcggccccctgggccacggcgccgagagaatcctggccgtgcccgtgagaaccgacgcccagggcagactggtgagccacgtggtgagcgccgccaccagcagagccggcgtgagagccagaagagccgcccccgtgagaacccccagcttccccggcggcaacgaggaggagcccggcagccacctgttctacaacgtgaccgtgttcggcagagacctgcacctgagactgagacccaacgccagactggtggcccccggcgccaccatggagtggcagggcgagaagggcaccaccagagtggagcccctgctgggcagctgcctgtacgtgggcgacgtggccggcctggccgaggccagcagcgtggccctgagcaactgcgacggcctggccggcctgatcagaatggaggaggaggagttcttcatcgagcccctggagaagggcctggccgcccaggaggccgagcagggcagagtgcacgtggtgtacagaagaccccccaccagcccccccctgggcggcccccaggccctggacaccggcgccagcctggacagcctggacagcctgagcagagccctgggcgtgctggaggagcacgccaacagcagcagaagaagagccagaagacacgccgccgacgacgactacaacatcgaggtgctgctgggcgtggacgacagcgtggtgcagttccacggcaaggagcacgtgcagaagtacctgctgaccctgatgaacatcgtgaacgagatctaccacgacgagagcctgggcgcccacatcaacgtggtgctggtgagaatcatcctgctgagctacggcaagagcatgagcctgatcgagatcggcaaccccagccagagcctggagaacgtgtgcagatgggcctacctgcagcagaagcccgacaccggccacgacgagtaccacgaccacgccatcttcctgaccagacaggacttcggccccagcggcatgcagggctacgcccccgtgaccggcatgtgccaccccgtgagaagctgcaccctgaaccacgaggacggcttcagcagcgccttcgtggtggcccacgagaccggccacgtgctgggcatggagcacgacggccagggcaacagatgcggcgacgaggtgagactgggcagcatcatggcccccctggtgcaggccgccttccacagattccactggagcagatgcagccagcaggagctgagcagatacctgcacagctacgactgcctgctggacgaccccttcgcccacgactggcccgccctgccccagctgcccggcctgcactacagcatgaacgagcagtgcagattcgacttcggcctgggctacatgatgtgcaccgccttcagaaccttcgacccctgcaagcagctgtggtgcagccaccccgacaacccctacttctgcaagaccaagaagggcccccccctggacggcaccatgtgcgcccccggcaagttcagacccggcgccgtggcccacgcctgctaccccagcaccctgggcggccagggcagatggatcgcctag

SEQ ID NO: 71853 - DNA, 4515 bp, Artificial Sequence
  Description of Artificial Sequence: Synthetic coding sequence
atgtgggtggccaagtggctgaccggcctgctgtaccacctgagcctgttcatcaccagaagctgggaggtggacttccaccccagacaggaggccctggtgagaaccctgaccagctacgaggtggtgatccccgagagagtgaacgagttcggcgaggtgttcccccagagccaccacttcagcagacagaagagaagcagcgaggccctggagcccatgcccttcagaacccactacagattcaccgcctacggccagctgttccagctgaacctgaccgccgacgccagcttcctggccgccggctacaccgaggtgcacctgggcacccccgagagaggcgcctgggagagcgacgccggccccagcgacctgagacactgcttctacagaggccaggtgaacagccaggaggactacaaggccgtggtgagcctgtgcggcggcctgaccggcaccttcaagggccagaacggcgagtacttcctggagcccatcatgaaggccgacggcaacgagtacgaggacggccacaacaagccccacctgatctacagacaggacctgaacaacagcttcctgcagaccctgaagtactgcagcgtgagcgagagccagatcaaggagaccagcctgcccttccacacctacagcaacatgaacgaggacctgaacgtgatgaaggagagagtgctgggccacaccagcaagaacgtgcccctgaaggacgagagaagacacagcagaaagaagagactgatcagctaccccagatacatcgagatcatggtgaccgccgacgccaaggtggtgagcgcccacggcagcaacctgcagaactacatcctgaccctgatgagcatcgtggccaccatctacaaggaccccagcatcggcaacctgatccacatcgtggtggtgaagctggtgatgatccacagagaggaggagggccccgtgatcaacttcgacggcgccaccaccctgaagaacttctgcagctggcagcagacccagaacgacctggacgacgtgcaccccagccaccacgacaccgccgtgctgatcaccagagaggacatctgcagcagcaaggagaagtgcaacatgctgggcctgagctacctgggcaccatctgcgaccccctgcagagctgcttcatcaacgaggagaagggcctgatcagcgccttcaccatcgcccacgagctgggccacaccctgggcgtgcagcacgacgacaaccccagatgcaaggagatgaaggtgaccaagtaccacgtgatggcccccgccctgagcttccacatgagcccctggagctggagcaactgcagcagaaagtacgtgaccgagttcctggacaccggctacggcgagtgcctgctggacaagcccgacgaggagatctacaacctgcccagcgagctgcccggcagcagatacgacggcaacaagcagtgcgagctggccttcggccccggcagccagatgtgcccccacatcaacatctgcatgcacctgtggtgcaccagcaccgagaagctgcacaagggctgcttcacccagcacgtgccccccgccgacggcaccgactgcggccccggcatgcactgcagacacggcctgtgcgtgaacaaggagaccgagaccagacccgtgaacggcgagtggggcccctgggagccctacagcagctgcagcagaacctgcggcggcggcatcgagagcgccaccagaagatgcaacagacccgagcccagaaacggcggcaactactgcgtgggcagaagaatgaagttcagaagctgcaacaccgacagctgccccaagggcacccaggacttcagagagaagcagtgcagcgacttcaacggcaagcacctggacatcagcggcatccccagcaacgtgagatggctgcccagatacagcggcatcggcaccaaggacagatgcaagctgtactgccaggtggccggcaccaactacttctacctgctgaaggacatggtggaggacggcaccccctgcggcaccgagagctacaacatcgactgcaactgcgtgctgaaggccgccggctgcgaccacgtgctgaacagcagcgccaagatcgacaagtgcggcgtgtgcggcggcgacaacagcagctgcaagaccatcaccggcgtgttcaacagcagccactacggctacaacgtggtggtgaagatccccgccggcgccaccaacgtggacatcagacagtacagctacagcggccagcccgacgacagctacctggccctgagcgacgccgagggcaacttcctgttcaacggcaacttcctgctgagcaccagcaagaaggagatcaacgtgcagggcaccagaaccgtgatcgagtacagcggcagcaacaacgccgtggagagaatcaacagcaccaacagacaggagaaggagatcctgatcgaggtgctgtgcgtgggcaacctgtacaaccccgacgtgcactacagcttcaacatccccctggaggagagaagcgacatgttcacctgggacccctacggcccctgggagggctgcaccaagatgtgccagggcctgcagagaagaaacatcacctgcatccacaagagcgaccacagcgtggtgagcgacaaggagtgcgaccacctgcccctgcccagcttcgtgacccagagctgcaacaccgactgcgagctgagatggcacgtgatcggcaagagcgagtgcagcagccagtgcggccagggctacagaaccctggacatccactgcatgaagtacagcatccacgagggccagaccgtgcaggtggacgaccactactgcggcgaccagctgaagccccccacccaggagctgtgccacggcaactgcgtgttcaccagatggcactacagcgagtggagccagtgcagcagaagctgcggcggcggcgagagaagcagagagagctactgcatgaacaacttcggccacagactggccgacaacgagtgccaggagctgagcagagtgaccagagagaactgcaacgagttcagctgccccagctgggccgccagcgagtggagcgagtgcctggtgacctgcggcaagggcaccaagcagagacaggtgtggtgccagctgaacgtggaccacctgagcgacggcttctgcaacagcagcaccaagcccgagagcctgagcccctgcgagctgcacacctgcgccagctggcaggtgggcccctggggcccctgcaccaccacctgcggccacggctaccagatgagagacgtgaagtgcgtgaacgagctggccagcgccgtgctggaggacaccgagtgccacgaggccagcagacccagcgacagacagagctgcgtgctgaccccctgcagcttcatcagcaagctggagaccgccctgctgcccaccgtgctgatcaagaagatggcccagtggagacacggcagctggaccccctgcagcgtgagctgcggcagaggcacccaggccagatacgtgagctgcagagacgccctggacagaatcgccgacgagagctactgcgcccacctgcccagacccgccgagatctgggactgcttcaccccctgcggcgagtggcaggccggcgactggagcccctgcagcgccagctgcggccacggcaagaccaccagacaggtgctgtgcatgaactaccaccagcccatcgacgagaactactgcgaccccgaggtgagacccctgatggagcaggagtgcagcctggccgcctgcccccccgcccacagccacttccccagcagccccgtgcagcccagctactacctgagcaccaacctgcccctgacccagaagctggaggacaacgagaaccaggtggtgcaccccagcgtgagaggcaaccagtggagaaccggcccctggggcagctgcagcagcagctgcagcggcggcctgcagcacagagccgtggtgtgccaggacgagaacggccagagcgccagctactgcgacgccgccagcaagccccccgagctgcagcagtgcggccccggcccctgcccccagtggaactacggcaactggggcgagtgcagccagacctgcggcggcggcatcaagagcagactggtgatctgccagttccccaacggccagatcctggaggaccacaactgcgagatcgtgaacaagccccccagcgtgatccagtgccacatgcacgcctgccccgccgacgtgagctggcaccaggagccctggaccagcgaggacctgaaggtgaagctgctgccccagagaaccatcatcctgtgggagctgatgaagaacatcttctgccacggcaagcacagccacatgtacctgatcaacgtggtgaccgaccacctgctgtaccccagacactgcgaccccgagaccatcgagacctacttcctgagcctgtggagcctgcagttcacctggggcgacctgaagtactacaagaacagcctgtag

SEQ ID NO: 71854 - DNA, 5733 bp, Artificial Sequence
  Description of Artificial Sequence: Synthetic coding sequence
atgtgggtggccaagtggctgaccggcctgctgtaccacctgagcctgttcatcaccagaagctgggaggtggacttccaccccagacaggaggccctggtgagaaccctgaccagctacgaggtggtgatccccgagagagtgaacgagttcggcgaggtgttcccccagagccaccacttcagcagacagaagagaagcagcgaggccctggagcccatgcccttcagaacccactacagattcaccgcctacggccagctgttccagctgaacctgaccgccgacgccagcttcctggccgccggctacaccgaggtgcacctgggcacccccgagagaggcgcctgggagagcgacgccggccccagcgacctgagacactgcttctacagaggccaggtgaacagccaggaggactacaaggccgtggtgagcctgtgcggcggcctgaccggcaccttcaagggccagaacggcgagtacttcctggagcccatcatgaaggccgacggcaacgagtacgaggacggccacaacaagccccacctgatctacagacaggacctgaacaacagcttcctgcagaccctgaagtactgcagcgtgagcgagagccagatcaaggagaccagcctgcccttccacacctacagcaacatgaacgaggacctgaacgtgatgaaggagagagtgctgggccacaccagcaagaacgtgcccctgaaggacgagagaagacacagcagaaagaagagactgatcagctaccccagatacatcgagatcatggtgaccgccgacgccaaggtggtgagcgcccacggcagcaacctgcagaactacatcctgaccctgatgagcatcgtggccaccatctacaaggaccccagcatcggcaacctgatccacatcgtggtggtgaagctggtgatgatccacagagaggaggagggccccgtgatcaacttcgacggcgccaccaccctgaagaacttctgcagctggcagcagacccagaacgacctggacgacgtgcaccccagccaccacgacaccgccgtgctgatcaccagagaggacatctgcagcagcaaggagaagtgcaacatgctgggcctgagctacctgggcaccatctgcgaccccctgcagagctgcttcatcaacgaggagaagggcctgatcagcgccttcaccatcgcccacgagctgggccacaccctgggcgtgcagcacgacgacaaccccagatgcaaggagatgaaggtgaccaagtaccacgtgatggcccccgccctgagcttccacatgagcccctggagctggagcaactgcagcagaaagtacgtgaccgagttcctggacaccggctacggcgagtgcctgctggacaagcccgacgaggagatctacaacctgcccagcgagctgcccggcagcagatacgacggcaacaagcagtgcgagctggccttcggccccggcagccagatgtgcccccacatcaacatctgcatgcacctgtggtgcaccagcaccgagaagctgcacaagggctgcttcacccagcacgtgccccccgccgacggcaccgactgcggccccggcatgcactgcagacacggcctgtgcgtgaacaaggagaccgagaccagacccgtgaacggcgagtggggcccctgggagccctacagcagctgcagcagaacctgcggcggcggcatcgagagcgccaccagaagatgcaacagacccgagcccagaaacggcggcaactactgcgtgggcagaagaatgaagttcagaagctgcaacaccgacagctgccccaagggcacccaggacttcagagagaagcagtgcagcgacttcaacggcaagcacctggacatcagcggcatccccagcaacgtgagatggctgcccagatacagcggcatcggcaccaaggacagatgcaagctgtactgccaggtggccggcaccaactacttctacctgctgaaggacatggtggaggacggcaccccctgcggcaccgagacccacgacatctgcgtgcagggccagtgcatggccgccggctgcgaccacgtgctgaacagcagcgccaagatcgacaagtgcggcgtgtgcggcggcgacaacagcagctgcaagaccatcaccggcgtgttcaacagcagccactacggctacaacgtggtggtgaagatccccgccggcgccaccaacgtggacatcagacagtacagctacagcggccagcccgacgacagctacctggccctgagcgacgccgagggcaacttcctgttcaacggcaacttcctgctgagcaccagcaagaaggagatcaacgtgcagggcaccagaaccgtgatcgagtacagcggcagcaacaacgccgtggagagaatcaacagcaccaacagacaggagaaggagctgatcctgcaggtgctgtgcgtgggcaacctgtacaaccccgacgtgcactacagcttcaacatccccctggaggagagaagcgacatgttcacctgggacccctacggcccctgggagggctgcaccaagatgtgccagggcctgcagagaagaaacatcacctgcatccacaagagcgaccacagcgtggtgagcgacaaggagtgcgaccacctgcccctgcccagcttcgtgacccagagctgcaacaccgactgcgagctgagatggcacgtgatcggcaagagcgagtgcagcagccagtgcggccagggctacagaaccctggacatccactgcatgaagtacagcatccacgagggccagaccgtgcaggtggacgaccactactgcggcgaccagctgaagccccccacccaggagctgtgccacggcaactgcgtgttcaccagatggcactacagcgagtggagccagtgcagcagaagctgcggcggcggcgagagaagcagagagagctactgcatgaacaacttcggccacagactggccgacaacgagtgccaggagctgagcagagtgaccagagagaactgcaacgagttcagctgccccagctgggccgccagcgagtggagcgagtgcctggtgacctgcggcaagggcaccaagcagagacaggtgtggtgccagctgaacgtggaccacctgagcgacggcttctgcaacagcagcaccaagcccgagagcctgagcccctgcgagctgcacacctgcgccagctggcaggtgggcccctggggcccctgcaccaccacctgcggccacggctaccagatgagagacgtgaagtgcgtgaacgagctggccagcgccgtgctggaggacaccgagtgccacgaggccagcagacccagcgacagacagagctgcgtgctgaccccctgcagcttcatcagcaagctggagaccgccctgctgcccaccgtgctgatcaagaagatggcccagtggagacacggcagctggaccccctgcagcgtgagctgcggcagaggcacccaggccagatacgtgagctgcagagacgccctggacagaatcgccgacgagagctactgcgcccacctgcccagacccgccgagatctgggactgcttcaccccctgcggcgagtggcaggccggcgactggagcccctgcagcgccagctgcggccacggcaagaccaccagacaggtgctgtgcatgaactaccaccagcccatcgacgagaactactgcgaccccgaggtgagacccctgatggagcaggagtgcagcctggccgcctgcccccccgcccacagccacttccccagcagccccgtgcagcccagctactacctgagcaccaacctgcccctgacccagaagctggaggacaacgagaaccaggtggtgcaccccagcgtgagaggcaaccagtggagaaccggcccctggggcagctgcagcagcagctgcagcggcggcctgcagcacagagccgtggtgtgccaggacgagaacggccagagcgccagctactgcgacgccgccagcaagccccccgagctgcagcagtgcggccccggcccctgcccccagtggaactacggcaactggggcgagtgcagccagacctgcggcggcggcatcaagagcagactggtgatctgccagttccccaacggccagatcctggaggaccacaactgcgagatcgtgaacaagccccccagcgtgatccagtgccacatgcacgcctgccccgccgacgtgagctggcaccaggagccctggaccagctgcagcgccagctgcggcaagggcagaaagtacagagaggtgttctgcatcgaccagttccagagaaagctggaggacaccaactgcagccaggtgcagaagccccccacccacaaggcctgcagaagcgtgagatgccccagctggaaggccaacagctggaacgagtgcagcgtgacctgcggcagcggcgtgcagcagagagacgtgtactgcagactgaagggcgtgggccaggtggtggaggagatgtgcgaccagagcaccagaccctgcagccagagaagatgctggagccaggactgcgtgcagcacaagggcatggagagaggcagactgaactgcagcaccagctgcgagagaaaggacagccaccagagaatggagtgcaccgacaaccagatcagacaggtgaacgagatcgtgtacaacagcagcaccatcagcctgaccagcaagaactgcagaaaccccccctgcaactacatcgtggtgaccgccgacagcagccagtgcgccaacaactgcggcttcagctacagacagagaatcacctactgcaccgagatccccagcaccaagaagcacaagctgcacagactgagacccatcgtgtaccaggagtgccccgtggtgcccagcagccaggtgtaccagtgcatcaacagctgcctgcacctggccacctggaaggtgggcaagtggagcaagtgcagcgtgacctgcggcatcggcatcatgaagagacaggtgaagtgcatcaccaagcacggcctgagcagcgacctgtgcctgaaccacctgaagcccggcgcccagaagaagtgctacgccaacgactgcaagagcttcaccacctgcaaggagatccaggtgaagaaccacatcagaaaggacggcgactactacctgaacatcaagggcagaatcatcaagatctactgcgccgacatgtacctggagaaccccaaggagtacctgaccctggtgcagggcgaggagaacttcagcgaggtgtacggcttcagactgaagaacccctaccagtgccccttcaacggcagcagaagagaggactgcgagtgcgacaacggccacctggccgccggctacaccgtgttcagcaagatcagaatcgacctgaccagcatgcagatcaagaccaccgacctgctgttcagcaagaccatcttcggcaacgccgtgcccttcgccaccgccggcgactgctacagcgccttcagatgcccccagggccagttcagcatcaacctgagcggcaccggcatgaagatcagcagcaccgccaagtggctgacccagggcagctacaccagcgtgagcatcagaagaagcgaggacggcaccagattcttcggcaagtgcggcggctactgcggcaagtgcctgccccacatgaccaccggcctgcccatccaggtgatctag

SEQ ID NO: 71855 - DNA, 1869 bp, Artificial Sequence
  Description of Artificial Sequence: Synthetic coding sequence
atgttcacctgggacccctacggcccctgggagggctgcaccaagatgtgccagggcctgcagagaagaaacatcacctgcatccacaagagcgaccacagcgtggtgagcgacaaggagtgcgaccacctgcccctgcccagcttcgtgacccagagctgcaacaccgactgcgagctgagatggcacgtgatcggcaagagcgagtgcagcagccagtgcggccagggctacagaaccctggacatccactgcatgaagtacagcatccacgagggccagaccgtgcaggtggacgaccactactgcggcgaccagctgaagccccccacccaggagctgtgccacggcaactgcgtgttcaccagatggcactacagcgagtggagccagtgcagcagaagctgcggcggcggcgagagaagcagagagagctactgcatgaacaacttcggccacagactggccgacaacgagtgccaggagctgagcagagtgaccagagagaactgcaacgagttcagctgccccagctgggccgccagcgagtggagcgagtgcctggtgacctgcggcaagggcaccaagcagagacaggtgtggtgccagctgaacgtggaccacctgagcgacggcttctgcaacagcagcaccaagcccgagagcctgagcccctgcgagctgcacacctgcgccagctggcaggtgggcccctggggcccctgcaccaccacctgcggccacggctaccagatgagagacgtgaagtgcgtgaacgagctggccagcgccgtgctggaggacaccgagtgccacgaggccagcagacccagcgacagacagtgcagcgtgagctgcggcagaggcacccaggccagatacgtgagctgcagagacgccctggacagaatcgccgacgagagctactgcgcccacctgcccagacccgccgagatctgggactgcttcaccccctgcggcgagtggcaggccggcgactggagcccctgcagcgccagctgcggccacggcaagaccaccagacaggtgctgtgcatgaactaccaccagcccatcgacgagaactactgcgaccccgaggtgagacccctgatggagcaggagtgcagcctggccgcctgcccccccgcccacagccacttccccagcagccccgtgcagcccagctactacctgagcaccaacctgcccctgacccagaagctggaggacaacgagaaccaggtggtgcaccccagcgtgagaggcaaccagtggagaaccggcccctggggcagctgcagcagcagctgcagcggcggcctgcagcacagagccgtggtgtgccaggacgagaacggccagagcgccagctactgcgacgccgccagcaagccccccgagctgcagcagtgcggccccggcccctgcccccagtggaactacggcaactggggcgagtgcagccagacctgcggcggcggcatcaagagcagactggtgatctgccagttccccaacggccagatcctggaggaccacaactgcgagatcgtgaacaagccccccagcgtgatccagtgccacatgcacgcctgccccgccgacgtgagctggcaccaggagccctggaccagcgaggacctgaaggtgaagctgctgccccagagaaccatcatcctgtgggagctgatgaagaacatcttctgccacggcaagcacagccacatgtacctgatcaacgtggtgaccgaccacctgctgtaccccagacactgcgaccccgagaccatcgagacctacttcctgagcctgtggagcctgcagttcacctggggcgacctgaagtactacaagaacagcctgtag

SEQ ID NO: 71856 - DNA, 4515 bp, Artificial Sequence
  Description of Artificial Sequence: Synthetic coding sequence
atgtgggtggccaagtggctgaccggcctgctgtaccacctgagcctgttcatcaccagaagctgggaggtggacttccaccccagacaggaggccctggtgagaaccctgaccagctacgaggtggtgatccccgagagagtgaacgagttcggcgaggtgttcccccagagccaccacttcagcagacagaagagaagcagcgaggccctggagcccatgcccttcagaacccactacagattcaccgcctacggccagctgttccagctgaacctgaccgccgacgccagcttcctggccgccggctacaccgaggtgcacctgggcacccccgagagaggcgcctgggagagcgacgccggccccagcgacctgagacactgcttctacagaggccaggtgaacagccaggaggactacaaggccgtggtgagcctgtgcggcggcctgaccggcaccttcaagggccagaacggcgagtacttcctggagcccatcatgaaggccgacggcaacgagtacgaggacggccacaacaagccccacctgatctacagacaggacctgaacaacagcttcctgcagaccctgaagtactgcagcgtgagcgagagccagatcaaggagaccagcctgcccttccacacctacagcaacatgaacgaggacctgaacgtgatgaaggagagagtgctgggccacaccagcaagaacgtgcccctgaaggacgagagaagacacagcagaaagaagagactgatcagctaccccagatacatcgagatcatggtgaccgccgacgccaaggtggtgagcgcccacggcagcaacctgcagaactacatcctgaccctgatgagcatcgtggccaccatctacaaggaccccagcatcggcaacctgatccacatcgtggtggtgaagctggtgatgatccacagagaggaggagggccccgtgatcaacttcgacggcgccaccaccctgaagaacttctgcagctggcagcagacccagaacgacctggacgacgtgcaccccagccaccacgacaccgccgtgctgatcaccagagaggacatctgcagcagcaaggagaagtgcaacatgctgggcctgagctacctgggcaccatctgcgaccccctgcagagctgcttcatcaacgaggagaagggcctgatcagcgccttcaccatcgcccacgagctgggccacaccctgggcgtgcagcacgacgacaaccccagatgcaaggagatgaaggtgaccaagtaccacgtgatggcccccgccctgagcttccacatgagcccctggagctggagcaactgcagcagaaagtacgtgaccgagttcctggacaccggctacggcgagtgcctgctggacaagcccgacgaggagatctacaacctgcccagcgagctgcccggcagcagatacgacggcaacaagcagtgcgagctggccttcggccccggcagccagatgtgcccccacatcaacatctgcatgcacctgtggtgcaccagcaccgagaagctgcacaagggctgcttcacccagcacgtgccccccgccgacggcaccgactgcggccccggcatgcactgcagacacggcctgtgcgtgaacaaggagaccgagaccagacccgtgaacggcgagtggggcccctgggagccctacagcagctgcagcagaacctgcggcggcggcatcgagagcgccaccagaagatgcaacagacccgagcccagaaacggcggcaactactgcgtgggcagaagaatgaagttcagaagctgcaacaccgacagctgccccaagggcacccaggacttcagagagaagcagtgcagcgacttcaacggcaagcacctggacatcagcggcatccccagcaacgtgagatggctgcccagatacagcggcatcggcaccaaggacagatgcaagctgtactgccaggtggccggcaccaactacttctacctgctgaaggacatggtggaggacggcaccccctgcggcaccgagacccacgacatctgcgtgcagggccagtgcatggccgccggctgcgaccacgtgctgaacagcagcgccaagatcgacaagtgcggcgtgtgcggcggcgacaacagcagctgcaagaccatcaccggcgtgttcaacagcagccactacggctacaacgtggtggtgaagatccccgccggcgccaccaacgtggacatcagacagtacagctacagcggccagcccgacgacagctacctggccctgagcgacgccgagggcaacttcctgttcaacggcaacttcctgctgagcaccagcaagaaggagatcaacgtgcagggcaccagaaccgtgatcgagtacagcggcagcaacaacgccgtggagagaatcaacagcaccaacagacaggagaaggagctgatcctgcaggtgctgtgcgtgggcaacctgtacaaccccgacgtgcactacagcttcaacatccccctggaggagagaagcgacatgttcacctgggacccctacggcccctgggagggctgcaccaagatgtgccagggcctgcagagaagaaacatcacctgcatccacaagagcgaccacagcgtggtgagcgacaaggagtgcgaccacctgcccctgcccagcttcgtgacccagagctgcaacaccgactgcgagctgagatggcacgtgatcggcaagagcgagtgcagcagccagtgcggccagggctacagaaccctggacatccactgcatgaagtacagcatccacgagggccagaccgtgcaggtggacgaccactactgcggcgaccagctgaagccccccacccaggagctgtgccacggcaactgcgtgttcaccagatggcactacagcgagtggagccagtgcagcagaagctgcggcggcggcgagagaagcagagagagctactgcatgaacaacttcggccacagactggccgacaacgagtgccaggagctgagcagagtgaccagagagaactgcaacgagttcagctgccccagctgggccgccagcgagtggagcgagtgcctggtgacctgcggcaagggcaccaagcagagacaggtgtggtgccagctgaacgtggaccacctgagcgacggcttctgcaacagcagcaccaagcccgagagcctgagcccctgcgagctgcacacctgcgccagctggcaggtgggcccctggggcccctgcaccaccacctgcggccacggctaccagatgagagacgtgaagtgcgtgaacgagctggccagcgccgtgctggaggacaccgagtgccacgaggccagcagacccagcgacagacagagctgcgtgctgaccccctgcagcttcatcagcaagctggagaccgccctgctgcccaccgtgctgatcaagaagatggcccagtggagacacggcagctggaccccctgcagcgtgagctgcggcagaggcacccaggccagatacgtgagctgcagagacgccctggacagaatcgccgacgagagctactgcgcccacctgcccagacccgccgagatctgggactgcttcaccccctgcggcgagtggcaggccggcgactggagcccctgcagcgccagctgcggccacggcaagaccaccagacaggtgctgtgcatgaactaccaccagcccatcgacgagaactactgcgaccccgaggtgagacccctgatggagcaggagtgcagcctggccgcctgcccccccgcccacagccacttccccagcagccccgtgcagcccagctactacctgagcaccaacctgcccctgacccagaagctggaggacaacgagaaccaggtggtgcaccccagcgtgagaggcaaccagtggagaaccggcccctggggcagctgcagcagcagctgcagcggcggcctgcagcacagagccgtggtgtgccaggacgagaacggccagagcgccagctactgcgacgccgccagcaagccccccgagctgcagcagtgcggccccggcccctgcccccagtggaactacggcaactggggcgagtgcagccagacctgcggcggcggcatcaagagcagactggtgatctgccagttccccaacggccagatcctggaggaccacaactgcgagatcgtgaacaagccccccagcgtgatccagtgccacatgcacgcctgccccgccgacgtgagctggcaccaggagccctggaccagcgaggacctgaaggtgaagctgctgccccagagaaccatcatcctgtgggagctgatgaagaacatcttctgccacggcaagcacagccacatgtacctgatcaacgtggtgaccgaccacctgctgtaccccagacactgcgaccccgagaccatcgagacctacttcctgagcctgtggagcctgcagttcacctggggcgacctgaagtactacaagaacagcctgtag

SEQ ID NO: 71857 - DNA, 3618 bp, Artificial Sequence
  Description of Artificial Sequence: Synthetic coding sequence
atggtgctgctgagcctgtggctgatcgccgccgccctggtggaggtgagaaccagcgccgacggccaggccggcaacgaggagatggtgcagatcgacctgcccatcaagagatacagagagtacgagctggtgacccccgtgagcaccaacctggagggcagatacctgagccacaccctgagcgccagccacaagaagagaagcgccagagacgtgagcagcaaccccgagcagctgttcttcaacatcaccgccttcggcaaggacttccacctgagactgaagcccaacacccagctggtggcccccggcgccgtggtggagtggcacgagaccagcctggtgcccggcaacatcaccgaccccatcaacaaccaccagcccggcagcgccacctacagaatcagaagaaccgagcccctgcagaccaactgcgcctacgtgggcgacatcgtggacatccccggcaccagcgtggccatcagcaactgcgacggcctggccggcatgatcaagagcgacaacgaggagtacttcatcgagcccctggagagaggcaagcagatggaggaggagaagggcagaatccacgtggtgtacaagagaagcgccgtggagcaggcccccatcgacatgagcaaggacttccactacagagagagcgacctggagggcctggacgacctgggcaccgtgtacggcaacatccaccagcagctgaacgagaccatgagaagaagaagacacgccggcgagaacgactacaacatcgaggtgctgctgggcgtggacgacagcgtggtgagattccacggcaaggagcacgtgcagaactacctgctgaccctgatgaacatcgtgaacgagatctaccacgacgagagcctgggcgtgcacatcaacgtggtgctggtgagaatgatcatgctgggctacgccaagagcatcagcctgatcgagagaggcaaccccagcagaagcctggagaacgtgtgcagatgggccagccagcagcagagaagcgacctgaaccacagcgagcaccacgaccacgccatcttcctgaccagacaggacttcggccccgccggcatgcagggctacgcccccgtgaccggcatgtgccaccccgtgagaagctgcaccctgaaccacgaggacggcttcagcagcgccttcgtggtggcccacgagaccggccacgtgctgggcatggagcacgacggccagggcaacagatgcggcgacgagaccgccatgggcagcgtgatggcccccctggtgcaggccgccttccacagataccactggagcagatgcagcggccaggagctgaagagatacatccacagctacgactgcctgctggacgaccccttcgaccacgactggcccaagctgcccgagctgcccggcatcaactacagcatggacgagcagtgcagattcgacttcggcgtgggctacaagatgtgcaccgccttcagaaccttcgacccctgcaagcagctgtggtgcagccaccccgacaacccctacttctgcaagaccaagaagggcccccccctggacggcaccgagtgcgccgccggcaagtggtgctacaagggccactgcatgtggaagaacgccaaccagcagaagcaggacggcaactggggcagctggaccaagttcggcagctgcagcagaacctgcggcaccggcgtgagattcagaaccagacagtgcaacaaccccatgcccatcaacggcggccaggactgccccggcgtgaacttcgagtaccagctgtgcaacaccgaggagtgccagaagcacttcgaggacttcagagcccagcagtgccagcagagaaacagccacttcgagtaccagaacaccaagcaccactggctgccctacgagcaccccgaccccaagaagagatgccacctgtactgccagagcaaggagaccggcgacgtggcctacatgaagcagctggtgcacgacggcacccactgcagctacaaggacccctacagcatctgcgtgagaggcgagtgcgtgaaggtgggctgcgacaaggagatcggcagcaacaaggtggaggacaagtgcggcgtgtgcggcggcgacaacagccactgcagaaccgtgaagggcaccttcaccagaacccccagaaagctgggctacctgaagatgttcgacatcccccccggcgccagacacgtgctgatccaggaggacgaggccagcccccacatcctggccatcaagaaccaggccaccggccactacatcctgaacggcaagggcgaggaggccaagagcagaaccttcatcgacctgggcgtggagtgggactacaacatcgaggacgacatcgagagcctgcacaccgacggccccctgcacgaccccgtgatcgtgctgatcatcccccaggagaacgacaccagaagcagcctgacctacaagtacatcatccacgaggacagcgtgcccaccatcaacagcaacaacgtgatccaggaggagctggacaccttcgagtgggccctgaagagctggagccagtgcagcaagccctgcggcggcggcttccagtacaccaagtacggctgcagaagaaagagcgacaacaagatggtgcacagaagcttctgcgaggccaacaagaagcccaagcccatcagaagaatgtgcaacatccaggagtgcacccaccccctgtgggtggccgaggagtgggagcactgcaccaagacctgcggcagcagcggctaccagctgagaaccgtgagatgcctgcagcccctgctggacggcaccaacagaagcgtgcacagcaagtactgcatgggcgacagacccgagagcagaagaccctgcaacagagtgccctgccccgcccagtggaagaccggcccctggagcgagtgcagcgtgacctgcggcgagggcaccgaggtgagacaggtgctgtgcagagccggcgaccactgcgacggcgagaagcccgagagcgtgagagcctgccagctgcccccctgcaacgacgagccctgcctgggcgacaagagcatcttctgccagatggaggtgctggccagatactgcagcatccccggctacaacaagctgtgctgcgagagctgcagcaagagaagcagcaccctgccccccccctacctgctggaggccgccgagacccacgacgacgtgatcagcaaccccagcgacctgcccagaagcctggtgatgcccaccagcctggtgccctaccacagcgagacccccgccaagaagatgagcctgagcagcatcagcagcgtgggcggccccaacgcctacgccgccttcagacccaacagcaagcccgacggcgccaacctgagacagagaagcgcccagcaggccggcagcaagaccgtgagactggtgaccgtgcccagcagcccccccaccaagagagtgcacctgagcagcgccagccagatggccgccgccagcttcttcgccgccagcgacagcatcggcgccagcagccaggccagaaccagcaagaaggacggcaagatcatcgacaacagaagacccaccagaagcagcaccctggagagatag

SEQ ID NO: 71858 - DNA, 1020 bp, Artificial Sequence
  Description of Artificial Sequence: Synthetic coding sequence
atgagccagaccggcagccaccccggcagaggcctggccggcagatggctgtggggcgcccagccctgcctgctgctgcccatcgtgcccctgagctggctggtgtggctgctgctgctgctgctggccagcctgctgcccagcgccagactggccagccccctgcccagagaggaggagatcgtgttccccgagaagctgaacggcagcgtgctgcccggcagcggcgcccccgccagactgctgtgcagactgcaggccttcggcgagaccctgctgctggagctggagcaggacagcggcgtgcaggtggagggcctgaccgtgcagtacctgggccaggcccccgagctgctgggcggcgccgagcccggcacctacctgaccggcaccatcaacggcgaccccgagagcgtggccagcctgcactgggacggcggcgccctgctgggcgtgctgcagtacagaggcgccgagctgcacctgcagcccctggagggcggcacccccaacagcgccggcggccccggcgcccacatcctgagaagaaagagccccgccagcggccagggccccatgtgcaacgtgaaggcccccctgggcagccccagccccagacccagaagagccaagagattcgccagcctgagcagattcgtggagaccctggtggtggccgacgacaagatggccgccttccacggcgccggcctgaagagatacctgctgaccgtgatggccgccgccgccaaggccttcaagcaccccagcatcagaaaccccgtgagcctggtggtgaccagactggtgatcctgggcagcggcgaggagggcccccaggtgggccccagcgccgcccagaccctgagaagcttctgcgcctggcagagaggcctgaacacccccgaggacagcgaccccgaccacttcgacaccgccatcctgttcaccagacaggtgagaccccagagcgccccccaggccatgcactgcaccatcctgagaagcgccaccacctag

SEQ ID NO: 71859 - DNA, 2514 bp, Artificial Sequence
  Description of Artificial Sequence: Synthetic coding sequence
atgagccagaccggcagccaccccggcagaggcctggccggcagatggctgtggggcgcccagccctgcctgctgctgcccatcgtgcccctgagctggctggtgtggctgctgctgctgctgctggccagcctgctgcccagcgccagactggccagccccctgcccagagaggaggagatcgtgttccccgagaagctgaacggcagcgtgctgcccggcagcggcgcccccgccagactgctgtgcagactgcaggccttcggcgagaccctgctgctggagctggagcaggacagcggcgtgcaggtggagggcctgaccgtgcagtacctgggccaggcccccgagctgctgggcggcgccgagcccggcacctacctgaccggcaccatcaacggcgaccccgagagcgtggccagcctgcactgggacggcggcgccctgctgggcgtgctgcagtacagaggcgccgagctgcacctgcagcccctggagggcggcacccccaacagcgccggcggccccggcgcccacatcctgagaagaaagagccccgccagcggccagggccccatgtgcaacgtgaaggcccccctgggcagccccagccccagacccagaagagccaagagattcgccagcctgagcagattcgtggagaccctggtggtggccgacgacaagatggccgccttccacggcgccggcctgaagagatacctgctgaccgtgatggccgccgccgccaaggccttcaagcaccccagcatcagaaaccccgtgagcctggtggtgaccagactggtgatcctgggcagcggcgaggagggcccccaggtgggccccagcgccgcccagaccctgagaagcttctgcgcctggcagagaggcctgaacacccccgaggacagcgaccccgaccacttcgacaccgccatcctgttcaccagacaggacctgtgcggcgtgagcacctgcgacaccctgggcatggccgacgtgggcaccgtgtgcgaccccgccagaagctgcgccatcgtggaggacgacggcctgcagagcgccttcaccgccgcccacgagctgggccacgtgttcaacatgctgcacgacaacagcaagccctgcatcagcctgaacggccccctgagcaccagcagacacgtgatggcccccgtgatggcccacgtggaccccgaggagccctggagcccctgcagcgccagattcatcaccgacttcctggacaacggctacggccactgcctgctggacaagcccgaggcccccctgcacctgcccgtgaccttccccggcaaggactacgacgccgacagacagtgccagctgaccttcggccccgacagcagacactgcccccagctgccccccccctgcgccgccctgtggtgcagcggccacctgaacggccacgccatgtgccagaccaagcacagcccctgggccgacggcaccccctgcggccccgcccaggcctgcatgggcggcagatgcctgcacatggaccagctgcaggacttcaacatcccccaggccggcggctggggcccctggggcccctggggcgactgcagcagaacctgcggcggcggcgtgcagttcagcagcagagactgcaccagacccgtgcccagaaacggcggcaagtactgcgagggcagaagaaccagattcagaagctgcaacaccgaggactgccccaccggcagcgccctgaccttcagagaggagcagtgcgccgcctacaaccacagaaccgacctgttcaagagcttccccggccccatggactgggtgcccagatacaccggcgtggccccccaggaccagtgcaagctgacctgccaggcccaggccctgggctactactacgtgctggagcccagagtggtggacggcaccccctgcagccccgacagcagcagcgtgtgcgtgcagggcagatgcatccacgccggctgcgacagaatcatcggcagcaagaagaagttcgacaagtgcatggtgtgcggcggcgacggcagcggctgcagcaagcagagcggcagcttcagaaagttcagatacggctacaacaacgtggtgaccatccccgccggcgccacccacatcctggtgagacagcagggcaaccccggccacagaagcatctacctggccctgaagctgcccgacggcagctacgccctgaacggcgagtacaccctgatgcccagccccaccgacgtggtgctgcccggcgccgtgagcctgagatacagcggcgccaccgccgccagcgagaccctgagcggccacggccccctggcccagcccctgaccctgcaggtgctggtggccggcaacccccaggacaccagactgagatacagcttcttcgtgcccagacccacccccagcacccccagacccaccccccaggactggctgcacagaagagcccagatcctggagatcctgagaagaagaccctgggccggcagaaagtag

SEQ ID NO: 71860 - DNA, 2793 bp, Artificial Sequence
  Description of Artificial Sequence: Synthetic coding sequence
atgctgctgggctgggccagcctgctgctgtgcgccttcagactgcccctggccgccgtgggccccgccgccacccccgcccaggacaaggccggccagccccccaccgccgccgccgccgcccagcccagaagaagacagggcgaggaggtgcaggagagagccgagccccccggccacccccaccccctggcccagagaagaagaagcaagggcctggtgcagaacatcgaccagctgtacagcggcggcggcaaggtgggctacctggtgtacgccggcggcagaagattcctgctggacctggagagagacggcagcgtgggcatcgccggcttcgtgcccgccggcggcggcaccagcgccccctggagacacagaagccactgcttctacagaggcaccgtggacggcagccccagaagcctggccgtgttcgacctgtgcggcggcctggacggcttcttcgccgtgaagcacgccagatacaccctgaagcccctgctgagaggcccctgggccgaggaggagaagggcagagtgtacggcgacggcagcgccagaatcctgcacgtgtacaccagagagggcttcagcttcgaggccctgccccccagagccagctgcgagacccccgccagcacccccgaggcccacgagcacgcccccgcccacagcaaccccagcggcagagccgccctggccagccagctgctggaccagagcgccctgagccccgccggcggcagcggcccccagacctggtggagaagaagaagaagaagcatcagcagagccagacaggtggagctgctgctggtggccgacgccagcatggccagactgtacggcagaggcctgcagcactacctgctgaccctggccagcatcgccaacagactgtacagccacgccagcatcgagaaccacatcagactggccgtggtgaaggtggtggtgctgggcgacaaggacaagagcctggaggtgagcaagaacgccgccaccaccctgaagaacttctgcaagtggcagcaccagcacaaccagctgggcgacgaccacgaggagcactacgacgccgccatcctgttcaccagagaggacctgtgcggccaccacagctgcgacaccctgggcatggccgacgtgggcaccatctgcagccccgagagaagctgcgccgtgatcgaggacgacggcctgcacgccgccttcaccgtggcccacgagatcggccacctgctgggcctgagccacgacgacagcaagttctgcgaggagaccttcggcagcaccgaggacaagagactgatgagcagcatcctgaccagcatcgacgccagcaagccctggagcaagtgcaccagcgccaccatcaccgagttcctggacgacggccacggcaactgcctgctggacctgcccagaaagcagatcctgggccccgaggagctgcccggccagacctacgacgccacccagcagtgcaacctgaccttcggccccgagtacagcgtgtgccccggcatggacgtgtgcgccagactgtggtgcgccgtggtgagacagggccagatggtgtgcctgaccaagaagctgcccgccgtggagggcaccccctgcggcaagggcagaatctgcctgcagggcaagtgcgtggacaagaccaagaagaagtactacagcaccagcagccacggcaactggggcagctggggcagctggggccagtgcagcagaagctgcggcggcggcgtgcagttcgcctacagacactgcaacaaccccgcccccagaaacaacggcagatactgcaccggcaagagagccatctacagaagctgcagcctgatgccctgcccccccaacggcaagagcttcagacacgagcagtgcgaggccaagaacggctaccagagcgacgccaagggcgtgaagaccttcgtggagtgggtgcccaagtacgccggcgtgctgcccgccgacgtgtgcaagctgacctgcagagccaagggcaccggctactacgtggtgttcagccccaaggtgaccgacggcaccgagtgcagactgtacagcaacagcgtgtgcgtgagaggcaagtgcgtgagaaccggctgcgacggcatcatcggcagcaagctgcagtacgacaagtgcggcgtgtgcggcggcgacaacagcagctgcaccaagatcgtgggcaccttcaacaagaagagcaagggctacaccgacgtggtgagaatccccgagggcgccacccacatcaaggtgagacagttcaaggccaaggaccagaccagattcaccgcctacctggccctgaagaagaagaacggcgagtacctgatcaacggcaagtacatgatcagcaccagcgagaccatcatcgacatcaacggcaccgtgatgaactacagcggctggagccacagagacgacttcctgcacggcatgggctacagcgccaccaaggagatcctgatcgtgcagatcctggccaccgaccccaccaagcccctggacgtgagatacagcttcttcgtgcccaagaagagcacccccaaggtgaacagcgtgaccagccacggcagcaacaaggtgggcagccacaccagccagccccagtgggtgaccggcccctggctggcctgcagcagaacctgcgacaccggctggcacaccagaaccgtgcagtgccaggacggcaacagaaagctggccaagggctgccccctgagccagagacccagcgccttcaagcagtgcctgctgaagaagtgctag

SEQ ID NO: 71861 - DNA, 2577 bp, Artificial Sequence
  Description of Artificial Sequence: Synthetic coding sequence
atggagatcctgtggaagaccctgacctggatcctgagcctgatcatggccagcagcgagttccacagcgaccacagactgagctacagcagccaggaggagttcctgacctacctggagcactaccagctgaccatccccatcagagtggaccagaacggcgccttcctgagcttcaccgtgaagaacgacaagcacagcagaagaagaagaagcatggaccccatcgacccccagcaggccgtgagcaagctgttcttcaagctgagcgcctacggcaagcacttccacctgaacctgaccctgaacaccgacttcgtgagcaagcacttcaccgtggagtactggggcaaggacggcccccagtggaagcacgacttcctggacaactgccactacaccggctacctgcaggaccagagaagcaccaccaaggtggccctgagcaactgcgtgggcctgcacggcgtgatcgccaccgaggacgaggagtacttcatcgagcccctgaagaacaccaccgaggacagcaagcacttcagctacgagaacggccacccccacgtgatctacaagaagagcgccctgcagcagagacacctgtacgaccacagccactgcggcgtgagcgacttcaccagaagcggcaagccctggtggctgaacgacaccagcaccgtgagctacagcctgcccatcaacaacacccacatccaccacagacagaagagaagcgtgagcatcgagagattcgtggagaccctggtggtggccgacaagatgatggtgggctaccacggcagaaaggacatcgagcactacatcctgagcgtgatgaacatcgtggccaagctgtacagagacagcagcctgggcaacgtggtgaacatcatcgtggccagactgatcgtgctgaccgaggaccagcccaacctggagatcaaccaccacgccgacaagagcctggacagcttctgcaagtggcagaagagcatcctgagccaccagagcgacggcaacaccatccccgagaacggcatcgcccaccacgacaacgccgtgctgatcaccagatacgacatctgcacctacaagaacaagccctgcggcaccctgggcctggccagcgtggccggcatgtgcgagcccgagagaagctgcagcatcaacgaggacatcggcctgggcagcgccttcaccatcgcccacgagatcggccacaacttcggcatgaaccacgacggcatcggcaacagctgcagaaaggtgatgaagcagcagtacggcagcagccactactgcgagtaccagagcttcttcctggtgtgcctgcagagcagactgcaccaccagctgagcagagaggtgtgcagagagctgtggtgcctgagcaagagcaacagatgcgtgaccaacagcatccccgccgccgagggcaccctgtgccagaccggcaacatcgagaagggctggtgctaccagggcgactgcgtgcccttcggcacctggccccagagcatcgacggcggctggggcccctggagcctgtggggcgagtgcagcagaacctgcggcggcggcgtgagcagcagcctgagacactgcgacagccccgcccccagcggcggcggcaagtactgcctgggcgagagaaagagatacagaagctgcaacaccgacccctgccccctgggcagcagagacttcagagagaagcagtgcgccgacttcgacaacatgcccttcagaggcaagtactacaactggaagccctacaccggcggcggcgtgaagccctgcgccctgaactgcctggccgagggctacaacttctacaccgagagagcccccgccgtgatcgacggcacccagtgcaacgccgacagcctggacatctgcatcaacggcgagtgcaagcacgtgggctgcgacaacatcctgggcagcgacgccagagaggacagatgcagagtgtgcggcggcgacggcagcacctgcgacgccatcgagggcttcttcaacgacagcctgcccagaggcggctacatggaggtggtgcagatccccagaggcagcgtgcacatcgaggtgagagaggtggccatgagcaagaactacatcgccctgaagagcgagggcgacgactactacatcaacggcgcctggaccatcgactggcccagaaagttcgacgtggccggcaccgccttccactacaagagacccaccgacgagcccgagagcctggaggccctgggccccaccagcgagaacctgatcgtgatggtgctgctgcaggagcagaacctgggcatcagatacaagttcaacgtgcccatcaccagaaccggcagcggcgacaacgaggtgggcttcacctggaaccaccagccctggagcgagtgcagcgccacctgcgccggcggcaagatgcccaccagacagcccacccagagagccagatggagaaccaagcacatcctgagctacgccctgtgcctgctgaagaagctgatcggcaacatcagctgcagattcgccagcagctgcaacctggccaaggagaccctgctgtag

SEQ ID NO: 71862 - DNA, 3354 bp, Artificial Sequence
  Description of Artificial Sequence: Synthetic coding sequence
atggagatcctgtggaagaccctgacctggatcctgagcctgatcatggccagcagcgagttccacagcgaccacagactgagctacagcagccaggaggagttcctgacctacctggagcactaccagctgaccatccccatcagagtggaccagaacggcgccttcctgagcttcaccgtgaagaacgacaagcacagcagaagaagaagaagcatggaccccatcgacccccagcaggccgtgagcaagctgttcttcaagctgagcgcctacggcaagcacttccacctgaacctgaccctgaacaccgacttcgtgagcaagcacttcaccgtggagtactggggcaaggacggcccccagtggaagcacgacttcctggacaactgccactacaccggctacctgcaggaccagagaagcaccaccaaggtggccctgagcaactgcgtgggcctgcacggcgtgatcgccaccgaggacgaggagtacttcatcgagcccctgaagaacaccaccgaggacagcaagcacttcagctacgagaacggccacccccacgtgatctacaagaagagcgccctgcagcagagacacctgtacgaccacagccactgcggcgtgagcgacttcaccagaagcggcaagccctggtggctgaacgacaccagcaccgtgagctacagcctgcccatcaacaacacccacatccaccacagacagaagagaagcgtgagcatcgagagattcgtggagaccctggtggtggccgacaagatgatggtgggctaccacggcagaaaggacatcgagcactacatcctgagcgtgatgaacatcgtggccaagctgtacagagacagcagcctgggcaacgtggtgaacatcatcgtggccagactgatcgtgctgaccgaggaccagcccaacctggagatcaaccaccacgccgacaagagcctggacagcttctgcaagtggcagaagagcatcctgagccaccagagcgacggcaacaccatccccgagaacggcatcgcccaccacgacaacgccgtgctgatcaccagatacgacatctgcacctacaagaacaagccctgcggcaccctgggcctggccagcgtggccggcatgtgcgagcccgagagaagctgcagcatcaacgaggacatcggcctgggcagcgccttcaccatcgcccacgagatcggccacaacttcggcatgaaccacgacggcatcggcaacagctgcggcaccaagggccacgaggccgccaagctgatggccgcccacatcaccgccaacaccaaccccttcagctggagcgcctgcagcagagactacatcaccagcttcctggacagcggcagaggcacctgcctggacaacgagccccccaagagagacttcctgtaccccgccgtggcccccggccaggtgtacgacgccgacgagcagtgcagattccagtacggcgccaccagcagacagtgcaagtacggcgaggtgtgcagagagctgtggtgcctgagcaagagcaacagatgcgtgaccaacagcatccccgccgccgagggcaccctgtgccagaccggcaacatcgagaagggctggtgctaccagggcgactgcgtgcccttcggcacctggccccagagcatcgacggcggctggggcccctggagcctgtggggcgagtgcagcagaacctgcggcggcggcgtgagcagcagcctgagacactgcgacagccccgcccccagcggcggcggcaagtactgcctgggcgagagaaagagatacagaagctgcaacaccgacccctgccccctgggcagcagagacttcagagagaagcagtgcgccgacttcgacaacatgcccttcagaggcaagtactacaactggaagccctacaccggcggcggcgtgaagccctgcgccctgaactgcctggccgagggctacaacttctacaccgagagagcccccgccgtgatcgacggcacccagtgcaacgccgacagcctggacatctgcatcaacggcgagtgcaagcacgtgggctgcgacaacatcctgggcagcgacgccagagaggacagatgcagagtgtgcggcggcgacggcagcacctgcgacgccatcgagggcttcttcaacgacagcctgcccagaggcggctacatggaggtggtgcagatccccagaggcagcgtgcacatcgaggtgagagaggtggccatgagcaagaactacatcgccctgaagagcgagggcgacgactactacatcaacggcgcctggaccatcgactggcccagaaagttcgacgtggccggcaccgccttccactacaagagacccaccgacgagcccgagagcctggaggccctgggccccaccagcgagaacctgatcgtgatggtgctgctgcaggagcagaacctgggcatcagatacaagttcaacgtgcccatcaccagaaccggcagcggcgacaacgaggtgggcttcacctggaaccaccagccctggagcgagtgcagcgccacctgcgccggcggcgtgcagagacaggaggtggtgtgcaagagactggacgacaacagcatcgtgcagaacaactactgcgaccccgacagcaagccccccgagaaccagagagcctgcaacaccgagccctgcccccccgagtggttcatcggcgactggctggagtgcagcaagacctgcgacggcggcatgagaaccagagccgtgctgtgcatcagaaagatcggccccagcgaggaggagaccctggactacagcggctgcctgacccacagacccgtggagaaggagccctgcaacaaccagagctgccccccccagtgggtggccctggactggagcgagtgcacccccaagtgcggccccggcttcaagcacagaatcgtgctgtgcaagagcagcgacctgagcaagaccttccccgccgcccagtgccccgaggagagcaagccccccgtgagaatcagatgcagcctgggcagatgccccccccccagatgggtgaccggcgactggggccagtgcagcgcccagtgcggcctgggccagcagatgagaaccgtgcagtgcctgagctacaccggccaggccagcagcgactgcctggagaccgtgagaccccccagcatgcagcagtgcgagagcaagtgcgacagcacccccatcagcaacaccgaggagtgcaaggacgtgaacaaggtggcctactgccccctggtgctgaagttcaagttctgcagcagagcctacttcagacagatgtgctgcaagacctgccagggccactag

SEQ ID NO: 71863 - DNA, 1407 bp, Artificial Sequence
  Description of Artificial Sequence: Synthetic coding sequence
atggagatcctgtggaagaccctgacctggatcctgagcctgatcatggccagcagcgagttccacagcgaccacagactgagctacagcagccaggaggagttcctgacctacctggagcactaccagctgaccatccccatcagagtggaccagaacggcgccttcctgagcttcaccgtgaagaacgacaagcacagcagaagaagaagaagcatggaccccatcgacccccagcaggccgtgagcaagctgttcttcaagctgagcgcctacggcaagcacttccacctgaacctgaccctgaacaccgacttcgtgagcaagcacttcaccgtggagtactggggcaaggacggcccccagtggaagcacgacttcctggacaactgccactacaccggctacctgcaggaccagagaagcaccaccaaggtggccctgagcaactgcgtgggcctgcacggcgtgatcgccaccgaggacgaggagtacttcatcgagcccctgaagaacaccaccgaggacagcaagcacttcagctacgagaacggccacccccacgtgatctacaagaagagcgccctgcagcagagacacctgtacgaccacagccactgcggcgtgagcgacttcaccagaagcggcaagccctggtggctgaacgacaccagcaccgtgagctacagcctgcccatcaacaacacccacatccaccacagacagaagagaagcgtgagcatcgagagattcgtggagaccctggtggtggccgacaagatgatggtgggctaccacggcagaaaggacatcgagcactacatcctgagcgtgatgaacatcgtggccaagctgtacagagacagcagcctgggcaacgtggtgaacatcatcgtggccagactgatcgtgctgaccgaggaccagcccaacctggagatcaaccaccacgccgacaagagcctggacagcttctgcaagtggcagaagagcatcctgagccaccagagcgacggcaacaccatccccgagaacggcatcgcccaccacgacaacgccgtgctgatcaccagatacgacatctgcacctacaagaacaagccctgcggcaccctgggcctggccagcgtggccggcatgtgcgagcccgagagaagctgcagcatcaacgaggacatcggcctgggcagcgccttcaccatcgcccacgagatcggccacaacttcggcatgaaccacgacggcatcggcaacagctgcggcaccaagggccacgaggccgccaagctgatggccgcccacatcaccgccaacaccaaccccttcagctggagcgcctgcagcagagactacatcaccagcttcctggagttcctgaagctgggcgacagcatcagcggcagctag

SEQ ID NO: 71864 - DNA, 5061 bp, Artificial Sequence
  Description of Artificial Sequence: Synthetic coding sequence
atgcccggcggccccagccccagaagccccgcccccctgctgagacccctgctgctgctgctgtgcgccctggcccccggcgcccccggccccgcccccggcagagccaccgagggcagagccgccctggacatcgtgcaccccgtgagagtggacgccggcggcagcttcctgagctacgagctgtggcccagagccctgagaaagagagacgtgagcgtgagaagagacgcccccgccttctacgagctgcagtacagaggcagagagctgagattcaacctgaccgccaaccagcacctgctggcccccggcttcgtgagcgagaccagaagaagaggcggcctgggcagagcccacatcagagcccacacccccgcctgccacctgctgggcgaggtgcaggaccccgagctggagggcggcctggccgccatcagcgcctgcgacggcctgaagggcgtgttccagctgagcaacgaggactacttcatcgagcccctggacagcgcccccgccagacccggccacgcccagccccacgtggtgtacaagagacaggcccccgagagactggcccagagaggcgacagcagcgcccccagcacctgcggcgtgcaggtgtaccccgagctggagagcagaagagagagatgggagcagagacagcagtggagaagacccagactgagaagactgcaccagagaagcgtgagcaaggagaagtgggtggagaccctggtggtggccgacgccaagatggtggagtaccacggccagccccaggtggagagctacgtgctgaccatcatgaacatggtggccggcctgttccacgaccccagcatcggcaaccccatccacatcaccatcgtgagactggtgctgctggaggacgaggaggaggacctgaagatcacccaccacgccgacaacaccctgaagagcttctgcaagtggcagaagagcatcaacatgaagggcgacgcccaccccctgcaccacgacaccgccatcctgctgaccagaaaggacctgtgcgccgccatgaacagaccctgcgagaccctgggcctgagccacgtggccggcatgtgccagccccacagaagctgcagcatcaacgaggacaccggcctgcccctggccttcaccgtggcccacgagctgggccacagcttcggcatccagcacgacggcagcggcaacgactgcgagcccgtgggcaagagacccttcatcatgagcccccagctgctgtacgacgccgcccccctgacctggagcagatgcagcagacagtacatcaccagattcctggacagaggctggggcctgtgcctggacgacccccccgccaaggacatcatcgacttccccagcgtgccccccggcgtgctgtacgacgtgagccaccagtgcagactgcagtacggcgcctacagcgccttctgcgaggacatggacaacgtgtgccacaccctgtggtgcagcgtgggcaccacctgccacagcaagctggacgccgccgtggacggcaccagatgcggcgagaacaagtggtgcctgagcggcgagtgcgtgcccgtgggcttcagacccgaggccgtggacggcggctggagcggctggagcgcctggagcatctgcagcagaagctgcggcatgggcgtgcagagcgccgagagacagtgcacccagcccacccccaagtacaagggcagatactgcgtgggcgagagaaagagattcagactgtgcaacctgcaggcctgccccgccggcagacccagcttcagacacgtgcagtgcagccacttcgacgccatgctgtacaagggccagctgcacacctgggtgcccgtggtgaacgacgtgaacccctgcgagctgcactgcagacccgccaacgagtacttcgccgagaagctgagagacgccgtggtggacggcaccccctgctaccaggtgagagccagcagagacctgtgcatcaacggcatctgcaagaacgtgggctgcgacttcgagatcgacagcggcgccatggaggacagatgcggcgtgtgccacggcaacggcagcacctgccacaccgtgagcggcaccttcgaggaggccgagggcctgggctacgtggacgtgggcctgatccccgccggcgccagagagatcagaatccaggaggtggccgaggccgccaacttcctggccctgagaagcgaggaccccgagaagtacttcctgaacggcggctggaccatccagtggaacggcgactaccaggtggccggcaccaccttcacctacgccagaagaggcaactgggagaacctgaccagccccggccccaccaaggagcccgtgtggatccagctgctgttccaggagagcaaccccggcgtgcactacgagtacaccatccacagagaggccggcggccacgacgaggtgcccccccccgtgttcagctggcactacggcccctggaccaagtgcaccgtgacctgcggcagaggcgtgcagagacagaacgtgtactgcctggagagacaggccggccccgtggacgaggagcactgcgaccccctgggcagacccgacgaccagcagagaaagtgcagcgagcagccctgccccgccagatggtgggccggcgagtggcagctgtgcagcagcagctgcggccccggcggcctgagcagaagagccgtgctgtgcatcagaagcgtgggcctggacgagcagagcgccctggagccccccgcctgcgagcacctgcccagaccccccaccgagaccccctgcaacagacacgtgccctgccccgccacctgggccgtgggcaactggagccagtgcagcgtgacctgcggcgagggcacccagagaagaaacgtgctgtgcaccaacgacaccggcgtgccctgcgacgaggcccagcagcccgccagcgaggtgacctgcagcctgcccctgtgcagatggcccctgggcaccctgggccccgagggcagcggcagcggcagcagcagccacgagctgttcaacgaggccgacttcatcccccaccacctggcccccagacccagccccgccagcagccccaagcccggcaccatgggcaacgccatcgaggaggaggcccccgagctggacctgcccggccccgtgttcgtggacgacttctactacgactacaacttcatcaacttccacgaggacctgagctacggccccagcgaggagcccgacctggacctggccggcaccggcgacagaaccccccccccccacagccaccccgccgcccccagcaccggcagccccgtgcccgccaccgagccccccgccgccaaggaggagggcgtgctgggcccctggagccccagcccctggcccagccaggccggcagaagcccccccccccccagcgagcagacccccggcaaccccctgatcaacttcctgcccgaggaggacacccccatcggcgcccccgacctgggcctgcccagcctgagctggcccagagtgagcaccgacggcctgcagacccccgccacccccgagagccagaacgacttccccgtgggcaaggacagccagagccagctgccccccccctggagagacagaaccaacgaggtgttcaaggacgacgaggagcccaagggcagaggcgccccccacctgccccccagacccagcagcaccctgccccccctgagccccgtgggcagcacccacagcagccccagccccgacgtggccgagctgtggaccggcggcaccgtggcctgggagcccgccctggagggcggcctgggccccgtggacagcgagctgtggcccaccgtgggcgtggccagcctgctgcccccccccatcgcccccctgcccgagatgaaggtgagagacagcagcctggagcccggcacccccagcttccccacccccggccccggcagctgggacctgcagaccgtggccgtgtggggcaccttcctgcccaccaccctgaccggcctgggccacatgcccgagcccgccctgaaccccggccccaagggccagcccgagagcctgagccccgaggtgcccctgagcagcagactgctgagcacccccgcctgggacagccccgccaacagccacagagtgcccgagacccagcccctggcccccagcctggccgaggccggcccccccgccgaccccctggtggtgagaaacgccggctggcaggccggcaactggagcgagtgcagcaccacctgcggcctgggcgccgtgtggagacccgtgagatgcagcagcggcagagacgaggactgcgcccccgccggcagaccccagcccgccagaagatgccacctgagaccctgcgccacctggcacagcggcaactggagcaagtgcagcagaagctgcggcggcggcagcagcgtgagagacgtgcagtgcgtggacaccagagacctgagacccctgagacccttccactgccagcccggccccgccaagccccccgcccacagaccctgcggcgcccagccctgcctgagctggtacaccagcagctggagagagtgcagcgaggcctgcggcggcggcgagcagcagagactggtgacctgccccgagcccggcctgtgcgaggaggccctgagacccaacaccaccagaccctgcaacacccacccctgcacccagtgggtggtgggcccctggggccagtgcagcggcccctgcggcggcggcgtgcagagaagactggtgaagtgcgtgaacacccagaccggcctgcccgaggaggacagcgaccagtgcggccacgaggcctggcccgagagcagcagaccctgcggcaccgaggactgcgagcccgtggagccccccagatgcgagagagacagactgagcttcggcttctgcgagaccctgagactgctgggcagatgccagctgcccaccatcagaacccagtgctgcagaagctgcagcccccccagccacggcgcccccagcagaggccaccagagagtggccagaagatag

SEQ ID NO: 71865 - DNA, 1383 bp, Artificial Sequence
  Description of Artificial Sequence: Synthetic coding sequence
atgcccggcggccccagccccagaagccccgcccccctgctgagacccctgctgctgctgctgtgcgccctggcccccggcgcccccggccccgcccccggcagagccaccgagggcagagccgccctggacatcgtgcaccccgtgagagtggacgccggcggcagcttcctgagctacgagctgtggcccagagccctgagaaagagagacgtgagcgtgagaagagacgcccccgccttctacgagctgcagtacagaggcagagagctgagattcaacctgaccgccaaccagcacctgctggcccccggcttcgtgagcgagaccagaagaagaggcggcctgggcagagcccacatcagagcccacacccccgcctgccacctgctgggcgaggtgcaggaccccgagctggagggcggcctggccgccatcagcgcctgcgacggcctgaagggcgtgttccagctgagcaacgaggactacttcatcgagcccctggacagcgcccccgccagacccggccacgcccagccccacgtggtgtacaagagacaggcccccgagagactggcccagagaggcgacagcagcgcccccagcacctgcggcgtgcaggtgtaccccgagctggagagcagaagagagagatgggagcagagacagcagtggagaagacccagactgagaagactgcaccagagaagcgtgagcaaggagaagtgggtggagaccctggtggtggccgacgccaagatggtggagtaccacggccagccccaggtggagagctacgtgctgaccatcatgaacatggtggccggcctgttccacgaccccagcatcggcaaccccatccacatcaccatcgtgagactggtgctgctggaggacgaggaggaggacctgaagatcacccaccacgccgacaacaccctgaagagcttctgcaagtggcagaagagcatcaacatgaagggcgacgcccaccccctgcaccacgacaccgccatcctgctgaccagaaaggacctgtgcgccgccatgaacagaccctgcgagaccctgggcctgagccacgtggccggcatgtgccagccccacagaagctgcagcatcaacgaggacaccggcctgcccctggccttcaccgtggcccacgagctgggccacagcagctgcaccacccccctgcccagccccggccccgccgccgccgccagcatcagccccggcagcctgagcgtgcagagacagaacgtgtactgcctggagagacaggccggccccgtggacgaggagcactgcgaccccctgggcagacccgacgaccagcagagaaagtgcagcgagcagccctgccccgccagcgcccagtag

SEQ ID NO: 71866 - DNA, 2670 bp, Artificial Sequence
  Description of Artificial Sequence: Synthetic coding sequence
atgctgcccgcccccgccgcccccagatggccccccctgctgctgctgctgctgctgctgctgcccctggccagaggcgcccccgccagacccgccgccggcggccaggccagcgagctggtggtgcccaccagactgcccggcagcgccggcgagctggccctgcacctgagcgccttcggcaagggcttcgtgctgagactggcccccgacgacagcttcctggcccccgagttcaagatcgagagactgggcggcagcggcagagccaccggcggcgagagaggcctgagaggctgcttcttcagcggcaccgtgaacggcgagcccgagagcctggccgccgtgagcctgtgcagaggcctgagcggcagcttcctgctggacggcgaggagttcaccatccagccccagggcgccggcggcagcctggcccagccccacagactgcagagatggggccccgccggcgccagacccctgcccagaggccccgagtgggaggtggagaccggcgagggccagagacaggagagaggcgaccaccaggaggacagcgaggaggagagccaggaggaggaggccgagggcgccagcgagccccccccccccctgggcgccaccagcagaaccaagagattcgtgagcgaggccagattcgtggagaccctgctggtggccgacgccagcatggccgccttctacggcgccgacctgcagaaccacatcctgaccctgatgagcgtggccgccagaatctacaagcaccccagcatcaagaacagcatcaacctgatggtggtgaaggtgctgatcgtggaggacgagaagtggggccccgaggtgagcgacaacggcggcctgaccctgagaaacttctgcaactggcagagaagattcaaccagcccagcgacagacaccccgagcactacgacaccgccatcctgctgaccagacagaacttctgcggccaggagggcctgtgcgacaccctgggcgtggccgacatcggcaccatctgcgaccccaacaagagctgcagcgtgatcgaggacgagggcctgcaggccgcccacaccctggcccacgagctgggccacgtgctgagcatgccccacgacgacagcaagccctgcaccagactgttcggccccatgggcaagcaccacgtgatggcccccctgttcgtgcacctgaaccagaccctgccctggagcccctgcagcgccatgtacctgaccgagctgctggacggcggccacggcgactgcctgctggacgcccccgccgccgccctgcccctgcccaccggcctgcccggcagaatggccctgtaccagctggaccagcagtgcagacagatcttcggccccgacttcagacactgccccaacaccagcgcccaggacgtgtgcgcccagctgtggtgccacaccgacggcgccgagcccctgtgccacaccaagaacggcagcctgccctgggccgacggcaccccctgcggccccggccacctgtgcagcgagggcagctgcctgcccgaggaggaggtggagagacccaagcccgtggccgacggcggctgggccccctggggcccctggggcgagtgcagcagaacctgcggcggcggcgtgcagttcagccacagagagtgcaaggaccccgagccccagaacggcggcagatactgcctgggcagaagagccaagtaccagagctgccacaccgaggagtgcccccccgacggcaagagcttcagagagcagcagtgcgagaagtacaacgcctacaactacaccgacatggacggcaacctgctgcagtgggtgcccaagtacgccggcgtgagccccagagacagatgcaagctgttctgcagagccagaggcagaagcgagttcaaggtgttcgaggccaaggtgatcgacggcaccctgtgcggccccgagaccctggccatctgcgtgagaggccagtgcgtgaaggccggctgcgaccacgtggtggacagccccagaaagctggacaagtgcggcgtgtgcggcggcaagggcaacagctgcagaaaggtgagcggcagcctgacccccaccaactacggctacaacgacatcgtgaccatccccgccggcgccaccaacatcgacgtgaagcagagaagccaccccggcgtgcagaacgacggcaactacctggccctgaagaccgccgacggccagtacctgctgaacggcaacctggccatcagcgccatcgagcaggacatcctggtgaagggcaccatcctgaagtacagcggcagcatcgccaccctggagagactgcagagcttcagacccctgcccgagcccctgaccgtgcagctgctgaccgtgcccggcgaggtgttcccccccaaggtgaagtacaccttcttcgtgcccaacgacgtggacttcagcatgcagagcagcaaggagagagccaccaccaacatcatccagcccctgctgcacgcccagtgggtgctgggcgactggagcgagtgcagcagcacctgcggcgccggctggcagagaagaaccgtggagtgcagagaccccagcggccaggccagcgccacctgcaacaaggccctgaagcccgaggacgccaagccctgcgagagccagctgtgccccctgtag

SEQ ID NO: 71867 - DNA, 2757 bp, Artificial Sequence
  Description of Artificial Sequence: Synthetic coding sequence
gccgccagagccagactgggcggcggcggcgccggcggcgccggctgcgccagccagagaggcagaagaggcagcgcccccgccgccggccccagaggccccagcagaccctgcaccagactgatccccctgttcctggagagagccgccggccccagaagcggcagacagcacctgcccgcccccggcggcctgctgcccagccccgccagaagccacagaagaagcccccacgcccccagacccagaagaccccccgtggccagcgcccccgccgccgccgccgccgccgccgccgccggccccagaagacccggccccgccagaagcagaggcgccggcctgggcgccggcggcgcccacgccgtggccagactgagaggctgcttcttcagcggcaccgtgaacggcgagcccgagagcctggccgccgtgagcctgtgcagaggcctgagcggcagcttcctgctggacggcgaggagttcaccatccagccccagggcgccggcggcagcctggcccagccccacagactgcagagatggggccccgccggcgccagacccctgcccagaggccccgagtgggaggtggagaccggcgagggccagagacaggagagaggcgaccaccaggaggacagcgaggaggagagccaggaggaggaggccgagggcgccagcgagccccccccccccctgggcgccaccagcagaaccaagagattcgtgagcgaggccagattcgtggagaccctgctggtggccgacgccagcatggccgccttctacggcgccgacctgcagaaccacatcctgaccctgatgagcgtggccgccagaatctacaagcaccccagcatcaagaacagcatcaacctgatggtggtgaaggtgctgatcgtggaggacgagaagtggggccccgaggtgagcgacaacggcggcctgaccctgagaaacttctgcaactggcagagaagattcaaccagcccagcgacagacaccccgagcactacgacaccgccatcctgctgaccagacagaacttctgcggccaggagggcctgtgcgacaccctgggcgtggccgacatcggcaccatctgcgaccccaacaagagctgcagcgtgatcgaggacgagggcctgcaggccgcccacaccctggcccacgagctgggccacgtgctgagcatgccccacgacgacagcaagccctgcaccagactgttcggccccatgggcaagcaccacgtgatggcccccctgttcgtgcacctgaaccagaccctgccctggagcccctgcagcgccatgtacctgaccgagctgctggacggcggccacggcgactgcctgctggacgcccccgccgccgccctgcccctgcccaccggcctgcccggcagaatggccctgtaccagctggaccagcagtgcagacagatcttcggccccgacttcagacactgccccaacaccagcgcccaggacgtgtgcgcccagctgtggtgccacaccgacggcgccgagcccctgtgccacaccaagaacggcagcctgccctgggccgacggcaccccctgcggccccggccacctgtgcagcgagggcagctgcctgcccgaggaggaggtggagagacccaagcccgtggccgacggcggctgggccccctggggcccctggggcgagtgcagcagaacctgcggcggcggcgtgcagttcagccacagagagtgcaaggaccccgagccccagaacggcggcagatactgcctgggcagaagagccaagtaccagagctgccacaccgaggagtgcccccccgacggcaagagcttcagagagcagcagtgcgagaagtacaacgcctacaactacaccgacatggacggcaacctgctgcagtgggtgcccaagtacgccggcgtgagccccagagacagatgcaagctgttctgcagagccagaggcagaagcgagttcaaggtgttcgaggccaaggtgatcgacggcaccctgtgcggccccgagaccctggccatctgcgtgagaggccagtgcgtgaaggccggctgcgaccacgtggtggacagccccagaaagctggacaagtgcggcgtgtgcggcggcaagggcaacagctgcagaaaggtgagcggcagcctgacccccaccaactacggctacaacgacatcgtgaccatccccgccggcgccaccaacatcgacgtgaagcagagaagccaccccggcgtgcagaacgacggcaactacctggccctgaagaccgccgacggccagtacctgctgaacggcaacctggccatcagcgccatcgagcaggacatcctggtgaagggcaccatcctgaagtacagcggcagcatcgccaccctggagagactgcagagcttcagacccctgcccgagcccctgaccgtgcagctgctgaccgtgcccggcgaggtgttcccccccaaggtgaagtacaccttcttcgtgcccaacgacgtggacttcagcatgcagagcagcaaggagagagccaccaccaacatcatccagcccctgctgcacgcccagtgggtgctgggcgactggagcgagtgcagcagcacctgcggcgccggctggcagagaagaaccgtggagtgcagagaccccagcggccaggccagcgccacctgcaacaaggccctgaagcccgaggacgccaagccctgcgagagccagctgtgccccctgtag

SEQ ID NO: 71868 - DNA, 5724 bp, Artificial Sequence
  Description of Artificial Sequence: Synthetic coding sequence
atgcagttcgtgagctgggccaccctgctgaccctgctggtgagagacctggccgagatgggcagccccgacgccgccgccgccgtgagaaaggacagactgcaccccagacaggtgaagctgctggagaccctgagcgagtacgagatcgtgagccccatcagagtgaacgccctgggcgagcccttccccaccaacgtgcacttcaagagaaccagaagaagcatcaacagcgccaccgacccctggcccgccttcgccagcagcagcagcagcagcaccagcagccaggcccactacagactgagcgccttcggccagcagttcctgttcaacctgaccgccaacgccggcttcatcgcccccctgttcaccgtgaccctgctgggcacccccggcgtgaaccagaccaagttctacagcgaggaggaggccgagctgaagcactgcttctacaagggctacgtgaacaccaacagcgagcacaccgccgtgatcagcctgtgcagcggcatgctgggcaccttcagaagccacgacggcgactacttcatcgagcccctgcagagcatggacgagcaggaggacgaggaggagcagaacaagccccacatcatctacagaagaagcgccccccagagagagcccagcaccggcagacacgcctgcgacaccagcgagcacaagaacagacacagcaaggacaagaagaagaccagagccagaaagtggggcgagagaatcaacctggccggcgacgtggccgccctgaacagcggcctggccaccgaggccttcagcgcctacggcaacaagaccgacaacaccagagagaagagaacccacagaagaaccaagagattcctgagctaccccagattcgtggaggtgctggtggtggccgacaacagaatggtgagctaccacggcgagaacctgcagcactacatcctgaccctgatgagcatcgacggccccagcatcagcttcaacgcccagaccaccctgaagaacttctgccagtggcagcacagcaagaacagccccggcggcatccaccacgacaccgccgtgctgctgaccagacaggacatctgcagagcccacgacaagtgcgacaccctgggcctggccgagctgggcaccatctgcgacccctacagaagctgcagcatcagcgaggacagcggcctgagcaccgccttcaccatcgcccacgagctgggccacgtgttcaacatgccccacgacgacaacaacaagtgcaaggaggagggcgtgaagagcccccagcacgtgatggcccccaccctgaacttctacaccaacccctggatgtggagcaagtgcagcagaaagtacatcaccgagttcctggacaccggctacggcgagtgcctgctgaacgagcccgagagcagaccctaccccctgcccgtgcagctgcccggcatcctgtacaacgtgaacaagcagtgcgagctgatcttcggccccggcagccaggtgtgcccctacatgatgcagtgcagaagactgtggtgcaacaacgtgaacggcgtgcacaagggctgcagaacccagcacaccccctgggccgacggcaccgagtgcgagcccggcaagcactgcaagtacggcttctgcgtgcccaaggagatggacgtgcccgtgaccgacggcagctggggcagctggagccccttcggcacctgcagcagaacctgcggcggcggcatcaagaccgccatcagagagtgcaacagacccgagcccaagaacggcggcaagtactgcgtgggcagaagaatgaagttcaagagctgcaacaccgagccctgcctgaagcagaagagagacttcagagacgagcagtgcgcccacttcgacggcaagcacttcaacatcaacggcctgctgcccaacgtgagatgggtgcccaagtacagcggcatcctgatgaaggacagatgcaagctgttctgcagagtggccggcaacaccgcctactaccagctgagagacagagtgatcgacggcaccccctgcggccaggacaccaacgacatctgcgtgcagggcctgtgcagacaggccggctgcgaccacgtgctgaacagcaaggccagaagagacaagtgcggcgtgtgcggcggcgacaacagcagctgcaagaccgtggccggcaccttcaacaccgtgcactacggctacaacaccgtggtgagaatccccgccggcgccaccaacatcgacgtgagacagcacagcttcagcggcgagaccgacgacgacaactacctggccctgagcagcagcaagggcgagttcctgctgaacggcaacttcgtggtgaccatggccaagagagagatcagaatcggcaacgccgtggtggagtacagcggcagcgagaccgccgtggagagaatcaacagcaccgacagaatcgagcaggagctgctgctgcaggtgctgagcgtgggcaagctgtacaaccccgacgtgagatacagcttcaacatccccatcgaggacaagccccagcagttctactggaacagccacggcccctggcaggcctgcagcaagccctgccagggcgagagaaagagaaagctggtgtgcaccagagagagcgaccagctgaccgtgagcgaccagagatgcgacagactgccccagcccggccacatcaccgagccctgcggcaccgactgcgacctgagatggcacgtggccagcagaagcgagtgcagcgcccagtgcggcctgggctacagaaccctggacatctactgcgccaagtacagcagactggacggcaagaccgagaaggtggacgacggcttctgcagcagccaccccaagcccagcaacagagagaagtgcagcggcgagtgcaacaccggcggctggagatacagcgcctggaccgagtgcagcaagagctgcgacggcggcacccagagaagaagagccatctgcgtgaacaccagaaacgacgtgctggacgacagcaagtgcacccaccaggagaaggtgaccatccagagatgcagcgagttcccctgcccccagtggaagagcggcgactggagcgagtgcctggtgacctgcggcaagggccacaagcacagacaggtgtggtgccagttcggcgaggacagactgaacgacagaatgtgcgaccccgagaccaagcccaccagcatgcagacctgccagcagcccgagtgcgccagctggcaggccggcccctggggccagtgcagcgtgacctgcggccagggctaccagctgagagccgtgaagtgcatcatcggcacctacatgagcgtggtggacgacaacgactgcaacgccgccaccagacccaccgacacccaggactgcgagctgcccagctgccaccccccccccgccgcccccgagaccagaagaagcacctacagcgcccccagaacccagtggagattcggcagctggaccccctgcagcgccacctgcggcaagggcaccagaatgagatacgtgagctgcagagacgagaacggcagcgtggccgacgagagcgcctgcgccaccctgcccagacccgtggccaaggaggagtgcagcgtgaccccctgcggccagtggaaggccctggactggagcagctgcagcgtgacctgcggccagggcagagccaccagacaggtgatgtgcgtgaactacagcgaccacgtgatcgacagaagcgagtgcgaccaggactacatccccgagaccgaccaggactgcagcatgagcccctgcccccagagaacccccgacagcggcctggcccagcaccccttccagaacgaggactacagacccagaagcgccagccccagcagaacccacgtgctgggcggcaaccagtggagaaccggcccctggggcgcctgcagcagcacctgcgccggcggcagccagagaagagtggtggtgtgccaggacgagaacggctacaccgccaacgactgcgtggagagaatcaagcccgacgagcagagagcctgcgagagcggcccctgcccccagtgggcctacggcaactggggcgagtgcaccaagctgtgcggcggcggcatcagaaccagactggtggtgtgccagagaagcaacggcgagagattccccgacctgagctgcgagatcctggacaagccccccgacagagagcagtgcaacacccacgcctgcccccacgacgccgcctggagcaccggcccctggagcagctgcagcgtgagctgcggcagaggccacaagcagagaaacgtgtactgcatggccaaggacggcagccacctggagagcgactactgcaagcacctggccaagccccacggccacagaaagtgcagaggcggcagatgccccaagtggaaggccggcgcctggagccagtgcagcgtgagctgcggcagaggcgtgcagcagagacacgtgggctgccagatcggcacccacaagatcgccagagagaccgagtgcaacccctacaccagacccgagagcgagagagactgccagggccccagatgccccctgtacacctggagagccgaggagtggcaggagtgcaccaagacctgcggcgagggcagcagatacagaaaggtggtgtgcgtggacgacaacaagaacgaggtgcacggcgccagatgcgacgtgagcaagagacccgtggacagagagagctgcagcctgcagccctgcgagtacgtgtggatcaccggcgagtggagcgagtgcagcgtgacctgcggcaagggctacaagcagagactggtgagctgcagcgagatctacaccggcaaggagaactacgagtacagctaccagaccaccatcaactgccccggcacccagccccccagcgtgcacccctgctacctgagagactgccccgtgagcgccacctggagagtgggcaactggggcagctgcagcgtgagctgcggcgtgggcgtgatgcagagaagcgtgcagtgcctgaccaacgaggaccagcccagccacctgtgccacaccgacctgaagcccgaggagagaaagacctgcagaaacgtgtacaactgcgagctgccccagaactgcaaggaggtgaagagactgaagggcgccagcgaggacggcgagtacttcctgatgatcagaggcaagctgctgaagatcttctgcgccggcatgcacagcgaccaccccaaggagtacgtgaccctggtgcacggcgacagcgagaacttcagcgaggtgtacggccacagactgcacaaccccaccgagtgcccctacaacggcagcagaagagacgactgccagtgcagaaaggactacaccgccgccggcttcagcagcttccagaagatcagaatcgacctgaccagcatgcagatcatcaccaccgacctgcagttcgccagaaccagcgagggccaccccgtgcccttcgccaccgccggcgactgctacagcgccgccaagtgcccccagggcagattcagcatcaacctgtacggcaccggcctgagcctgaccgagagcgccagatggatcagccagggcaactacgccgtgagcgacatcaagaagagccccgacggcaccagagtggtgggcaagtgcggcggctactgcggcaagtgcacccccagcagcggcaccggcctggaggtgagagtgctgtag

SEQ ID NO: 71869 - DNA, 2976 bp, Artificial Sequence
  Description of Artificial Sequence: Synthetic coding sequence
tgagagtgcagcgcccagtgcggcctgggctacagaaccctggacatctactgcgccaagtacagcagactggacggcaagaccgagaaggtggacgacggcttctgcagcagccaccccaagcccagcaacagagagaagtgcagcggcgagtgcaacaccggcggctggagatacagcgcctggaccgagtgcagcaagagctgcgacggcggcacccagagaagaagagccatctgcgtgaacaccagaaacgacgtgctggacgacagcaagtgcacccaccaggagaaggtgaccatccagagatgcagcgagttcccctgcccccagtggaagagcggcgactggagcgagtgcctggtgacctgcggcaagggccacaagcacagacaggtgtggtgccagttcggcgaggacagactgaacgacagaatgtgcgaccccgagaccaagcccaccagcatgcagacctgccagcagcccgagtgcgccagctggcaggccggcccctggggccagtgcagcgtgacctgcggccagggctaccagctgagagccgtgaagtgcatcatcggcacctacatgagcgtggtggacgacaacgactgcaacgccgccaccagacccaccgacacccaggactgcgagctgcccagctgccaccccccccccgccgcccccgagaccagaagaagcacctacagcgcccccagaacccagtggagattcggcagctggaccccctgcagcgccacctgcggcaagggcaccagaatgagatacgtgagctgcagagacgagaacggcagcgtggccgacgagagcgcctgcgccaccctgcccagacccgtggccaaggaggagtgcagcgtgaccccctgcggccagtggaaggccctggactggagcagctgcagcgtgacctgcggccagggcagagccaccagacaggtgatgtgcgtgaactacagcgaccacgtgatcgacagaagcgagtgcgaccaggactacatccccgagaccgaccaggactgcagcatgagcccctgcccccagagaacccccgacagcggcctggcccagcaccccttccagaacgaggactacagacccagaagcgccagccccagcagaacccacgtgctgggcggcaaccagtggagaaccggcccctggggcgcctgcagcagcacctgcgccggcggcagccagagaagagtggtggtgtgccaggacgagaacggctacaccgccaacgactgcgtggagagaatcaagcccgacgagcagagagcctgcgagagcggcccctgcccccagtgggcctacggcaactggggcgagtgcaccaagctgtgcggcggcggcatcagaaccagactggtggtgtgccagagaagcaacggcgagagattccccgacctgagctgcgagatcctggacaagccccccgacagagagcagtgcaacacccacgcctgcccccacgacgccgcctggagcaccggcccctggagcagctgcagcgtgagctgcggcagaggccacaagcagagaaacgtgtactgcatggccaaggacggcagccacctggagagcgactactgcaagcacctggccaagccccacggccacagaaagtgcagaggcggcagatgccccaagtggaaggccggcgcctggagccagtgcagcgtgagctgcggcagaggcgtgcagcagagacacgtgggctgccagatcggcacccacaagatcgccagagagaccgagtgcaacccctacaccagacccgagagcgagagagactgccagggccccagatgccccctgtacacctggagagccgaggagtggcaggagtgcaccaagacctgcggcgagggcagcagatacagaaaggtggtgtgcgtggacgacaacaagaacgaggtgcacggcgccagatgcgacgtgagcaagagacccgtggacagagagagctgcagcctgcagccctgcgagtacgtgtggatcaccggcgagtggagcgagtgcagcgtgacctgcggcaagggctacaagcagagactggtgagctgcagcgagatctacaccggcaaggagaactacgagtacagctaccagaccaccatcaactgccccggcacccagccccccagcgtgcacccctgctacctgagagactgccccgtgagcgccacctggagagtgggcaactggggcagctgcagcgtgagctgcggcgtgggcgtgatgcagagaagcgtgcagtgcctgaccaacgaggaccagcccagccacctgtgccacaccgacctgaagcccgaggagagaaagacctgcagaaacgtgtacaactgcgagctgccccagaactgcaaggaggtgaagagactgaagggcgccagcgaggacggcgagtacttcctgatgatcagaggcaagctgctgaagatcttctgcgccggcatgcacagcgaccaccccaaggagtacgtgaccctggtgcacggcgacagcgagaacttcagcgaggtgtacggccacagactgcacaaccccaccgagtgcccctacaacggcagcagaagagacgactgccagtgcagaaaggactacaccgccgccggcttcagcagcttccagaagatcagaatcgacctgaccagcatgcagatcatcaccaccgacctgcagttcgccagaaccagcgagggccaccccgtgcccttcgccaccgccggcgactgctacagcgccgccaagtgcccccagggcagattcagcatcaacctgtacggcaccggcctgagcctgaccgagagcgccagatggatcagccagggcaactacgccgtgagcgacatcaagaagagccccgacggcaccagagtggtgggcaagtgcggcggctactgcggcaagtgcacccccagcagcggcaccggcctggaggtgagagtgctgtag

SEQ ID NO: 71870 - DNA, 5808 bp, Artificial Sequence
  Description of Artificial Sequence: Synthetic coding sequence
atgcagttcgtgagctgggccaccctgctgaccctgctggtgagagacctggccgagatgggcagccccgacgccgccgccgccgtgagaaaggacagactgcaccccagacaggtgaagctgctggagaccctgagcgagtacgagatcgtgagccccatcagagtgaacgccctgggcgagcccttccccaccaacgtgcacttcaagagaaccagaagaagcatcaacagcgccaccgacccctggcccgccttcgccagcagcagcagcagcagcaccagcagccaggcccactacagactgagcgccttcggccagcagttcctgttcaacctgaccgccaacgccggcttcatcgcccccctgttcaccgtgaccctgctgggcacccccggcgtgaaccagaccaagttctacagcgaggaggaggccgagctgaagcactgcttctacaagggctacgtgaacaccaacagcgagcacaccgccgtgatcagcctgtgcagcggcatgctgggcaccttcagaagccacgacggcgactacttcatcgagcccctgcagagcatggacgagcaggaggacgaggaggagcagaacaagccccacatcatctacagaagaagcgccccccagagagagcccagcaccggcagacacgcctgcgacaccagcgagcacaagaacagacacagcaaggacaagaagaagaccagagccagaaagtggggcgagagaatcaacctggccggcgacgtggccgccctgaacagcggcctggccaccgaggccttcagcgcctacggcaacaagaccgacaacaccagagagaagagaacccacagaagaaccaagagattcctgagctaccccagattcgtggaggtgctggtggtggccgacaacagaatggtgagctaccacggcgagaacctgcagcactacatcctgaccctgatgagcatcgtggccagcatctacaaggaccccagcatcggcaacctgatcaacatcgtgatcgtgaacctgatcgtgatccacaacgagcaggacggccccagcatcagcttcaacgcccagaccaccctgaagaacttctgccagtggcagcacagcaagaacagccccggcggcatccaccacgacaccgccgtgctgctgaccagacaggacatctgcagagcccacgacaagtgcgacaccctgggcctggccgagctgggcaccatctgcgacccctacagaagctgcagcatcagcgaggacagcggcctgagcaccgccttcaccatcgcccacgagctgggccacgtgttcaacatgccccacgacgacaacaacaagtgcaaggaggagggcgtgaagagcccccagcacgtgatggcccccaccctgaacttctacaccaacccctggatgtggagcaagtgcagcagaaagtacatcaccgagttcctggacaccggctacggcgagtgcctgctgaacgagcccgagagcagaccctaccccctgcccgtgcagctgcccggcatcctgtacaacgtgaacaagcagtgcgagctgatcttcggccccggcagccaggtgtgcccctacatgatgcagtgcagaagactgtggtgcaacaacgtgaacggcgtgcacaagggctgcagaacccagcacaccccctgggccgacggcaccgagtgcgagcccggcaagcactgcaagtacggcttctgcgtgcccaaggagatggacgtgcccgtgaccgacggcagctggggcagctggagccccttcggcacctgcagcagaacctgcggcggcggcatcaagaccgccatcagagagtgcaacagacccgagcccaagaacggcggcaagtactgcgtgggcagaagaatgaagttcaagagctgcaacaccgagccctgcctgaagcagaagagagacttcagagacgagcagtgcgcccacttcgacggcaagcacttcaacatcaacggcctgctgcccaacgtgagatgggtgcccaagtacagcggcatcctgatgaaggacagatgcaagctgttctgcagagtggccggcaacaccgcctactaccagctgagagacagagtgatcgacggcaccccctgcggccaggacaccaacgacatctgcgtgcagggcctgtgcagacaggccggctgcgaccacgtgctgaacagcaaggccagaagagacaagtgcggcgtgtgcggcggcgacaacagcagctgcaagaccgtggccggcaccttcaacaccgtgcactacggctacaacaccgtggtgagaatccccgccggcgccaccaacatcgacgtgagacagcacagcttcagcggcgagaccgacgacgacaactacctggccctgagcagcagcaagggcgagttcctgctgaacggcaacttcgtggtgaccatggccaagagagagatcagaatcggcaacgccgtggtggagtacagcggcagcgagaccgccgtggagagaatcaacagcaccgacagaatcgagcaggagctgctgctgcaggtgctgagcgtgggcaagctgtacaaccccgacgtgagatacagcttcaacatccccatcgaggacaagccccagcagttctactggaacagccacggcccctggcaggcctgcagcaagccctgccagggcgagagaaagagaaagctggtgtgcaccagagagagcgaccagctgaccgtgagcgaccagagatgcgacagactgccccagcccggccacatcaccgagccctgcggcaccgactgcgacctgagatggcacgtggccagcagaagcgagtgcagcgcccagtgcggcctgggctacagaaccctggacatctactgcgccaagtacagcagactggacggcaagaccgagaaggtggacgacggcttctgcagcagccaccccaagcccagcaacagagagaagtgcagcggcgagtgcaacaccggcggctggagatacagcgcctggaccgagtgcagcaagagctgcgacggcggcacccagagaagaagagccatctgcgtgaacaccagaaacgacgtgctggacgacagcaagtgcacccaccaggagaaggtgaccatccagagatgcagcgagttcccctgcccccagtggaagagcggcgactggagcgagtgcctggtgacctgcggcaagggccacaagcacagacaggtgtggtgccagttcggcgaggacagactgaacgacagaatgtgcgaccccgagaccaagcccaccagcatgcagacctgccagcagcccgagtgcgccagctggcaggccggcccctggggccagtgcagcgtgacctgcggccagggctaccagctgagagccgtgaagtgcatcatcggcacctacatgagcgtggtggacgacaacgactgcaacgccgccaccagacccaccgacacccaggactgcgagctgcccagctgccaccccccccccgccgcccccgagaccagaagaagcacctacagcgcccccagaacccagtggagattcggcagctggaccccctgcagcgccacctgcggcaagggcaccagaatgagatacgtgagctgcagagacgagaacggcagcgtggccgacgagagcgcctgcgccaccctgcccagacccgtggccaaggaggagtgcagcgtgaccccctgcggccagtggaaggccctggactggagcagctgcagcgtgacctgcggccagggcagagccaccagacaggtgatgtgcgtgaactacagcgaccacgtgatcgacagaagcgagtgcgaccaggactacatccccgagaccgaccaggactgcagcatgagcccctgcccccagagaacccccgacagcggcctggcccagcaccccttccagaacgaggactacagacccagaagcgccagccccagcagaacccacgtgctgggcggcaaccagtggagaaccggcccctggggcgcctgcagcagcacctgcgccggcggcagccagagaagagtggtggtgtgccaggacgagaacggctacaccgccaacgactgcgtggagagaatcaagcccgacgagcagagagcctgcgagagcggcccctgcccccagtgggcctacggcaactggggcgagtgcaccaagctgtgcggcggcggcatcagaaccagactggtggtgtgccagagaagcaacggcgagagattccccgacctgagctgcgagatcctggacaagccccccgacagagagcagtgcaacacccacgcctgcccccacgacgccgcctggagcaccggcccctggagcagctgcagcgtgagctgcggcagaggccacaagcagagaaacgtgtactgcatggccaaggacggcagccacctggagagcgactactgcaagcacctggccaagccccacggccacagaaagtgcagaggcggcagatgccccaagtggaaggccggcgcctggagccagtgcagcgtgagctgcggcagaggcgtgcagcagagacacgtgggctgccagatcggcacccacaagatcgccagagagaccgagtgcaacccctacaccagacccgagagcgagagagactgccagggccccagatgccccctgtacacctggagagccgaggagtggcaggagtgcaccaagacctgcggcgagggcagcagatacagaaaggtggtgtgcgtggacgacaacaagaacgaggtgcacggcgccagatgcgacgtgagcaagagacccgtggacagagagagctgcagcctgcagccctgcgagtacgtgtggatcaccggcgagtggagcgagtgcagcgtgacctgcggcaagggctacaagcagagactggtgagctgcagcgagatctacaccggcaaggagaactacgagtacagctaccagaccaccatcaactgccccggcacccagccccccagcgtgcacccctgctacctgagagactgccccgtgagcgccacctggagagtgggcaactggggcagctgcagcgtgagctgcggcgtgggcgtgatgcagagaagcgtgcagtgcctgaccaacgaggaccagcccagccacctgtgccacaccgacctgaagcccgaggagagaaagacctgcagaaacgtgtacaactgcgagctgccccagaactgcaaggaggtgaagagactgaagggcgccagcgaggacggcgagtacttcctgatgatcagaggcaagctgctgaagatcttctgcgccggcatgcacagcgaccaccccaaggagtacgtgaccctggtgcacggcgacagcgagaacttcagcgaggtgtacggccacagactgcacaaccccaccgagtgcccctacaacggcagcagaagagacgactgccagtgcagaaaggactacaccgccgccggcttcagcagcttccagaagatcagaatcgacctgaccagcatgcagatcatcaccaccgacctgcagttcgccagaaccagcgagggccaccccgtgcccttcgccaccgccggcgactgctacagcgccgccaagtgcccccagggcagattcagcatcaacctgtacggcaccggcctgagcctgaccgagagcgccagatggatcagccagggcaactacgccgtgagcgacatcaagaagagccccgacggcaccagagtggtgggcaagtgcggcggctactgcggcaagtgcacccccagcagcggcaccggcctggaggtgagagtgctgtag

SEQ ID NO: 71871 - DNA, 1176 bp, Artificial Sequence
  Description of Artificial Sequence: Synthetic coding sequence
atgatcctgaacggcgaggagatcatcctgagcctgcagaagaccaagcacctgctgggccccgactacaccgagaccctgtacagccccagaggcgaggagatcaccaccaagcccgagaacatggagcactgctactacaagggcaacatcctgaacgagaagaacagcgtggccagcatcagcacctgcgacggcctgagaggctacttcacccaccaccaccagagataccagatcaagcccctgaagagcaccgacgagaaggagcacgccgtgttcaccagcaaccaggaggagcaggaccccgccaaccacacctgcggcgtgaagagcaccgacggcaagcagggccccatcagaatcagcagaagcctgaagagccccgagaaggaggacttcctgagagcccagaagtacatcgacctgtacctggtgctggacaacgccttctacaagaactacaacgagaacctgaccctgatcagaagcttcgtgttcgacgtgatgaacctgctgaacgtgatctacaacaccatcgacgtgcaggtggccctggtgggcatggagatctggagcgacggcgacaagatcaaggtggtgcccagcgccagcaccaccttcgacaacttcctgagatggcacagcagcaacctgggcaagaagatccacgaccacgcccagctgctgagcggcatcagcttcaacaacagaagagtgggcctggccgccagcaacagcctgtgcagccccagcagcgtggccgtgatcgaggccaagaagaagaacaacgtggccctggtgggcgtgatgagccacgagctgggccacgtgctgggcatgcccgacgtgcccttcaacaccaagtgccccagcggcagctgcgtgatgaaccagtacctgagcagcaagttccccaaggacttcagcaccagctgcagagcccacttcgagagatacctgctgagccagaagcccaagtgcctgctgcaggcccccatccccaccaacatcatgaccacccccgtgtgcggcaaccacctgctggaggtgggcgaggactgcgactgcggcagccccaaggagtgcaccaacctgtgctgcgaggccctgacctgcaagctgaagcccggcaccgactgcggcggcgacgcccccaaccacaccaccgagtag

SEQ ID NO: 71872 - DNA, 1413 bp, Artificial Sequence
  Description of Artificial Sequence: Synthetic coding sequence
atgctgagaggcatcagccagctgcccgccgtggccaccatgagctgggtgctgctgcccgtgctgtggctgatcgtgcagacccaggccatcgccatcaagcagacccccgagctgaccctgcacgagatcgtgtgccccaagaagctgcacatcctgcacaagagagagatcaagaacaaccagaccgagaagcacggcaaggaggagagatacgagcccgaggtgcagtaccagatgatcctgaacggcgaggagatcatcctgagcctgcagaagaccaagcacctgctgggccccgactacaccgagaccctgtacagccccagaggcgaggagatcaccaccaagcccgagaacatggagcactgctactacaagggcaacatcctgaacgagaagaacagcgtggccagcatcagcacctgcgacggcctgagaggctacttcacccaccaccaccagagataccagatcaagcccctgaagagcaccgacgagaaggagcacgccgtgttcaccagcaaccaggaggagcaggaccccgccaaccacacctgcggcgtgaagagcaccgacggcaagcagggccccatcagaatcagcagaagcctgaagagccccgagaaggaggacttcctgagagcccagaagtacatcgacctgtacctggtgctggacaacgccttctacaagaactacaacgagaacctgaccctgatcagaagcttcgtgttcgacgtgatgaacctgctgaacgtgatctacaacaccatcgacgtgcaggtggccctggtgggcatggagatctggagcgacggcgacaagatcaaggtggtgcccagcgccagcaccaccttcgacaacttcctgagatggcacagcagcaacctgggcaagaagatccacgaccacgcccagctgctgagcggcatcagcttcaacaacagaagagtgggcctggccgccagcaacagcctgtgcagccccagcagcgtggccgtgatcgaggccaagaagaagaacaacgtggccctggtgggcgtgatgagccacgagctgggccacgtgctgggcatgcccgacgtgcccttcaacaccaagtgccccagcggcagctgcgtgatgaaccagtacctgagcagcaagttccccaaggacttcagcaccagctgcagagcccacttcgagagatacctgctgagccagaagcccaagtgcctgctgcaggcccccatccccaccaacatcatgaccacccccgtgtgcggcaaccacctgctggaggtgggcgaggactgcgactgcggcagccccaaggagtgcaccaacctgtgctgcgaggccctgacctgcaagctgaagcccggcaccgactgcggcggcgacgcccccaaccacaccaccgagtag

SEQ ID NO: 71873 - DNA, 1176 bp, Artificial Sequence; identical to SEQ ID NO: 71871
  Description of Artificial Sequence: Synthetic coding sequence

SEQ ID NO: 71874 - DNA, 2052 bp, Artificial Sequence
  Description of Artificial Sequence: Synthetic coding sequence
atggagtgctgcagaagagccacccccggcaccctgctgctgttcctggccttcctgctgctgagcagcagaaccgccagaagcgaggaggacagagacggcctgtgggacgcctggggcccctggagcgagtgcagcagaacctgcggcggcggcgccagctacagcctgagaagatgcctgagcagcaagagctgcgagggcagaaacatcagatacagaacctgcagcaacgtggactgcccccccgaggccggcgacttcagagcccagcagtgcagcgcccacaacgacgtgaagcaccacggccagttctacgagtggctgcccgtgagcaacgaccccgacaacccctgcagcctgaagtgccaggccaagggcaccaccctggtggtggagctggcccccaaggtgctggacggcaccagatgctacaccgagagcctggacatgtgcatcagcggcctgtgccagatcgtgggctgcgaccaccagctgggcagcaccgtgaaggaggacaactgcggcgtgtgcaacggcgacggcagcacctgcagactggtgagaggccagtacaagagccagctgagcgccaccaagagcgacgacaccgtggtggccatcccctacggcagcagacacatcagactggtgctgaagggccccgaccacctgtacctggagaccaagaccctgcagggcaccaagggcgagaacagcctgagcagcaccggcaccttcctggtggacaacagcagcgtggacttccagaagttccccgacaaggagatcctgagaatggccggccccctgaccgccgacttcatcgtgaagatcagaaacagcggcagcgccgacagcaccgtgcagttcatcttctaccagcccatcatccacagatggagagagaccgacttcttcccctgcagcgccacctgcggcggcggctaccagctgaccagcgccgagtgctacgacctgagaagcaacagagtggtggccgaccagtactgccactactaccccgagaacatcaagcccaagcccaagctgcaggagtgcaacctggacccctgccccgccagcgacggctacaagcagatcatgccctacgacctgtaccaccccctgcccagatgggaggccaccccctggaccgcctgcagcagcagctgcggcggcggcatccagagcagagccgtgagctgcgtggaggaggacatccagggccacgtgaccagcgtggaggagtggaagtgcatgtacacccccaagatgcccatcgcccagccctgcaacatcttcgactgccccaagtggctggcccaggagtggagcccctgcaccgtgacctgcggccagggcctgagatacagagtggtgctgtgcatcgaccacagaggcatgcacaccggcggctgcagccccaagaccaagccccacatcaaggaggagtgcatcgtgcccaccccctgctacaagcccaaggagaagctgcccgtggaggccaagctgccctggttcaagcaggcccaggagctggaggagggcgccgccgtgagcgaggagcccagcttcatccccgaggcctggagcgcctgcaccgtgacctgcggcgtgggcacccaggtgagaatcgtgagatgccaggtgctgctgagcttcagccagagcgtggccgacctgcccatcgacgagtgcgagggccccaagcccgccagccagagagcctgctacgccggcccctgcagcggcgagatccccgagttcaaccccgacgagaccgacggcctgttcggcggcctgcaggacttcgacgagctgtacgactgggagtacgagggcttcaccaagtgcagcgagagctgcggcggcggcgtgcaggaggccgtggtgagctgcctgaacaagcagaccagagagcccgccgaggagaacctgtgcgtgaccagcagaagacccccccagctgctgaagagctgcaacctggacccctgccccgccagaagcagcatcgacagcgcctggaacgcctgcaacgtgctgtgctag

SEQ ID NO: 71875 - DNA, 1401 bp, Artificial Sequence
  Description of Artificial Sequence: Synthetic coding sequence
atgtgcctgaccgacgagtggggcttcttcttcttcttcttcctgggcgtgcccgaggccgaggtgacctggttcagaaacaagagcaagctgggcagcccccaccacctgcacgagggcagcctgctgctgaccaacgtgagcagcagcgaccagggcctgtacagctgcagagccgccaacctgcacggcgagctgaccgagagcacccagctgctgatcctggaccccccccaggtgcccacccagctggaggacatcagagccctgctggccgccaccggccccaacctgcccagcgtgctgaccagccccctgggcacccagctggtgctggaccccggcaacagcgccctgctgggctgccccatcaagggccaccccgtgcccaacatcacctggttccacggcggccagcccatcgtgaccgccaccggcctgacccaccacatcctggccgccggccagatcctgcaggtggccaacctgagcggcggcagccagggcgagttcagctgcctggcccagaacgaggccggcgtgctgatgcagaaggccagcctggtgatccaggactactggtggagcgtggacagactggccacctgcagcgccagctgcggcaacagaggcgtgcagcagcccagactgagatgcctgctgaacagcaccgaggtgaaccccgcccactgcgccggcaaggtgagacccgccgtgcagcccatcgcctgcaacagaagagactgccccagcagatggatggtgaccagctggagcgcctgcaccagaagctgcggcggcggcgtgcagaccagaagagtgacctgccagaagctgaaggccagcggcatcagcacccccgtgagcaacgacatgtgcacccaggtggccaagagacccgtggacacccaggcctgcaaccagcagctgtgcgtggagtgggccttcagcagctggggccagtgcaacggcccctgcatcggcccccacctggccgtgcagcacagacaggtgttctgccagaccagagacggcatcaccctgcccagcgagcagtgcagcgccctgcccagacccgtgagcacccagaactgctggagcgaggcctgcagcgtgcactggagagtgagcctgtggaccctgtgcaccgccacctgcggcaactacggcttccagagcagaagagtggagtgcgtgcacgccagaaccaacaaggccgtgcccgagcacctgtgcagctggggccccagacccgccaactggcagagatgcaacatcaccccctgcgagaacatggagtgcagagacaccaccagatactgcgagaaggtgaagcagctgaagctgtgccagctgagccagttcaagagcagatgctgcggcacctgcggcaaggcctag

SEQ ID NO: 71876 - DNA, 1578 bp, Artificial Sequence
  Description of Artificial Sequence: Synthetic coding sequence
atggagtgctgcagaagagccacccccggcaccctgctgctgttcctggccttcctgctgctgagcagcagaaccgccagaagcgaggaggacagagacggcctgtgggacgcctggggcccctggagcgagtgcagcagaacctgcggcggcggcgccagctacagcctgagaagatgcctgagcagcaagagctgcgagggcagaaacatcagatacagaacctgcagcaacgtggactgcccccccgaggccggcgacttcagagcccagcagtgcagcgcccacaacgacgtgaagcaccacggccagttctacgagtggctgcccgtgagcaacgaccccgacaacccctgcagcctgaagtgccaggccaagggcaccaccctggtggtggagctggcccccaaggtgctggacggcaccagatgctacaccgagagcctggacatgtgcatcagcggcctgtgccagatcgtgggctgcgaccaccagctgggcagcaccgtgaaggaggacaactgcggcgtgtgcaacggcgacggcagcacctgcagactggtgagaggccagtacaagagccagctgagcgccaccaagagcgacgacaccgtggtggccatcccctacggcagcagacacatcagactggtgctgaagggccccgaccacctgtacctggagaccaagaccctgcagggcaccaagggcgagaacagcctgagcagcaccggcaccttcctggtggacaacagcagcgtggacttccagaagttccccgacaaggagatcctgagaatggccggccccctgaccgccgacttcatcgtgaagatcagaaacagcggcagcgccgacagcaccgtgcagttcatcttctaccagcccatcatccacagatggagagagaccgacttcttcccctgcagcgccacctgcggcggcggctaccagctgaccagcgccgagtgctacgacctgagaagcaacagagtggtggccgaccagtactgccactactaccccgagaacatcaagcccaagcccaagctgcaggagtgcaacctggacccctgccccgccagcgacggctacaagcagatcatgccctacgacctgtaccaccccctgcccagatgggaggccaccccctggaccgcctgcagcagcagctgcggcggcggcatccagagcagagccgtgagctgcgtggaggaggacatccagggccacgtgaccagcgtggaggagtggaagtgcatgtacacccccaagatgcccatcgcccagccctgcaacatcttcgactgccccaagtggctggcccaggagtggagcccctgcaccgtgacctgcggccagggcctgagatacagagtggtgctgtgcatcgaccacagaggcatgcacaccggcggctgcagccccaagaccaagccccacatcaaggaggagtgcatcgtgcccaccccctgctacaagcccaaggagaagctgcccgtggaggccaagctgccctggttcaagcaggcccaggagctggaggagggcgccgccgtgagcgaggagcccagctag

SEQ ID NO: 71877 - DNA, 786 bp, Artificial Sequence
  Description of Artificial Sequence: Synthetic coding sequence
atgtgcctgaccgacgagtggggcttcttcttcttcttcttcctgggcgtgcccgaggccgaggtgacctggttcagaaacaagagcaagctgggcagcccccaccacctgcacgagggcagcctgctgctgaccaacgtgagcagcagcgaccagggcctgtacagctgcagagccgccaacctgcacggcgagctgaccgagagcacccagctgctgatcctggaccccccccaggtgcccacccagctggaggacatcagagccctgctggccgccaccggccccaacctgcccagcgtgctgaccagccccctgggcacccagctggtgctggaccccggcaacagcgccctgctgggctgccccatcaagggccaccccgtgcccaacatcacctggttccacggcggccagcccatcgtgaccgccaccggcctgacccaccacatcctggccgccggccagatcctgcaggtggccaacctgagcggcggcagccagggcgagttcagctgcctggcccagaacgaggccggcgtgctgatgcagaaggccagcctggtgatccaggactactggtggagcgtggacagactggccacctgcagcgccagctgcggcaacagaggcgtgcagcagcccagactgagatgcctgctgaacagcaccgaggtgaaccccgcccactgcgccggcaaggtgagacccgccgtgcagcccatcgcctgcaacagaagagactgccccagcagagccatgggcctggccagcggcctgacctag

SEQ ID NO: 71878 - DNA, 5289 bp, Artificial Sequence
  Description of Artificial Sequence: Synthetic coding sequence
atggagtgctgcagaagagccacccccggcaccctgctgctgttcctggccttcctgctgctgagcagcagaaccgccagaagcgaggaggacagagacggcctgtgggacgcctggggcccctggagcgagtgcagcagaacctgcggcggcggcgccagctacagcctgagaagatgcctgagcagcaagagctgcgagggcagaaacatcagatacagaacctgcagcaacgtggactgcccccccgaggccggcgacttcagagcccagcagtgcagcgcccacaacgacgtgaagcaccacggccagttctacgagtggctgcccgtgagcaacgaccccgacaacccctgcagcctgaagtgccaggccaagggcaccaccctggtggtggagctggcccccaaggtgctggacggcaccagatgctacaccgagagcctggacatgtgcatcagcggcctgtgccagatcgtgggctgcgaccaccagctgggcagcaccgtgaaggaggacaactgcggcgtgtgcaacggcgacggcagcacctgcagactggtgagaggccagtacaagagccagctgagcgccaccaagagcgacgacaccgtggtggccatcccctacggcagcagacacatcagactggtgctgaagggccccgaccacctgtacctggagaccaagaccctgcagggcaccaagggcgagaacagcctgagcagcaccggcaccttcctggtggacaacagcagcgtggacttccagaagttccccgacaaggagatcctgagaatggccggccccctgaccgccgacttcatcgtgaagatcagaaacagcggcagcgccgacagcaccgtgcagttcatcttctaccagcccatcatccacagatggagagagaccgacttcttcccctgcagcgccacctgcggcggcggctaccagctgaccagcgccgagtgctacgacctgagaagcaacagagtggtggccgaccagtactgccactactaccccgagaacatcaagcccaagcccaagctgcaggagtgcaacctggacccctgccccgccagcgacggctacaagcagatcatgccctacgacctgtaccaccccctgcccagatgggaggccaccccctggaccgcctgcagcagcagctgcggcggcggcatccagagcagagccgtgagctgcgtggaggaggacatccagggccacgtgaccagcgtggaggagtggaagtgcatgtacacccccaagatgcccatcgcccagccctgcaacatcttcgactgccccaagtggctggcccaggagtggagcccctgcaccgtgacctgcggccagggcctgagatacagagtggtgctgtgcatcgaccacagaggcatgcacaccggcggctgcagccccaagaccaagccccacatcaaggaggagtgcatcgtgcccaccccctgctacaagcccaaggagaagctgcccgtggaggccaagctgccctggttcaagcaggcccaggagctggaggagggcgccgccgtgagcgaggagcccagcttcatccccgaggcctggagcgcctgcaccgtgacctgcggcgtgggcacccaggtgagaatcgtgagatgccaggtgctgctgagcttcagccagagcgtggccgacctgcccatcgacgagtgcgagggccccaagcccgccagccagagagcctgctacgccggcccctgcagcggcgagatccccgagttcaaccccgacgagaccgacggcctgttcggcggcctgcaggacttcgacgagctgtacgactgggagtacgagggcttcaccaagtgcagcgagagctgcggcggcggcgtgcaggaggccgtggtgagctgcctgaacaagcagaccagagagcccgccgaggagaacctgtgcgtgaccagcagaagacccccccagctgctgaagagctgcaacctggacccctgccccgccagatgggagatcggcaagtggagcccctgcagcctgacctgcggcgtgggcctgcagaccagagacgtgttctgcagccacctgctgagcagagagatgaacgagaccgtgatcctggccgacgagctgtgcagacagcccaagcccagcaccgtgcaggcctgcaacagattcaactgcccccccgcctggtaccccgcccagtggcagccctgcagcagaacctgcggcggcggcgtgcagaagagagaggtgctgtgcaagcagagaatggccgacggcagcttcctggagctgcccgagaccttctgcagcgccagcaagcccgcctgccagcaggcctgcaagaaggacgactgccccagcgagtggctgctgagcgactggaccgagtgcagcaccagctgcggcgagggcacccagaccagaagcgccatctgcagaaagatgctgaagaccggcctgagcaccgtggtgaacagcaccctgtgcccccccctgcccttcagcagcagcatcagaccctgcatgctggccacctgcgccagacccggcagacccagcaccaagcacagcccccacatcgccgccgccagaaaggtgtacatccagaccagaagacagagaaagctgcacttcgtggtgggcggcttcgcctacctgctgcccaagaccgccgtggtgctgagatgccccgccagaagagtgagaaagcccctgatcacctgggagaaggacggccagcacctgatcagcagcacccacgtgaccgtggcccccttcggctacctgaagatccacagactgaagcccagcgacgccggcgtgtacacctgcagcgccggccccgccagagagcacttcgtgatcaagctgatcggcggcaacagaaagctggtggccagacccctgagccccagaagcgaggaggaggtgctggccggcagaaagggcggccccaaggaggccctgcagacccacaagcaccagaacggcatcttcagcaacggcagcaaggccgagaagagaggcctggccgccaaccccggcagcagatacgacgacctggtgagcagactgctggagcagggcggctggcccggcgagctgctggccagctgggaggcccaggacagcgccgagagaaacaccaccagcgaggaggaccccggcgccgagcaggtgctgctgcacctgcccttcaccatggtgaccgagcagagaagactggacgacatcctgggcaacctgagccagcagcccgaggagctgagagacctgtacagcaagcacctggtggcccagctggcccaggagatcttcagaagccacctggagcaccaggacaccctgctgaagcccagcgagagaagaaccagccccgtgaccctgagcccccacaagcacgtgagcggcttcagcagcagcctgagaaccagcagcaccggcgacgccggcggcggcagcagaagaccccacagaaagcccaccatcctgagaaagatcagcgccgcccagcagctgagcgccagcgaggtggtgacccacctgggccagaccgtggccctggccagcggcaccctgagcgtgctgctgcactgcgaggccatcggccaccccagacccaccatcagctgggccagaaacggcgaggaggtgcagttcagcgacagaatcctgctgcagcccgacgacagcctgcagatcctggcccccgtggaggccgacgtgggcttctacacctgcaacgccaccaacgccctgggctacgacagcgtgagcatcgccgtgaccctggccggcaagcccctggtgaagaccagcagaatgaccgtgatcaacaccgagaagcccgccgtgaccgtggacatcggcagcaccatcaagaccgtgcagggcgtgaacgtgaccatcaactgccaggtggccggcgtgcccgaggccgaggtgacctggttcagaaacaagagcaagctgggcagcccccaccacctgcacgagggcagcctgctgctgaccaacgtgagcagcagcgaccagggcctgtacagctgcagagccgccaacctgcacggcgagctgaccgagagcacccagctgctgatcctggaccccccccaggtgcccacccagctggaggacatcagagccctgctggccgccaccggccccaacctgcccagcgtgctgaccagccccctgggcacccagctggtgctggaccccggcaacagcgccctgctgggctgccccatcaagggccaccccgtgcccaacatcacctggttccacggcggccagcccatcgtgaccgccaccggcctgacccaccacatcctggccgccggccagatcctgcaggtggccaacctgagcggcggcagccagggcgagttcagctgcctggcccagaacgaggccggcgtgctgatgcagaaggccagcctggtgatccaggactactggtggagcgtggacagactggccacctgcagcgccagctgcggcaacagaggcgtgcagcagcccagactgagatgcctgctgaacagcaccgaggtgaaccccgcccactgcgccggcaaggtgagacccgccgtgcagcccatcgcctgcaacagaagagactgccccagcagatggatggtgaccagctggagcgcctgcaccagaagctgcggcggcggcgtgcagaccagaagagtgacctgccagaagctgaaggccagcggcatcagcacccccgtgagcaacgacatgtgcacccaggtggccaagagacccgtggacacccaggcctgcaaccagcagctgtgcgtggagtgggccttcagcagctggggccagtgcaacggcccctgcatcggcccccacctggccgtgcagcacagacaggtgttctgccagaccagagacggcatcaccctgcccagcgagcagtgcagcgccctgcccagacccgtgagcacccagaactgctggagcgaggcctgcagcgtgcactggagagtgagcctgtggaccctgtgcaccgccacctgcggcaactacggcttccagagcagaagagtggagtgcgtgcacgccagaaccaacaaggccgtgcccgagcacctgtgcagctggggccccagacccgccaactggcagagatgcaacatcaccccctgcgagaacatggagtgcagagacaccaccagatactgcgagaaggtgaagcagctgaagctgtgccagctgagccagttcaagagcagatgctgcggcacctgcggcaaggcctag

SEQ ID NO: 71879 - DNA, 1320 bp, Artificial Sequence
  Description of Artificial Sequence: Synthetic coding sequence
atggagtgctgcagaagagccacccccggcaccctgctgctgttcctggccttcctgctgctgagcagcagaaccgccagaagcgaggaggacagagacggcctgtgggacgcctggggcccctggagcgagtgcagcagaacctgcggcggcggcgccagctacagcctgagaagatgcctgagcagcaagagctgcgagggcagaaacatcagatacagaacctgcagcaacgtggactgcccccccgaggccggcgacttcagagcccagcagtgcagcgcccacaacgacgtgaagcaccacggccagttctacgagtggctgcccgtgagcaacgaccccgacaacccctgcagcctgaagtgccaggccaagggcaccaccctggtggtggagctggcccccaaggtgctggacggcaccagatgctacaccgagagcctggacatgtgcatcagcggcctgtgccagatcgtgggctgcgaccaccagctgggcagcaccgtgaaggaggacaactgcggcgtgtgcaacggcgacggcagcacctgcagactggtgagaggccagtacaagagccagctgagcgccaccaagagcgacgacaccgtggtggccatcccctacggcagcagacacatcagactggtgctgaagggccccgaccacctgtacctggagaccaagaccctgcagggcaccaagggcgagaacagcctgagcagcaccggcaccttcctggtggacaacagcagcgtggacttccagaagttccccgacaaggagatcctgagaatggccggccccctgaccgccgacttcatcgtgaagatcagaaacagcggcagcgccgacagcaccgtgcagttcatcttctaccagcccatcatccacagatggagagagaccgacttcttcccctgcagcgccacctgcggcggcggctaccagctgaccagcgccgagtgctacgacctgagaagcaacagagtggtggccgaccagtactgccactactaccccgagaacatcaagcccaagcccaagctgcaggagtgcaacctggacccctgccccgccagatgggaggccaccccctggaccgcctgcagcagcagctgcggcggcggcatccagagcagagccgtgagctgcgtggaggaggacatccagggccacgtgaccagcgtggaggagtggaagtgcatgtacacccccaagatgcccatcgcccagccctgcaacatcttcgactgccccaagtggctggcccaggagtggagccccgtgaccgtgcccagcttcttcgtgcactag

SEQ ID NO: 71880 - DNA, 2856 bp, Artificial Sequence
  Description of Artificial Sequence: Synthetic coding sequence
atggacggcagatggcagtgcagctgctgggcctggttcctgctggtgctggccgtggtggccggcgacaccgtgagcaccggcagcaccgacaacagccccaccagcaacagcctggagggcggcaccgacgccaccgccttctggtggggcgagtggaccaagtggaccgcctgcagcagaagctgcggcggcggcgtgaccagccaggagagacactgcctgcagcagagaagaaagagcgtgcccggccccggcaacagaacctgcaccggcaccagcaagagataccagctgtgcagagtgcaggagtgcccccccgacggcagaagcttcagagaggagcagtgcgtgagcttcaacagccacgtgtacaacggcagaacccaccagtggaagcccctgtaccccgacgactacgtgcacatcagcagcaagccctgcgacctgcactgcaccaccgtggacggccagagacagctgatggtgcccgccagagacggcaccagctgcaagctgaccgacctgagaggcgtgtgcgtgagcggcaagtgcgagcccatcggctgcgacggcgtgctgttcagcacccacaccctggacaagtgcggcatctgccagggcgacggcagcagctgcacccacgtgaccggcaactacagaaagggcaacgcccacctgggctacagcctggtgacccacatccccgccggcgccagagacatccagatcgtggagagaaagaagagcgccgacgtgctggccctggccgacgaggccggctactacttcttcaacggcaactacaaggtggacagccccaagaacttcaacatcgccggcaccgtggtgaagtacagaagacccatggacgtgtacgagaccggcatcgagtacatcgtggcccagggccccaccaaccagggcctgaacgtgatggtgtggaaccagaacggcaagagccccagcatcaccttcgagtacaccctgctgcagcccccccacgagagcagaccccagcccatctactacggcttcagcgagagcgccgagagccagggcctggacggcgccggcctgatgggcttcgtgccccacaacggcagcctgtacggccaggccagcagcgagagactgggcctggacaacagactgttcggccaccccggcctggacatggagctgggccccagccagggccaggagaccaacgaggtgtgcgagcaggccggcggcggcgcctgcgagggcccccccagaggcaagggcttcagagacagaaacgtgaccggcacccccctgaccggcgacaaggacgacgaggaggtggacacccacttcgccagccaggagttcttcagcgccaacgccatcagcgaccagctgctgggcgccggcagcgacctgaaggacttcaccctgaacgagaccgtgaacagcatcttcgcccagggcgcccccagaagcagcctggccgagagcttcttcgtggactacgaggagaacgagggcgccggcccctacctgctgaacggcagctacctggagctgagcagcgacagagtggccaacagcagcagcgaggcccccttccccaacgtgagcaccagcctgctgaccagcgccggcaacagaacccacaaggccagaaccagacccaaggccagaaagcagggcgtgagccccgccgacatgtacagatggaagctgagcagccacgagccctgcagcgccacctgcaccaccggcgtgatgagcgcctacgccatgtgcgtgagatacgacggcgtggaggtggacgacagctactgcgacgccctgaccagacccgagcccgtgcacgagttctgcgccggcagagagtgccagcccagatgggagaccagcagctggagcgagtgcagcagaacctgcggcgagggctaccagttcagagtggtgagatgctggaagatgctgagccccggcttcgacagcagcgtgtacagcgacctgtgcgaggccgccgaggccgtgagacccgaggagagaaagacctgcagaaaccccgcctgcggcccccagtgggagatgagcgagtggagcgagtgcaccgccaagtgcggcgagagaagcgtggtgaccagagacatcagatgcagcgaggacgagaagctgtgcgaccccaacaccagacccgtgggcgagaagaactgcaccggccccccctgcgacagacagtggaccgtgagcgactggggcccctgcagcggcagctgcggccagggcagaaccatcagacacgtgtactgcaagaccagcgacggcagagtggtgcccgagagccagtgccagatggagaccaagcccctggccatccacccctgcggcgacaagaactgccccgcccactggctggcccaggactgggagagatgcaacaccacctgcggcagaggcgtgaagaagagactggtgctgtgcatggagctggccaacggcaagccccagaccagaagcggccccgagtgcggcctggccaagaagccccccgaggagagcacctgcttcgagagaccctgcttcaagtggtacaccagcccctggagcgagtgcaccaagacctgcggcgtgggcgtgagaatgagagacgtgaagtgctaccagggcaccgacatcgtgagaggctgcgaccccctggtgaagcccgtgggcagacaggcctgcgacctgcagccctgccccaccgagccccccgacgacagctgccaggaccagcccggcaccaactgcgccctggccatcaaggtgaacctgtgcggccactggtactacagcaaggcctgctgcagaagctgcagacccccccacagctag

SEQ ID NO: 71881 - DNA, 2856 bp, Artificial Sequence; identical to SEQ ID NO: 71880
  Description of Artificial Sequence: Synthetic coding sequence

SEQ ID NO: 71882 - DNA, 3183 bp, Artificial Sequence
  Description of Artificial Sequence: Synthetic coding sequence
atgctgttcgaggtgggcgagggcggcggcgccggcgaggagggcaagggcagaggcagacccggcagaagcctgtgcacccacgccgcccccgccagaaccgcccacctggcccccagcgccctgagaagcgccagacccttcctgtgggaggacaacctgctgaccagaagccagggcctgcccgacaaccacgaccagctggtgcccgacaacctggaggcctgggccctggccggccccagaggcctgttccccaagagaaccctggtgatctggaagagaatcggcgccggcctggtggtgaccgtggccctgctgcccagaatggacggcagatggcagtgcagctgctgggcctggttcctgctggtgctggccgtggtggccggcgacaccgtgagcaccggcagcaccgacaacagccccaccagcaacagcctggagggcggcaccgacgccaccgccttctggtggggcgagtggaccaagtggaccgcctgcagcagaagctgcggcggcggcgtgaccagccaggagagacactgcctgcagcagagaagaaagagcgtgcccggccccggcaacagaacctgcaccggcaccagcaagagataccagctgtgcagagtgcaggagtgcccccccgacggcagaagcttcagagaggagcagtgcgtgagcttcaacagccacgtgtacaacggcagaacccaccagtggaagcccctgtaccccgacgactacgtgcacatcagcagcaagccctgcgacctgcactgcaccaccgtggacggccagagacagctgatggtgcccgccagagacggcaccagctgcaagctgaccgacctgagaggcgtgtgcgtgagcggcaagtgcgagcccatcggctgcgacggcgtgctgttcagcacccacaccctggacaagtgcggcatctgccagggcgacggcagcagctgcacccacgtgaccggcaactacagaaagggcaacgcccacctgggctacagcctggtgacccacatccccgccggcgccagagacatccagatcgtggagagaaagaagagcgccgacgtgctggccctggccgacgaggccggctactacttcttcaacggcaactacaaggtggacagccccaagaacttcaacatcgccggcaccgtggtgaagtacagaagacccatggacgtgtacgagaccggcatcgagtacatcgtggcccagggccccaccaaccagggcctgaacgtgatggtgtggaaccagaacggcaagagccccagcatcaccttcgagtacaccctgctgcagcccccccacgagagcagaccccagcccatctactacggcttcagcgagagcgccgagagccagggcctggacggcgccggcctgatgggcttcgtgccccacaacggcagcctgtacggccaggccagcagcgagagactgggcctggacaacagactgttcggccaccccggcctggacatggagctgggccccagccagggccaggagaccaacgaggtgtgcgagcaggccggcggcggcgcctgcgagggcccccccagaggcaagggcttcagagacagaaacgtgaccggcacccccctgaccggcgacaaggacgacgaggaggtggacacccacttcgccagccaggagttcttcagcgccaacgccatcagcgaccagctgctgggcgccggcagcgacctgaaggacttcaccctgaacgagaccgtgaacagcatcttcgcccagggcgcccccagaagcagcctggccgagagcttcttcgtggactacgaggagaacgagggcgccggcccctacctgctgaacggcagctacctggagctgagcagcgacagagtggccaacagcagcagcgaggcccccttccccaacgtgagcaccagcctgctgaccagcgccggcaacagaacccacaaggccagaaccagacccaaggccagaaagcagggcgtgagccccgccgacatgtacagatggaagctgagcagccacgagccctgcagcgccacctgcaccaccggcgtgatgagcgcctacgccatgtgcgtgagatacgacggcgtggaggtggacgacagctactgcgacgccctgaccagacccgagcccgtgcacgagttctgcgccggcagagagtgccagcccagatgggagaccagcagctggagcgagtgcagcagaacctgcggcgagggctaccagttcagagtggtgagatgctggaagatgctgagccccggcttcgacagcagcgtgtacagcgacctgtgcgaggccgccgaggccgtgagacccgaggagagaaagacctgcagaaaccccgcctgcggcccccagtgggagatgagcgagtggagcgagtgcaccgccaagtgcggcgagagaagcgtggtgaccagagacatcagatgcagcgaggacgagaagctgtgcgaccccaacaccagacccgtgggcgagaagaactgcaccggccccccctgcgacagacagtggaccgtgagcgactggggcccctgcagcggcagctgcggccagggcagaaccatcagacacgtgtactgcaagaccagcgacggcagagtggtgcccgagagccagtgccagatggagaccaagcccctggccatccacccctgcggcgacaagaactgccccgcccactggctggcccaggactgggagagatgcaacaccacctgcggcagaggcgtgaagaagagactggtgctgtgcatggagctggccaacggcaagccccagaccagaagcggccccgagtgcggcctggccaagaagccccccgaggagagcacctgcttcgagagaccctgcttcaagtggtacaccagcccctggagcgagtgcaccaagacctgcggcgtgggcgtgagaatgagagacgtgaagtgctaccagggcaccgacatcgtgagaggctgcgaccccctggtgaagcccgtgggcagacaggcctgcgacctgcagccctgccccaccgagccccccgacgacagctgccaggaccagcccggcaccaactgcgccctggccatcaaggtgaacctgtgcggccactggtactacagcaaggcctgctgcagaagctgcagacccccccacagctag

SEQ ID NO: 71883 - DNA, 5076 bp, Artificial Sequence
  Description of Artificial Sequence: Synthetic coding sequence
atggccagctggaccagcccctggtgggtgctgatcggcatggtgttcatgcacagccccctgccccagaccaccgccgagaagagccccggcgcctacttcctgcccgagttcgccctgagcccccagggcagcttcctggaggacaccaccggcgagcagttcctgacctacagatacgacgaccagaccagcagaaacaccagaagcgacgaggacaaggacggcaactgggacgcctggggcgactggagcgactgcagcagaacctgcggcggcggcgccagctacagcctgagaagatgcctgaccggcagaaactgcgagggccagaacatcagatacaagacctgcagcaaccacgactgcccccccgacgccgaggacttcagagcccagcagtgcagcgcctacaacgacgtgcagtaccagggccactactacgagtggctgcccagatacaacgaccccgccgccccctgcgccctgaagtgccacgcccagggccagaacctggtggtggagctggcccccaaggtgctggacggcaccagatgcaacaccgacagcctggacatgtgcatcagcggcatctgccaggccgtgggctgcgacagacagctgggcagcaacgccaaggaggacaactgcggcgtgtgcgccggcgacggcagcacctgcagactggtgagaggccagagcaagagccacgtgagccccgagaagagagaggagaacgtgatcgccgtgcccctgggcagcagaagcgtgagaatcaccgtgaagggccccgcccacctgttcatcgagagcaagaccctgcagggcagcaagggcgagcacagcttcaacagccccggcgtgttcctggtggagaacaccaccgtggagttccagagaggcagcgagagacagaccttcaagatccccggccccctgatggccgacttcatcttcaagaccagatacaccgccgccaaggacagcgtggtgcagttcttcttctaccagcccatcagccaccagtggagacagaccgacttcttcccctgcaccgtgacctgcggcggcggctaccagctgaacagcgccgagtgcgtggacatcagactgaagagagtggtgcccgaccactactgccactactaccccgagaacgtgaagcccaagcccaagctgaaggagtgcagcatggacccctgccccagcagcgacggcttcaaggagatcatgccctacgaccacttccagcccctgcccagatgggagcacaacccctggaccgcctgcagcgtgagctgcggcggcggcatccagagaagaagcttcgtgtgcgtggaggagagcatgcacggcgagatcctgcaggtggaggagtggaagtgcatgtacgcccccaagcccaaggtgatgcagacctgcaacctgttcgactgccccaagtggatcgccatggagtggagccagtgcaccgtgacctgcggcagaggcctgagatacagagtggtgctgtgcatcaaccacagaggcgagcacgtgggcggctgcaacccccagctgaagctgcacatcaaggaggagtgcgtgatccccatcccctgctacaagcccaaggagaagagccccgtggaggccaagctgccctggctgaagcaggcccaggagctggaggagaccagaatcgccaccgaggagcccaccttcatccccgagccctggagcgcctgcagcaccacctgcggccccggcgtgcaggtgagagaggtgaagtgcagagtgctgctgaccttcacccagaccgagaccgagctgcccgaggaggagtgcgagggccccaagctgcccaccgagagaccctgcctgctggaggcctgcgacgagagccccgccagcagagagctggacatccccctgcccgaggacagcgagaccacctacgactgggagtacgccggcttcaccccctgcaccgccacctgcgtgggcggccaccaggaggccatcgccgtgtgcctgcacatccagacccagcagaccgtgaacgacagcctgtgcgacatggtgcacagaccccccgccatgagccaggcctgcaacaccgagccctgcccccccagatggcacgtgggcagctggggcccctgcagcgccacctgcggcgtgggcatccagaccagagacgtgtactgcctgcaccccggcgagacccccgccccccccgaggagtgcagagacgagaagccccacgccctgcaggcctgcaaccagttcgactgcccccccggctggcacatcgaggagtggcagcagtgcagcagaacctgcggcggcggcacccagaacagaagagtgacctgcagacagctgctgaccgacggcagcttcctgaacctgagcgacgagctgtgccagggccccaaggccagcagccacaagagctgcgccagaaccgactgccccccccacctggccgtgggcgactggagcaagtgcagcgtgagctgcggcgtgggcatccagagaagaaagcaggtgtgccagagactggccgccaagggcagaagaatccccctgagcgagatgatgtgcagagacctgcccggcctgcccctggtgagaagctgccagatgcccgagtgcagcaagatcaagagcgagatgaagaccaagctgggcgagcagggcccccagatcctgagcgtgcagagagtgtacatccagaccagagaggagaagagaatcaacctgaccatcggcagcagagcctacctgctgcccaacaccagcgtgatcatcaagtgccccgtgagaagattccagaagagcctgatccagtgggagaaggacggcagatgcctgcagaacagcaagagactgggcatcaccaagagcggcagcctgaagatccacggcctggccgcccccgacatcggcgtgtacagatgcatcgccggcagcgcccaggagaccgtggtgctgaagctgatcggcaccgacaacagactgatcgccagacccgccctgagagagcccatgagagagtaccccggcatggaccacagcgaggccaacagcctgggcgtgacctggcacaagatgagacagatgtggaacaacaagaacgacctgtacctggacgacgaccacatcagcaaccagcccttcctgagagccctgctgggccactgcagcaacagcgccggcagcaccaacagctgggagctgaagaacaagcagttcgaggccgccgtgaagcagggcgcctacagcatggacaccgcccagttcgacgagctgatcagaaacatgagccagctgatggagaccggcgaggtgagcgacgacctggccagccagctgatctaccagctggtggccgagctggccaaggcccagcccacccacatgcagtggagaggcatccaggaggagaccccccccgccgcccagctgagaggcgagaccggcagcgtgagccagagcagccacgccaagaacagcggcaagctgaccttcaagcccaagggccccgtgctgatgagacagagccagccccccagcatcagcttcaacaagaccatcaacagcagaatcggcaacaccgtgtacatcaccaagagaaccgaggtgatcaacatcctgtgcgacctgatcacccccagcgaggccacctacacctggaccaaggacggcaccctgctgcagcccagcgtgaagatcatcctggacggcaccggcaagatccagatccagaaccccaccagaaaggagcagggcatctacgagtgcagcgtggccaaccacctgggcagcgacgtggagagcagcagcgtgctgtacgccgaggcccccgtgatcctgagcgtggagagaaacatcaccaagcccgagcacaaccacctgagcgtggtggtgggcggcatcgtggaggccgccctgggcgccaacgtgaccatcagatgccccgtgaagggcgtgccccagcccaacatcacctggctgaagagaggcggcagcctgagcggcaacgtgagcctgctgttcaacggcagcctgctgctgcagaacgtgagcctggagaacgagggcacctacgtgtgcatcgccaccaacgccctgggcaaggccgtggccaccagcgtgctgcacctgctggagagaagatggcccgagagcagaatcgtgttcctgcagggccacaagaagtacatcctgcaggccaccaacaccagaaccaacagcaacgaccccaccggcgagccccccccccaggagcccttctgggagcccggcaactggagccactgcagcgccacctgcggccacctgggcgccagaatccagagaccccagtgcgtgatggccaacggccaggaggtgagcgaggccctgtgcgaccacctgcagaagcccctggccggcttcgagccctgcaacatcagagactgccccgccagatggttcaccagcgtgtggagccagtgcagcgtgagctgcggcgagggctaccacagcagacaggtgacctgcaagagaaccaaggccaacggcaccgtgcaggtggtgagccccagagcctgcgcccccaaggacagacccctgggcagaaagccctgcttcggccacccctgcgtgcagtgggagcccggcaacagatgccccggcagatgcatgggcagagccgtgagaatgcagcagagacacaccgcctgccagcacaacagcagcgacagcaactgcgacgacagaaagagacccaccctgagaagaaactgcaccagcggcgcctgcgacgtgtgctggcacaccggcccctggaagccctgcaccgccgcctgcggcagaggcttccagagcagaaaggtggactgcatccacaccagaagctgcaagcccgtggccaagagacactgcgtgcagaagaagaagcccatcagctggagacactgcctgggccccagctgcgacagagactgcaccgacaccacccactactgcatgttcgtgaagcacctgaacctgtgcagcctggacagatacaagcagagatgctgccagagctgccaggagggctag

SEQ ID NO: 71884 - DNA, 3225 bp, Artificial Sequence
  Description of Artificial Sequence: Synthetic coding sequence
atggagaactggaccggcagaccctggctgtacctgctgctgctgctgagcctgccccagctgtgcctggaccaggaggtgctgagcggccacagcctgcagacccccaccgaggagggccagggccccgagggcgtgtggggcccctgggtgcagtgggccagctgcagccagccctgcggcgtgggcgtgcagagaagaagcagaacctgccagctgcccaccgtgcagctgcaccccagcctgcccctgccccccagaccccccagacaccccgaggccctgctgcccagaggccagggccccagaccccagaccagccccgagaccctgcccctgtacagaacccagagcagaggcagaggcggccccctgagaggccccgccagccacctgggcagagaggagacccaggagatcagagccgccagaagaagcagactgagagaccccatcaagcccggcatgttcggctacggcagagtgcccttcgccctgcccctgcacagaaacagaagacaccccagaagcccccccagaagcgagctgagcctgatcagcagcagaggcgaggaggccatccccagccccacccccagagccgagcccttcagcgccaacggcagcccccagaccgagctgccccccaccgagctgagcgtgcacacccccagcccccaggccgagcccctgagccccgagaccgcccagaccgaggtggcccccagaaccagacccgcccccctgagacaccaccccagagcccaggccagcggcaccgagccccccagccccacccacagcctgggcgagggcggcttcttcagagccagcccccagcccagaagacccagcagccagggctgggccagcccccaggtggccggcagaagacccgaccccttccccagcgtgcccagaggcagaggccagcagggccagggcccctggggcaccggcggcaccccccacggccccagactggagcccgacccccagcaccccggcgcctggctgcccctgctgagcaacggcccccacgccagcagcctgtggagcctgttcgcccccagcagccccatccccagatgcagcggcgagagcgagcagctgagagcctgcagccaggccccctgcccccccgagcagcccgaccccagagccctgcagtgcgccgccttcaacagccaggagttcatgggccagctgtaccagtgggagcccttcaccgaggtgcagggcagccagagatgcgagctgaactgcagacccagaggcttcagattctacgtgagacacaccgagaaggtgcaggacggcaccctgtgccagcccggcgcccccgacatctgcgtggccggcagatgcctgagccccggctgcgacggcatcctgggcagcggcagaagacccgacggctgcggcgtgtgcggcggcgacgacagcacctgcagactggtgagcggcaacctgaccgacagaggcggccccctgggctaccagaagatcctgtggatccccgccggcgccctgagactgcagatcgcccagctgagacccagcagcaactacctggccctgagaggccccggcggcagaagcatcatcaacggcaactgggccgtggacccccccggcagctacagagccggcggcaccgtgttcagatacaacagaccccccagagaggagggcaagggcgagagcctgagcgccgagggccccaccacccagcccgtggacgtgtacatgatcttccaggaggagaaccccggcgtgttctaccagtacgtgatcagcagccccccccccatcctggagaaccccacccccgagccccccgtgccccagctgcagcccgagatcctgagagtggagccccccctggcccccgcccccagacccgccagaacccccggcaccctgcagagacaggtgagaatcccccagatgcccgcccccccccaccccagaacccccctgggcagccccgccgcctactggaagagagtgggccacagcgcctgcagcgccagctgcggcaagggcgtgtggagacccatcttcctgtgcatcagcagagagagcggcgaggagctggacgagagaagctgcgccgccggcgccagaccccccgccagccccgagccctgccacggcaccccctgccccccctactgggaggccggcgagtggaccagctgcagcagaagctgcggccccggcacccagcacagacagctgcagtgcagacaggagttcggcggcggcggcagcagcgtgccccccgagagatgcggccacctgcccagacccaacatcacccagagctgccagctgagactgtgcggccactgggaggtgggcagcccctggagccagtgcagcgtgagatgcggcagaggccagagaagcagacaggtgagatgcgtgggcaacaacggcgacgaggtgagcgagcaggagtgcgccagcggccccccccagccccccagcagagaggcctgcgacatgggcccctgcaccaccgcctggttccacagcgactggagcagcaagtgcagcgccgagtgcggcaccggcatccagagaagaagcgtggtgtgcctgggcagcggcgccgccctgggccccggccagggcgaggccggcgccggcaccggccagagctgccccaccggcagcagaccccccgacatgagagcctgcagcctgggcccctgcgagagaacctggagatggtacaccggcccctggggcgagtgcagcagcgagtgcggcagcggcacccagagaagagacatcatctgcgtgagcaagctgggcaccgagttcaacgtgaccagccccagcaactgcagccacctgcccagaccccccgccctgcagccctgccagggccaggcctgccaggacagatggttcagcaccccctggagcccctgcagcagaagctgccagggcggcacccagaccagagaggtgcagtgcctgagcaccaaccagaccctgagcaccagatgccccccccagctgagacccagcagaaagagaccctgcaacagccagccctgcagccagagacccgacgaccagtgcaaggacagcagcccccactgccccctggtggtgcaggccagactgtgcgtgtacccctactacaccgccacctgctgcagaagctgcgcccacgtgctggagagaagcccccaggaccccagctag

SEQ ID NO: 71885 - DNA, 3225 bp, Artificial Sequence; identical to SEQ ID NO: 71884
  Description of Artificial Sequence: Synthetic coding sequence

SEQ ID NO: 71886 - DNA, 3294 bp, Artificial Sequence
  Description of Artificial Sequence: Synthetic coding sequence
atggagaactggaccggcagaccctggctgtacctgctgctgctgctgagcctgccccagctgtgcctggaccaggaggtgctgagcggccacagcctgcagacccccaccgaggagggccagggccccgagggcgtgtggggcccctgggtgcagtgggccagctgcagccagccctgcggcgtgggcgtgcagagaagaagcagaacctgccagctgcccaccgtgcagctgcaccccagcctgcccctgccccccagaccccccagacaccccgaggccctgctgcccagaggccagggccccagaccccagaccagccccgagaccctgcccctgtacagaacccagagcagaggcagaggcggccccctgagaggccccgccagccacctgggcagagaggagacccaggagatcagagccgccagaagaagcagactgagagaccccatcaagcccggcatgttcggctacggcagagtgcccttcgccctgcccctgcacagaaacagaagacaccccagaagcccccccagaagcgagctgagcctgatcagcagcagaggcgaggaggccatccccagccccacccccagagccgagcccttcagcgccaacggcagcccccagaccgagctgccccccaccgagctgagcgtgcacacccccagcccccaggccgagcccctgagccccgagaccgcccagaccgaggtggcccccagaaccagacccgcccccctgagacaccaccccagagcccaggccagcggcaccgagccccccagccccacccacagcctgggcgagggcggcttcttcagagccagcccccagcccagaagacccagcagccagggctgggccagcccccaggtggccggcagaagacccgaccccttccccagcgtgcccagaggcagaggccagcagggccagggcccctggggcaccggcggcaccccccacggccccagactggagcccgacccccagcaccccggcgcctggctgcccctgctgagcaacggcccccacgccagcagcctgtggagcctgttcgcccccagcagccccatccccagatgcagcggcgagagcgagcagctgagagcctgcagccaggccccctgcccccccgagcagcccgaccccagagccctgcagtgcgccgccttcaacagccaggagttcatgggccagctgtaccagtgggagcccttcaccgaggcccccctgctgcccctgagacacgccttcttcctgctgcccggcgccggcagcggcgacagcaccggcgtgcagggcagccagagatgcgagctgaactgcagacccagaggcttcagattctacgtgagacacaccgagaaggtgcaggacggcaccctgtgccagcccggcgcccccgacatctgcgtggccggcagatgcctgagccccggctgcgacggcatcctgggcagcggcagaagacccgacggctgcggcgtgtgcggcggcgacgacagcacctgcagactggtgagcggcaacctgaccgacagaggcggccccctgggctaccagaagatcctgtggatccccgccggcgccctgagactgcagatcgcccagctgagacccagcagcaactacctggccctgagaggccccggcggcagaagcatcatcaacggcaactgggccgtggacccccccggcagctacagagccggcggcaccgtgttcagatacaacagaccccccagagaggagggcaagggcgagagcctgagcgccgagggccccaccacccagcccgtggacgtgtacatgatcttccaggaggagaaccccggcgtgttctaccagtacgtgatcagcagccccccccccatcctggagaaccccacccccgagccccccgtgccccagctgcagcccgagatcctgagagtggagccccccctggcccccgcccccagacccgccagaacccccggcaccctgcagagacaggtgagaatcccccagatgcccgcccccccccaccccagaacccccctgggcagccccgccgcctactggaagagagtgggccacagcgcctgcagcgccagctgcggcaagggcgtgtggagacccatcttcctgtgcatcagcagagagagcggcgaggagctggacgagagaagctgcgccgccggcgccagaccccccgccagccccgagccctgccacggcaccccctgccccccctactgggaggccggcgagtggaccagctgcagcagaagctgcggccccggcacccagcacagacagctgcagtgcagacaggagttcggcggcggcggcagcagcgtgccccccgagagatgcggccacctgcccagacccaacatcacccagagctgccagctgagactgtgcggccactgggaggtgggcagcccctggagccagtgcagcgtgagatgcggcagaggccagagaagcagacaggtgagatgcgtgggcaacaacggcgacgaggtgagcgagcaggagtgcgccagcggccccccccagccccccagcagagaggcctgcgacatgggcccctgcaccaccgcctggttccacagcgactggagcagcaagtgcagcgccgagtgcggcaccggcatccagagaagaagcgtggtgtgcctgggcagcggcgccgccctgggccccggccagggcgaggccggcgccggcaccggccagagctgccccaccggcagcagaccccccgacatgagagcctgcagcctgggcccctgcgagagaacctggagatggtacaccggcccctggggcgagtgcagcagcgagtgcggcagcggcacccagagaagagacatcatctgcgtgagcaagctgggcaccgagttcaacgtgaccagccccagcaactgcagccacctgcccagaccccccgccctgcagccctgccagggccaggcctgccaggacagatggttcagcaccccctggagcccctgcagcagaagctgccagggcggcacccagaccagagaggtgcagtgcctgagcaccaaccagaccctgagcaccagatgccccccccagctgagacccagcagaaagagaccctgcaacagccagccctgcagccagagacccgacgaccagtgcaaggacagcagcccccactgccccctggtggtgcaggccagactgtgcgtgtacccctactacaccgccacctgctgcagaagctgcgcccacgtgctggagagaagcccccaggaccccagctag

SEQ ID NO: 71887 - DNA, 2634 bp, Artificial Sequence
  Description of Artificial Sequence: Synthetic coding sequence
atggagaactggaccggcagaccctggctgtacctgctgctgctgctgagcctgccccagctgtgcctggaccaggaggtgctgagcggccacagcctgcagacccccaccgaggagggccagggccccgagggcgtgtggggcccctgggtgcagtgggccagctgcagccagccctgcggcgtgggcgtgcagagaagaagcagaacctgccagctgcccaccgtgcagctgcaccccagcctgcccctgccccccagaccccccagacaccccgaggccctgctgcccagaggccagggccccagaccccagaccagccccgagaccctgcccctgtacagaacccagagcagaggcagaggcggccccctgagaggccccgccagccacctgggcagagaggagacccaggagatcagagccgccagaagaagcagactgagagaccccatcaagcccggcatgttcggctacggcagagtgcccttcgccctgcccctgcacagaaacagaagacaccccagaagcccccccagaagcgagctgagcctgatcagcagcagaggcgaggaggccatccccagccccacccccagagccgagcccttcagcgccaacggcagcccccagaccgagctgccccccaccgagctgagcgtgcacacccccagcccccaggccgagcccctgagccccgagaccgcccagaccgaggtggcccccagaaccagacccgcccccctgagacaccaccccagagcccaggccagcggcaccgagccccccagccccacccacagcctgggcgagggcggcttcttcagagccagcccccagcccagaagacccagcagccagggctgggccagcccccaggtggccggcagaagacccgaccccttccccagcgtgcccagaggcagaggccagcagggccagggcccctggggcaccggcggcaccccccacggccccagactggagcccgacccccagcaccccggcgcctggctgcccctgctgagcaacggcccccacgccagcagcctgtggagcctgttcgcccccagcagccccatccccagatgcagcggcgagagcgagcagctgagagcctgcagccaggccccctgcccccccgagcagcccgaccccagagccctgcagtgcgccgccttcaacagccaggagttcatgggccagctgtaccagtgggagcccttcaccgaggtgcagggcagccagagatgcgagctgaactgcagacccagaggcttcagattctacgtgagacacaccgagaaggtgcaggacggcaccctgtgccagcccggcgcccccgacatctgcgtggccggcagatgcctgagccccggctgcgacggcatcctgggcagcggcagaagacccgacggctgcggcgtgtgcggcggcgacgacagcacctgcagactggtgagcggcaacctgaccgacagaggcggccccctgggctaccagaagatcctgtggatccccgccggcgccctgagactgcagatcgcccagctgagacccagcagcaactacctggccctgagaggccccggcggcagaagcatcatcaacggcaactgggccgtggacccccccggcagctacagagccggcggcaccgtgttcagatacaacagaccccccagagaggagggcaagggcgagagcctgagcgccgagggccccaccacccagcccgtggacgtgtacatgatcttccaggaggagaaccccggcgtgttctaccagtacgtgatcagcagccccccccccatcctggagaaccccacccccgagccccccgtgccccagctgcagcccgagatcctgagagtggagccccccctggcccccgcccccagacccgccagaacccccggcaccctgcagagacaggtgagaatcccccagatgcccgcccccccccaccccagaacccccctgggcagccccgccgcctactggaagagagtgggccacagcgcctgcagcgccagctgcggcaagggcgtgtggagacccatcttcctgtgcatcagcagagagagcggcgaggagctggacgagagaagctgcgccgccggcgccagaccccccgccagccccgagccctgccacggcaccccctgccccccctactgggaggccggcgagtggaccagctgcagcagaagctgcggccccggcacccagcacagacagctgcagtgcagacaggagttcggcggcggcggcagcagcgtgccccccgagagatgcggccacctgcccagacccaacatcacccagagctgccagctgagactgtgcggccactgggaggtgggcagcccctggagccagtgcagcgtgagatgcggcagaggccagagaagcagacaggtgagatgcgtgggcaacaacggcgacgaggtgagcgagcaggagtgcgccagcggccccccccagccccccagcagagaggcctgcgacatgggcccctgcaccaccgcctggttccacagcgactggagcagcaaggtgagccccgagccccccgccatcagctgcatcctgggcaaccacgcccaggacaccagcgccttccccgcctag

SEQ ID NO: 71888 - DNA, 1311 bp, Artificial Sequence
  Description of Artificial Sequence: Synthetic coding sequence
atgggcagcctggccctggccggcgtgctgatggccgtggagagcgtgggcgtgatgatcctgcccgtggccctgttcagaggcaccagcctgaccgagggcgccccctgggccatcagaagaagctgcggcttccagagagagccctgcggcagcagactgcccagcagcggcctggcccccaccacctggcacttcgtggccctgggcagaagcatcatcaacggcaactgggccgtggacccccccggcagctacagagccggcggcaccgtgttcagatacaacagaccccccagagaggagggcaagggcgagagcctgagcgccgagggccccaccacccagcccgtggacgtgtacatgatcttccaggaggagaaccccggcgtgttctaccagtacgtgatcagcagccccccccccatcctggagaaccccacccccgagccccccgtgccccagctgcagcccgagatcctgagagtggagccccccctggcccccgcccccagacccgccagaacccccggcaccctgcagagacaggtgagaatcccccagatgcccgcccccccccaccccagaacccccctgggcagccccgccgcctactggaagagagtgggccacagcgcctgcagcgccagctgcggcaagggcgtgtggagacccatcttcctgtgcatcagcagagagagcggcgaggagctggacgagagaagctgcgccgccggcgccagaccccccgccagccccgagccctgccacggcaccccctgccccccctactgggaggccggcgagtggaccagctgcagcagaagctgcggccccggcacccagcacagacagctgcagtgcagacaggagttcggcggcggcggcagcagcgtgccccccgagagatgcggccacctgcccagacccaacatcacccagagctgccagctgagactgtgcggccactgggaggtgggcagcccctggagccagtgcagcgtgagatgcggcagaggccagagaagcagacaggtgagatgcgtgggcaacaacggcgacgaggtgagcgagcaggagtgcgccagcggccccccccagccccccagcagagaggcctgcgacatgggcccctgcaccaccgcctggttccacagcgactggagcagcaagtgcagcgccgagtgcggcaccggcatccagagaagaagcgtggtgtgcctgggcagcggcgccgccctgggccccggccagggcgaggccggcgccggcaccggccagagctgccccaccggcagcagacccccctag

SEQ ID NO: 71889 - DNA, 2130 bp, Artificial Sequence
  Description of Artificial Sequence: Synthetic coding sequence
atgcccggcatcgacaagctgcccatcgaggagaccctggaggacagcccccagaccagaagcctgctgggcgtgttcgaggaggacgccaccgccatcagcaactacatgaaccagctgtaccaggccatgcacagaatctacgacgcccagaacgagctgagcgccgccacccacctgaccagcaagctgctgaaggagtacgagaagcagagattccccctgggcggcgacgacgaggtgatgagcagcaccctgcagcagttcagcaaggtgatcgacgagctgagcagctgccacgccgtgctgagcacccagctggccgacgccatgatgttccccatcacccagttcaaggagagagacctgaaggagatcctgaccctgaaggaggtgttccagatcgccagcaacgaccacgacgccgccatcaacagatacagcagactgagcaagaagagagagaacgacaaggtgaagtacgaggtgaccgaggacgtgtacaccagcagaaagaagcagcaccagaccatgatgcactacttctgcgccctgaacaccctgcagtacaagaagaagatcgccctgctggagcccctgctgggctacatgcaggcccagatcagcttcttcaagatgggcagcgagaacctgaacgagcagctggaggagttcctggccaacatcggcaccagcgtgcagaacgtgagaagagagatggacagcgacatcgagaccatgcagcagaccatcgaggacctggaggtggccagcgaccccctgtacgtgcccgaccccgaccccaccaagttccccgtgaacagaaacctgaccagaaaggccggctacctgaacgccagaaacaagaccggcctggtgagcagcacctgggacagacagttctacttcacccagggcggcaacctgatgagccaggccagaggcgacgtggccggcggcctggccatggacatcgacaactgcagcgtgatggccgtggactgcgaggacagaagatactgcttccagatcaccagcttcgacggcaagaagagcagcatcctgcaggccgagagcaagaaggaccacgaggagtggatctgcaccatcaacaacatcagcaagcagatctacctgagcgagaaccccgaggagaccgccgccagagtgaaccagagcgccctggaggccgtgacccccagccccagcttccagcagagacacgagagcctgagacccgccgccggccagagcagaccccccaccgccagaaccagcagcagcggcagcctgggcagcgagagcaccaacctggccgccctgagcctggacagcctggtggcccccgacacccccatccagttcgacatcatcagccccgtgtgcgaggaccagcccggccaggccaaggccttcggccagggcggcagaagaaccaaccccttcggcgagagcggcggcagcaccaagagcgagaccgaggacagcatcctgcaccagctgttcatcgtgagattcctgggcagcatggaggtgaagagcgacgaccaccccgacgtggtgtacgagaccatgagacagatcctggccgccagagccatccacaacatcttcagaatgaccgagagccacctgctggtgacctgcgactgcctgaagctgatcgacccccagacccaggtgaccagactgaccttccccctgccctgcgtggtgctgtacgccacccaccaggagaacaagagactgttcggcttcgtgctgagaaccagcagcggcagaagcgagagcaacctgagcagcgtgtgctacatcttcgagagcaacaacgagggcgagaagatctgcgacagcgtgggcctggccaagcagatcgccctgcacgccgagctggacagaagagccagcgagaagcagaaggagatcgagagagtgaaggagaagcagcagaaggagctgaacaagcagaagcagatcgagaaggacctggaggagcagagcagactgatcgccgccagcagcagacccaaccaggccagcagcgagggccagttcgtggtgctgagcagcagccagagcgaggagagcgacctgggcgagggcggcaagaagagagagagcgaggcctag

SEQ ID NO: 71890 - DNA, 1995 bp, Artificial Sequence
  Description of Artificial Sequence: Synthetic coding sequence
atgcccgccgtggacaagctgctgctggaggaggccctgcaggacagcccccagaccagaagcctgctgagcgtgttcgaggaggacgccggcaccctgaccgactacaccaaccagctgctgcaggccatgcagagagtgtacggcgcccagaacgagatgtgcctggccacccagcagctgagcaagcagctgctggcctacgagaagcagaacttcgccctgggcaagggcgacgaggaggtgatcagcaccctgcactacttcagcaaggtggtggacgagctgaacctgctgcacaccgagctggccaagcagctggccgacaccatggtgctgcccatcatccagttcagagagaaggacctgaccgaggtgagcaccctgaaggacctgttcggcctggccagcaacgagcacgacctgagcatggccaagtacagcagactgcccaagaagaaggagaacgagaaggtgaagaccgaggtgggcaaggaggtggccgccgccagaagaaagcagcacctgagcagcctgcagtactactgcgccctgaacgccctgcagtacagaaagcagatggccatgatggagcccatgatcggcttcgcccacggccagatcaacttcttcaagaagggcgccgagatgttcagcaagagaatggacagcttcctgagcagcgtggccgacatggtgcagagcatccaggtggagctggaggccgaggccgagaagatgagagtgagccagcaggagctgctgagcgtggacgagagcgtgtacacccccgacagcgacgtggccgccccccagatcaacagaaacctgatccagaaggccggctacctgaacctgagaaacaagaccggcctggtgaccaccacctgggagagactgtacttcttcacccagggcggcaacctgatgtgccagcccagaggcgccgtggccggcggcctgatccaggacctggacaactgcagcgtgatggccgtggactgcgaggacagaagatactgcttccagatcaccacccccaacggcaagagcggcatcatcctgcaggccgagagcagaaaggagaacgaggagtggatctgcgccatcaacaacatcagcagacagatctacctgaccgacaaccccgaggccgtggccatcaagctgaaccagaccgccctgcaggccgtgacccccatcaccagcttcggcaagaagcaggagagcagctgccccagccagaacctgaagaacagcgagatggagaacgagaacgacaagatcgtgcccaaggccaccgccagcctgcccgaggccgaggagctgatcgcccccggcacccccatccagttcgacatcgtgctgcccgccaccgagttcctggaccagaacagaggcagcagaagaaccaaccccttcggcgagaccgaggacgagagcttccccgaggccgaggacagcctgctgcagcagatgttcatcgtgagattcctgggcagcatggccgtgaagaccgacagcaccaccgaggtgatctacgaggccatgagacaggtgctggccgccagagccatccacaacatcttcagaatgaccgagagccacctgatggtgaccagccagagcctgagactgatcgacccccagacccaggtgagcagagccaacttcgagctgaccagcgtgacccagttcgccgcccaccaggagaacaagagactggtgggcttcgtgatcagagtgcccgagagcaccggcgaggagagcctgagcacctacatcttcgagagcaacagcgagggcgagaagatctgctacgccatcaacctgggcaaggagatcatcgaggtgcagaaggaccccgaggccctggcccagctgatgctgagcatccccctgaccaacgacggcaagtacgtgctgctgaacgaccagcccgacgacgacgacggcaaccccaacgagcacagaggcgccgagagcgaggcctag

SEQ ID NO: 71891 - DNA, 2013 bp, Artificial Sequence
  Description of Artificial Sequence: Synthetic coding sequence
atgcccgccgtggacaagctgctgctggaggaggccctgcaggacagcccccagaccagaagcctgctgagcgtgttcgaggaggacgccggcaccctgaccgactacaccaaccagctgctgcaggccatgcagagagtgtacggcgcccagaacgagatgtgcctggccacccagcagctgagcaagcagctgctggcctacgagaagcagaacttcgccctgggcaagggcgacgaggaggtgatcagcaccctgcactacttcagcaaggtggtggacgagctgaacctgctgcacaccgagctggccaagcagctggccgacaccatggtgctgcccatcatccagttcagagagaaggacctgaccgaggtgagcaccctgaaggacctgttcggcctggccagcaacgacgtgtgcctgttcctggagcacgacctgagcatggccaagtacagcagactgcccaagaagaaggagaacgagaaggtgaagaccgaggtgggcaaggaggtggccgccgccagaagaaagcagcacctgagcagcctgcagtactactgcgccctgaacgccctgcagtacagaaagcagatggccatgatggagcccatgatcggcttcgcccacggccagatcaacttcttcaagaagggcgccgagatgttcagcaagagaatggacagcttcctgagcagcgtggccgacatggtgcagagcatccaggtggagctggaggccgaggccgagaagatgagagtgagccagcaggagctgctgagcgtggacgagagcgtgtacacccccgacagcgacgtggccgccccccagatcaacagaaacctgatccagaaggccggctacctgaacctgagaaacaagaccggcctggtgaccaccacctgggagagactgtacttcttcacccagggcggcaacctgatgtgccagcccagaggcgccgtggccggcggcctgatccaggacctggacaactgcagcgtgatggccgtggactgcgaggacagaagatactgcttccagatcaccacccccaacggcaagagcggcatcatcctgcaggccgagagcagaaaggagaacgaggagtggatctgcgccatcaacaacatcagcagacagatctacctgaccgacaaccccgaggccgtggccatcaagctgaaccagaccgccctgcaggccgtgacccccatcaccagcttcggcaagaagcaggagagcagctgccccagccagaacctgaagaacagcgagatggagaacgagaacgacaagatcgtgcccaaggccaccgccagcctgcccgaggccgaggagctgatcgcccccggcacccccatccagttcgacatcgtgctgcccgccaccgagttcctggaccagaacagaggcagcagaagaaccaaccccttcggcgagaccgaggacgagagcttccccgaggccgaggacagcctgctgcagcagatgttcatcgtgagattcctgggcagcatggccgtgaagaccgacagcaccaccgaggtgatctacgaggccatgagacaggtgctggccgccagagccatccacaacatcttcagaatgaccgagagccacctgatggtgaccagccagagcctgagactgatcgacccccagacccaggtgagcagagccaacttcgagctgaccagcgtgacccagttcgccgcccaccaggagaacaagagactggtgggcttcgtgatcagagtgcccgagagcaccggcgaggagagcctgagcacctacatcttcgagagcaacagcgagggcgagaagatctgctacgccatcaacctgggcaaggagatcatcgaggtgcagaaggaccccgaggccctggcccagctgatgctgagcatccccctgaccaacgacggcaagtacgtgctgctgaacgaccagcccgacgacgacgacggcaaccccaacgagcacagaggcgccgagagcgaggcctag

SEQ ID NO: 71892 - DNA, 2760 bp, Artificial Sequence
  Description of Artificial Sequence: Synthetic coding sequence
atgaccgacagcaagtacttcaccaccaccaagaagggcgagatcttcgagctgaaggccgagctgaacagcgacaagaaggagaagaagaaggaggccgtgaagaaggtgatcgccagcatgaccgtgggcaaggacgtgagcgccctgttccccgacgtggtgaactgcatgcagaccgacaacctggagctgaagaagctggtgtacctgtacctgatgaactacgccaagagccagcccgacatggccatcatggccgtgaacaccttcgtgaaggactgcgaggaccccaaccccctgatcagagccctggccgtgagaaccatgggctgcatcagagtggacaagatcaccgagtacctgtgcgagcccctgagaaagtgcctgaaggacgaggacccctacgtgagaaagaccgccgccgtgtgcgtggccaagctgcacgacatcaacgcccagctggtggaggaccagggcttcctggacaccctgaaggacctgatcagcgacagcaaccccatggtggtggccaacgccgtggccgccctgagcgagatcgccgagagccaccccagcagcaacctgctggacctgaacccccagagcatcaacaagctgctgaccgccctgaacgagtgcaccgagtggggccagatcttcatcctggactgcctggccaactacatgcccaaggacgacagagaggcccagagcatctgcgagagagtgacccccagactgagccacgccaacagcgccgtggtgctgagcgccgtgaaggtgctgatgaagttcatggagatgctgagcaaggacctggactactacggcaccctgctgaagaagctggccccccccctggtgaccctgctgagcgccgagcccgagctgcagtacgtggccctgagaaacatcaacctgatcgtgcagaagagacccgagatcctgaagcacgagatgaaggtgttcttcgtgaagtacaacgaccccatctacgtgaagctggagaagctggacatcatgatcagactggccagccaggccaacatcgcccaggtgctggccgagctgaaggagtacgccaccgaggtggacgtggacttcgtgagaaaggccgtgagagccatcggcagatgcgccatcaaggtggagcagagcgccgagagatgcgtgagcaccctgctggacctgatccagaccaaggtgaactacgtggtgcaggaggccatcgtggtgatcaaggacatcttcagaaagtaccccaacaagtacgagagcgtgatcgccaccctgtgcgagaacctggacagcctggacgagcccgaggccagagccgccatgatctggatcgtgggcgagtacgccgagagaatcgacaacgccgacgagctgctggagagcttcctggagggcttccacgacgagagcacccaggtgcagctgcagctgctgaccgccatcgtgaagctgttcctgaagaagcccaccgagacccaggagctggtgcagcaggtgctgagcctggccacccaggacagcgacaaccccgacctgagagacagaggctacatctactggagactgctgagcaccgaccccgtggccgccaaggaggtggtgctggccgagaagcccctgatcagcgaggagaccgacctgatcgagcccaccctgctggacgagctgatctgctacatcggcaccctggccagcgtgtaccacaagccccccagcgccttcgtggagggcggcagaggcgtggtgcacaagagcctgccccccagaaccgccagcagcgagagcgccgagagccccgagaccgcccccaccggcgccccccccggcgagcagcccgacgtgatccccgcccagggcgacctgctgggcgacctgctgaacctggacctgggcccccccgtgagcggcccccccctggccaccagcagcgtgcagatgggcgccgtggacctgctgggcggcggcctggacagcctgatcggcggcaccaacttcgtggccccccccaccgccgccgtgcccgccaacctgggcgcccccatcggcagcggcctgagcgacctgttcgacctgaccagcggcgtgggcaccctgagcggcagctacgtggcccccaaggccgtgggcagcatcagcatggacctgcagctgaccaacaaggccctgcaggtgatgaccgacttcgccatccagttcaacagaaacagcttcggcctggcccccgccacccccctgcaggtgcacgcccccctgagccccaaccagaccgtggagatcagcctgcccctgagcaccgtgggcagcgtgatgaagatggagcccctgaacaacctgcaggtggccgtgaagaacaacatcgacgtgttctacttcagcaccctgtaccccctgcacatcctgttcgtggaggacggcaagatggacagacagatgttcctggccacctggaaggacatccccaacgagaacgaggcccagttccagatcagagactgccccctgaacgccgaggccgccagcagcaagctgcagagcagcaacatcttcaccgtggccaagagaaacgtggagggccaggacatgctgtaccagagcctgaagctgaccaacggcatctgggtgctggccgagctgagaatccagcccggcaaccccagctgcaccctgagcctgaagtgcagagcccccgaggtgagccagcacgtgtaccaggcctacgagaccatcctgaagaactag

SEQ ID NO: 71893 - DNA, 2829 bp, Artificial Sequence
  Description of Artificial Sequence: Synthetic coding sequence
atgaccgacagcaagtacttcaccaccaccaagaagggcgagatcttcgagctgaaggccgagctgaacagcgacaagaaggagaagaagaaggaggccgtgaagaaggtgatcgccagcatgaccgtgggcaaggacgtgagcgccctgttccccgacgtggtgaactgcatgcagaccgacaacctggagctgaagaagctggtgtacctgtacctgatgaactacgccaagagccagcccgacatggccatcatggccgtgaacaccttcgtgaaggactgcgaggaccccaaccccctgatcagagccctggccgtgagaaccatgggctgcatcagagtggacaagatcaccgagtacctgtgcgagcccctgagaaagtgcctgaaggacgaggacccctacgtgagaaagaccgccgccgtgtgcgtggccaagctgcacgacatcaacgcccagctggtggaggaccagggcttcctggacaccctgaaggacctgatcagcgacagcaaccccatggtggtggccaacgccgtggccgccctgagcgagatcgccgagagccaccccagcagcaacctgctggacctgaacccccagagcatcaacaagctgctgaccgccctgaacgagtgcaccgagtggggccagatcttcatcctggactgcctggccaactacatgcccaaggacgacagagaggcccagagcatctgcgagagagtgacccccagactgagccacgccaacagcgccgtggtgctgagcgccgtgaaggtgctgatgaagttcatggagatgctgagcaaggacctggactactacggcaccctgctgaagaagctggccccccccctggtgaccctgctgagcgccgagcccgagctgcagtacgtggccctgagaaacatcaacctgatcgtgcagaagagacccgagatcctgaagcacgagatgaaggtgttcttcgtgaagtacaacgaccccatctacgtgaagctggagaagctggacatcatgatcagactggccagccaggccaacatcgcccaggtgctggccgagctgaaggagtacgccaccgaggtggacgtggacttcgtgagaaaggccgtgagagccatcggcagatgcgccatcaaggtggagcagagcgccgagagatgcgtgagcaccctgctggacctgatccagaccaaggtgaactacgtggtgcaggaggccatcgtggtgatcaaggacatcttcagaaagtaccccaacaagtacgagagcgtgatcgccaccctgtgcgagaacctggacagcctggacgagcccgaggccagagccgccatgatctggatcgtgggcgagtacgccgagagaatcgacaacgccgacgagctgctggagagcttcctggagggcttccacgacgagagcacccaggtgcagctgcagctgctgaccgccatcgtgaagctgttcctgaagaagcccaccgagacccaggagctggtgcagcaggtgctgagcctggccacccaggacagcgacaaccccgacctgagagacagaggctacatctactggagactgctgagcaccgaccccgtggccgccaaggaggtggtgctggccgagaagcccctgatcagcgaggagaccgacctgatcgagcccaccctgctggacgagctgatctgctacatcggcaccctggccagcgtgtaccacaagccccccagcgccttcgtggagggcggcagaggcgtggtgcacaagagcctgccccccagaaccgccagcagcgagagcgccgagagccccgagaccgcccccaccggcgccccccccggcgagcagcccgacgtgatccccgcccagggcgacctgctgggcgacctgctgaacctggacctgggcccccccgtgagcggcccccccctggccaccagcagcgtgcagatgggcgccgtggacctgctgggcggcggcctggacagcctgatcggcggcaccaacttcgtggccccccccaccgccgccgtgcccgccaacctgggcgcccccatcggcagcggcctgagcgacctgttcgacctgaccagcggcgtgggcaccctgagcggcagctacgtggcccccaaggccgtgtggctgcccgccatgaaggccaagggcctggagatcagcggcaccttcaccagacaggtgggcagcatcagcatggacctgcagctgaccaacaaggccctgcaggtgatgaccgacttcgccatccagttcaacagaaacagcttcggcctggcccccgccacccccctgcaggtgcacgcccccctgagccccaaccagaccgtggagatcagcctgcccctgagcaccgtgggcagcgtgatgaagatggagcccctgaacaacctgcaggtggccgtgaagaacaacatcgacgtgttctacttcagcaccctgtaccccctgcacatcctgttcgtggaggacggcaagatggacagacagatgttcctggccacctggaaggacatccccaacgagaacgaggcccagttccagatcagagactgccccctgaacgccgaggccgccagcagcaagctgcagagcagcaacatcttcaccgtggccaagagaaacgtggagggccaggacatgctgtaccagagcctgaagctgaccaacggcatctgggtgctggccgagctgagaatccagcccggcaaccccagctgcaccgacctggagctgagcctgaagtgcagagcccccgaggtgagccagcacgtgtaccaggcctacgagaccatcctgaagaactag

SEQ ID NO: 71894 - DNA, 2850 bp, Artificial Sequence
  Description of Artificial Sequence: Synthetic coding sequence
atgaccgacagcaagtacttcaccaccaccaagaagggcgagatcttcgagctgaaggccgagctgaacagcgacaagaaggagaagaagaaggaggccgtgaagaaggtgatcgccagcatgaccgtgggcaaggacgtgagcgccctgttccccgacgtggtgaactgcatgcagaccgacaacctggagctgaagaagctggtgtacctgtacctgatgaactacgccaagagccagcccgacatggccatcatggccgtgaacaccttcgtgaaggactgcgaggaccccaaccccctgatcagagccctggccgtgagaaccatgggctgcatcagagtggacaagatcaccgagtacctgtgcgagcccctgagaaagtgcctgaaggacgaggacccctacgtgagaaagaccgccgccgtgtgcgtggccaagctgcacgacatcaacgcccagctggtggaggaccagggcttcctggacaccctgaaggacctgatcagcgacagcaaccccatggtggtggccaacgccgtggccgccctgagcgagatcgccgagagccaccccagcagcaacctgctggacctgaacccccagagcatcaacaagctgctgaccgccctgaacgagtgcaccgagtggggccagatcttcatcctggactgcctggccaactacatgcccaaggacgacagagaggcccagagcatctgcgagagagtgacccccagactgagccacgccaacagcgccgtggtgctgagcgccgtgaaggtgctgatgaagttcatggagatgctgagcaaggacctggactactacggcaccctgctgaagaagctggccccccccctggtgaccctgctgagcgccgagcccgagctgcagtacgtggccctgagaaacatcaacctgatcgtgcagaagagacccgagatcctgaagcacgagatgaaggtgttcttcgtgaagtacaacgaccccatctacgtgaagctggagaagctggacatcatgatcagactggccagccaggccaacatcgcccaggtgctggccgagctgaaggagtacgccaccgaggtggacgtggacttcgtgagaaaggccgtgagagccatcggcagatgcgccatcaaggtggagcagagcgccgagagatgcgtgagcaccctgctggacctgatccagaccaaggtgaactacgtggtgcaggaggccatcgtggtgatcaaggacatcttcagaaagtaccccaacaagtacgagagcgtgatcgccaccctgtgcgagaacctggacagcctggacgagcccgaggccagagccgccatgatctggatcgtgggcgagtacgccgagagaatcgacaacgccgacgagctgctggagagcttcctggagggcttccacgacgagagcacccaggtgcagctgcagctgctgaccgccatcgtgaagctgttcctgaagaagcccaccgagacccaggagctggtgcagcaggtgctgagcctggccacccaggacagcgacaaccccgacctgagagacagaggctacatctactggagactgctgagcaccgaccccgtggccgccaaggaggtggtgctggccgagaagcccctgatcagcgaggagaccgacctgatcgagcccaccctgctggacgagctgatctgctacatcggcaccctggccagcgtgtaccacaagccccccagcgccttcgtggagggcggcagaggcgtggtgcacaagagcctgccccccagaaccgccagcagcgagagcgccgagagccccgagaccgcccccaccggcgccccccccggcgagcagcccgacgtgatccccgcccagggcgacctgctgggcgacctgctgaacctggacctgggcccccccgtgagcggcccccccctggccaccagcagcgtgcagatgggcgccgtggacctgctgggcggcggcctggacagcctgatgggcgacgagcccgagggcatcggcggcaccaacttcgtggccccccccaccgccgccgtgcccgccaacctgggcgcccccatcggcagcggcctgagcgacctgttcgacctgaccagcggcgtgggcaccctgagcggcagctacgtggcccccaaggccgtgtggctgcccgccatgaaggccaagggcctggagatcagcggcaccttcaccagacaggtgggcagcatcagcatggacctgcagctgaccaacaaggccctgcaggtgatgaccgacttcgccatccagttcaacagaaacagcttcggcctggcccccgccacccccctgcaggtgcacgcccccctgagccccaaccagaccgtggagatcagcctgcccctgagcaccgtgggcagcgtgatgaagatggagcccctgaacaacctgcaggtggccgtgaagaacaacatcgacgtgttctacttcagcaccctgtaccccctgcacatcctgttcgtggaggacggcaagatggacagacagatgttcctggccacctggaaggacatccccaacgagaacgaggcccagttccagatcagagactgccccctgaacgccgaggccgccagcagcaagctgcagagcagcaacatcttcaccgtggccaagagaaacgtggagggccaggacatgctgtaccagagcctgaagctgaccaacggcatctgggtgctggccgagctgagaatccagcccggcaaccccagctgcaccgacctggagctgagcctgaagtgcagagcccccgaggtgagccagcacgtgtaccaggcctacgagaccatcctgaagaactag

SEQ ID NO: 71895 - DNA, 2820 bp, Artificial Sequence
  Description of Artificial Sequence: Synthetic coding sequence
atgaccgacagcaagtacttcaccaccaccaagaagggcgagatcttcgagctgaaggccgagctgaacagcgacaagaaggagaagaagaaggaggccgtgaagaaggtgatcgccagcatgaccgtgggcaaggacgtgagcgccctgttccccgacgtggtgaactgcatgcagaccgacaacctggagctgaagaagctggtgtacctgtacctgatgaactacgccaagagccagcccgacatggccatcatggccgtgaacaccttcgtgaaggactgcgaggaccccaaccccctgatcagagccctggccgtgagaaccatgggctgcatcagagtggacaagatcaccgagtacctgtgcgagcccctgagaaagtgcctgaaggacgaggacccctacgtgagaaagaccgccgccgtgtgcgtggccaagctgcacgacatcaacgcccagctggtggaggaccagggcttcctggacaccctgaaggacctgatcagcgacagcaaccccatggtggtggccaacgccgtggccgccctgagcgagatcgccgagagccaccccagcagcaacctgctggacctgaacccccagagcatcaacaagctgctgaccgccctgaacgagtgcaccgagtggggccagatcttcatcctggactgcctggccaactacatgcccaaggacgacagagaggcccagagcatctgcgagagagtgacccccagactgagccacgccaacagcgccgtggtgctgagcgccgtgaaggtgctgatgaagttcatggagatgctgagcaaggacctggactactacggcaccctgctgaagaagctggccccccccctggtgaccctgctgagcgccgagcccgagctgcagtacgtggccctgagaaacatcaacctgatcgtgcagaagagacccgagatcctgaagcacgagatgaaggtgttcttcgtgaagtacaacgaccccatctacgtgaagctggagaagctggacatcatgatcagactggccagccaggccaacatcgcccaggtgctggccgagctgaaggagtacgccaccgaggtggacgtggacttcgtgagaaaggccgtgagagccatcggcagatgcgccatcaaggtggagcagagcgccgagagatgcgtgagcaccctgctggacctgatccagaccaaggtgaactacgtggtgcaggaggccatcgtggtgatcaaggacatcttcagaaagtaccccaacaagtacgagagcgtgatcgccaccctgtgcgagaacctggacagcctggacgagcccgaggccagagccgccatgatctggatcgtgggcgagtacgccgagagaatcgacaacgccgacgagctgctggagagcttcctggagggcttccacgacgagagcacccaggtgcagctgcagctgctgaccgccatcgtgaagctgttcctgaagaagcccaccgagacccaggagctggtgcagcaggtgctgagcctggccacccaggacagcgacaaccccgacctgagagacagaggctacatctactggagactgctgagcaccgaccccgtggccgccaaggaggtggtgctggccgagaagcccctgatcagcgaggagaccgacctgatcgagcccaccctgctggacgagctgatctgctacatcggcaccctggccagcgtgtaccacaagccccccagcgccttcgtggagggcggcagaggcgtggtgcacaagagcctgccccccagaaccgccagcagcgagagcgccgagagccccgagaccgcccccaccggcgccccccccggcgagcagcccgacgtgatccccgcccagggcgacctgctgggcgacctgctgaacctggacctgggcccccccgtgagcggcccccccctggccaccagcagcgtgcagatgggcgccgtggacctgctgggcggcggcctggacagcctgatcggcggcaccaacttcgtggccccccccaccgccgccgtgcccgccaacctgggcgcccccatcggcagcggcctgagcgacctgttcgacctgaccagcggcgtgggcaccctgagcggcagctacgtggcccccaaggccgtgtggctgcccgccatgaaggccaagggcctggagatcagcggcaccttcaccagacaggtgggcagcatcagcatggacctgcagctgaccaacaaggccctgcaggtgatgaccgacttcgccatccagttcaacagaaacagcttcggcctggcccccgccacccccctgcaggtgcacgcccccctgagccccaaccagaccgtggagatcagcctgcccctgagcaccgtgggcagcgtgatgaagatggagcccctgaacaacctgcaggtggccgtgaagaacaacatcgacgtgttctacttcagcaccctgtaccccctgcacatcctgttcgtggaggacggcaagatggacagacagatgttcctggccacctggaaggacatccccaacgagaacgaggcccagttccagatcagagactgccccctgaacgccgaggccgccagcagcaagctgcagagcagcaacatcttcaccgtggccaagagaaacgtggagggccaggacatgctgtaccagagcctgaagctgaccaacggcatctgggtgctggccgagctgagaatccagcccggcaaccccagctgcaccctgagcctgaagtgcagagcccccgaggtgagccagcacgtgtaccaggcctacgagaccatcctgaagaactag

SEQ ID NO: 71896 - DNA, 2850 bp, Artificial Sequence; identical to SEQ ID NO: 71894
  Description of Artificial Sequence: Synthetic coding sequence

SEQ ID NO: 71897 - DNA, 2820 bp, Artificial Sequence; identical to SEQ ID NO: 71895
  Description of Artificial Sequence: Synthetic coding sequence

SEQ ID NO: 71898 - DNA, 1737 bp, Artificial Sequence
  Description of Artificial Sequence: Synthetic coding sequence
atgaccgacagcaagtacttcaccaccaccaagaagggcgagatcttcgagctgaaggccgagctgaacagcgacaagaaggagaagaagaaggaggccgtgaagaaggtgatcgccagcatgaccgtgggcaaggacgtgagcgccctgttccccgacgtggtgaactgcatgcagaccgacaacctggagctgaagaagctggtgtacctgtacctgatgaactacgccaagagccagcccgacatggccatcatggccgtgaacaccttcgtgaaggactgcgaggaccccaaccccctgatcagagccctggccgtgagaaccatgggctgcatcagagtggacaagatcaccgagtacctgtgcgagcccctgagaaagtgcctgaaggacgaggacccctacgtgagaaagaccgccgccgtgtgcgtggccaagctgcacgacatcaacgcccagctggtggaggaccagggcttcctggacaccctgaaggacctgatcagcgacagcaaccccatggtggtggccaacgccgtggccgccctgagcgagatcgccgagagccaccccagcagcaacctgctggacctgaacccccagagcatcaacaagctgctgaccgccctgaacgagtgcaccgagtggggccagatcttcatcctggactgcctggccaactacatgcccaaggacgacagagaggcccagagcatctgcgagagagtgacccccagactgagccacgccaacagcgccgtggtgctgagcgccgtgaaggtgctgatgaagttcatggagatgctgagcaaggacctggactactacggcaccctgctgaagaagctggccccccccctggtgaccctgctgagcgccgagcccgagctgcagtacgtggccctgagaaacatcaacctgatcgtgcagaagagacccgagatcctgaagcacgagatgaaggtgttcttcgtgaagtacaacgaccccatctacgtgaagctggagaagctggacatcatgatcagactggccagccaggccaacatcgcccaggtgctggccgagctgaaggagtacgccaccgaggtggacgtggacttcgtgagaaaggccgtgagagccatcggcagatgcgccatcaaggtggagcagagcgccgagagatgcgtgagcaccctgctggacctgatccagaccaaggtgaactacgtggtgcaggaggccatcgtggtgatcaaggacatcttcagaaagtaccccaacaagtacgagagcgtgatcgccaccctgtgcgagaacctggacagcctggacgagcccgaggccagagccgccatgatctggatcgtgggcgagtacgccgagagaatcgacaacgccgacgagctgctggagagcttcctggagggcttccacgacgagagcacccaggtgcagctgcagctgctgaccgccatcgtgaagctgttcctgaagaagcccaccgagacccaggagctggtgcagcaggtgctgagcctggccacccaggacagcgacaaccccgacctgagagacagaggctacatctactggagactgctgagcaccgaccccgtggccgccaaggaggtggtgctggccgagaagcccctgatcagcgaggagaccgacctgatcgagcccaccctgctggacgagctgatctgctacatcggcaccctggccagcgtgtaccacaagcccccctag

SEQ ID NO: 71899 - DNA, 2820 bp, Artificial Sequence; identical to SEQ ID NO: 71895
  Description of Artificial Sequence: Synthetic coding sequence

SEQ ID NO: 71900 - DNA, 2469 bp, Artificial Sequence
  Description of Artificial Sequence: Synthetic coding sequence
atgcccgcccccatcagactgagagagctgatcagaaccatcagaaccgccagaacccaggccgaggagagagagatgatccagaaggagtgcgccgccatcagaagcagcttcagagaggaggacaacacctacagatgcagaaacgtggccaagctgctgtacatgcacatgctgggctaccccgcccacttcggccagctggagtgcctgaagctgatcgccagccagaagttcaccgacaagagaatcggctacctgggcgccatgctgctgctggacgagagacaggacgtgcacctgctgatgaccaactgcatcaagaacgacctgaaccacagcacccagttcgtgcagggcctggccctgtgcaccctgggctgcatgggcagcagcgagatgtgcagagacctggccggcgaggtggagaagctgctgaagaccagcaacagctacctgagaaagaaggccgccctgtgcgccgtgcacgtgatcagaaaggtgcccgagctgatggagatgttcctgcccgccaccaagaacctgctgaacgagaagaaccacggcgtgctgcacaccagcgtggtgctgctgaccgagatgtgcgagagaagccccgacatgctggcccacttcagaaagctggtgccccagctggtgagaatcctgaagaacctgatcatgagcggctacagccccgagcacgacgtgagcggcatcagcgaccccttcctgcaggtgagaatcctgagactgctgagaatcctgggcagaaacgacgacgacagcagcgaggccatgaacgacatcctggcccaggtggccaccaacaccgagaccagcaagaacgtgggcaacgccatcctgtacgagaccgtgctgaccatcatggacatcaagagcgagagcggcctgagagtgctggccatcaacatcctgggcagattcctgctgaacaacgacaagaacatcagatacgtggccctgaccagcctgctgaagaccgtgcagaccgaccacaacgccgtgcagagacacagaagcaccatcgtggactgcctgaaggacctggacgtgagcatcaagagaagagccatggagctgagcttcgccctggtgaacggcaacaacatcagaggcatgatgaaggagctgctgtacttcctggacagctgcgagcccgagttcaaggccgactgcgccagcggcatcttcctggccgccgagaagtacgcccccagcaagagatggcacatcgacaccatcatgagagtgctgaccaccgccggcagctacgtgagagacgacgccgtgcccaacctgatccagctgatcaccaacagcgtggagatgcacgcctacaccgtgcagagactgtacaaggccatcctgggcgactacagccagcagcccctggtgcaggtggccgcctggtgcatcggcgagtacggcgacctgctggtgagcggccagtgcgaggaggaggagcccatccaggtgaccgaggacgaggtgctggacatcctggagagcgtgctgatcagcaacatgagcaccagcgtgaccagaggctacgccctgaccgccatcatgaagctgagcaccagattcacctgcaccgtgaacagaatcaagaaggtggtgagcatctacggcagcagcatcgacgtggagctgcagcagagagccgtggagtacaacgccctgttcaagaagtacgaccacatgagaagcgccctgctggagagaatgcccgtgatggagaaggtgaccaccaacggccccaccgagatcgtgcagaccaacggcgagaccgagcccgcccccctggagaccaagcccccccccagcggcccccagcccaccagccaggccaacgacctgctggacctgctgggcggcaacgacatcacccccgtgatccccaccgcccccaccagcaagcccagcagcgccggcggcgagctgctggacctgctgggcgacatcaacctgaccggcgcccccgccgccgcccccgcccccgccagcgtgccccagatcagccagccccccttcctgctggacggcctgagcagccagcccctgttcaacgacatcgccgccggcatccccagcatcaccgcctacagcaagaacggcctgaagatcgagttcaccttcgagagaagcaacaccaaccccagcgtgaccgtgatcaccatccaggccagcaacagcaccgagctggacatgaccgacttcgtgttccaggccgccgtgcccaagaccttccagctgcagctgctgagccccagcagcagcatcgtgcccgccttcaacaccggcaccatcacccaggtgatcaaggtgctgaacccccagaagcagcagctgagaatgagaatcaagctgacctacaaccacaagggcagcgccatgcaggacctggccgaggtgaacaacttccccccccagagctggcagtag

SEQ ID NO: 71901 - DNA, 2478 bp, Artificial Sequence
  Description of Artificial Sequence: Synthetic coding sequence
atgcccgcccccatcagactgagagagctgatcagaaccatcagaaccgccagaacccaggccgaggagagagagatgatccagaaggagtgcgccgccatcagaagcagcttcagagaggaggacaacacctacagatgcagaaacgtggccaagctgctgtacatgcacatgctgggctaccccgcccacttcggccagctggagtgcctgaagctgatcgccagccagaagttcaccgacaagagaatcggctacctgggcgccatgctgctgctggacgagagacaggacgtgcacctgctgatgaccaactgcatcaagaacgacctgaaccacagcacccagttcgtgcagggcctggccctgtgcaccctgggctgcatgggcagcagcgagatgtgcagagacctggccggcgaggtggagaagctgctgaagaccagcaacagctacctgagaaagaaggccgccctgtgcgccgtgcacgtgatcagaaaggtgcccgagctgatggagatgttcctgcccgccaccaagaacctgctgaacgagaagaaccacggcgtgctgcacaccagcgtggtgctgctgaccgagatgtgcgagagaagccccgacatgctggcccacttcagaaagaacgagaagctggtgccccagctggtgagaatcctgaagaacctgatcatgagcggctacagccccgagcacgacgtgagcggcatcagcgaccccttcctgcaggtgagaatcctgagactgctgagaatcctgggcagaaacgacgacgacagcagcgaggccatgaacgacatcctggcccaggtggccaccaacaccgagaccagcaagaacgtgggcaacgccatcctgtacgagaccgtgctgaccatcatggacatcaagagcgagagcggcctgagagtgctggccatcaacatcctgggcagattcctgctgaacaacgacaagaacatcagatacgtggccctgaccagcctgctgaagaccgtgcagaccgaccacaacgccgtgcagagacacagaagcaccatcgtggactgcctgaaggacctggacgtgagcatcaagagaagagccatggagctgagcttcgccctggtgaacggcaacaacatcagaggcatgatgaaggagctgctgtacttcctggacagctgcgagcccgagttcaaggccgactgcgccagcggcatcttcctggccgccgagaagtacgcccccagcaagagatggcacatcgacaccatcatgagagtgctgaccaccgccggcagctacgtgagagacgacgccgtgcccaacctgatccagctgatcaccaacagcgtggagatgcacgcctacaccgtgcagagactgtacaaggccatcctgggcgactacagccagcagcccctggtgcaggtggccgcctggtgcatcggcgagtacggcgacctgctggtgagcggccagtgcgaggaggaggagcccatccaggtgaccgaggacgaggtgctggacatcctggagagcgtgctgatcagcaacatgagcaccagcgtgaccagaggctacgccctgaccgccatcatgaagctgagcaccagattcacctgcaccgtgaacagaatcaagaaggtggtgagcatctacggcagcagcatcgacgtggagctgcagcagagagccgtggagtacaacgccctgttcaagaagtacgaccacatgagaagcgccctgctggagagaatgcccgtgatggagaaggtgaccaccaacggccccaccgagatcgtgcagaccaacggcgagaccgagcccgcccccctggagaccaagcccccccccagcggcccccagcccaccagccaggccaacgacctgctggacctgctgggcggcaacgacatcacccccgtgatccccaccgcccccaccagcaagcccagcagcgccggcggcgagctgctggacctgctgggcgacatcaacctgaccggcgcccccgccgccgcccccgcccccgccagcgtgccccagatcagccagccccccttcctgctggacggcctgagcagccagcccctgttcaacgacatcgccgccggcatccccagcatcaccgcctacagcaagaacggcctgaagatcgagttcaccttcgagagaagcaacaccaaccccagcgtgaccgtgatcaccatccaggccagcaacagcaccgagctggacatgaccgacttcgtgttccaggccgccgtgcccaagaccttccagctgcagctgctgagccccagcagcagcatcgtgcccgccttcaacaccggcaccatcacccaggtgatcaaggtgctgaacccccagaagcagcagctgagaatgagaatcaagctgacctacaaccacaagggcagcgccatgcaggacctggccgaggtgaacaacttccccccccagagctggcagtag

SEQ ID NO: 71902 - DNA, 2478 bp, Artificial Sequence
  Description of Artificial Sequence: Synthetic coding sequence
atgcccgcccccatcagactgagagagctgatcagaaccatcagaaccgccagaacccaggccgaggagagagagatgatccagaaggagtgcgccgccatcagaagcagcttcagagaggaggacaacacctacagatgcagaaacgtggccaagctgctgtacatgcacatgctgggctaccccgcccacttcggccagctggagtgcctgaagctgatcgccagccagaagttcaccgacaagagaatcggctacctgggcgccatgctgctgctggacgagagacaggacgtgcacctgctgatgaccaactgcatcaagaacgacctgaaccacagcacccagttcgtgcagggcctggccctgtgcaccctgggctgcatgggcagcagcgagatgtgcagagacctggccggcgaggtggagaagctgctgaagaccagcaacagctacctgagaaagaaggccgccctgtgcgccgtgcacgtgatcagaaaggtgcccgagctgatggagatgttcctgcccgccaccaagaacctgctgaacgagaagaaccacggcgtgctgcacaccagcgtggtgctgctgaccgagatgtgcgagagaagccccgacatgctggcccacttcagaaaggagagcaagctggtgccccagctggtgagaatcctgaagaacctgatcatgagcggctacagccccgagcacgacgtgagcggcatcagcgaccccttcctgcaggtgagaatcctgagactgctgagaatcctgggcagaaacgacgacgacagcagcgaggccatgaacgacatcctggcccaggtggccaccaacaccgagaccagcaagaacgtgggcaacgccatcctgtacgagaccgtgctgaccatcatggacatcaagagcgagagcggcctgagagtgctggccatcaacatcctgggcagattcctgctgaacaacgacaagaacatcagatacgtggccctgaccagcctgctgaagaccgtgcagaccgaccacaacgccgtgcagagacacagaagcaccatcgtggactgcctgaaggacctggacgtgagcatcaagagaagagccatggagctgagcttcgccctggtgaacggcaacaacatcagaggcatgatgaaggagctgctgtacttcctggacagctgcgagcccgagttcaaggccgactgcgccagcggcatcttcctggccgccgagaagtacgcccccagcaagagatggcacatcgacaccatcatgagagtgctgaccaccgccggcagctacgtgagagacgacgccgtgcccaacctgatccagctgatcaccaacagcgtggagatgcacgcctacaccgtgcagagactgtacaaggccatcctgggcgactacagccagcagcccctggtgcaggtggccgcctggtgcatcggcgagtacggcgacctgctggtgagcggccagtgcgaggaggaggagcccatccaggtgaccgaggacgaggtgctggacatcctggagagcgtgctgatcagcaacatgagcaccagcgtgaccagaggctacgccctgaccgccatcatgaagctgagcaccagattcacctgcaccgtgaacagaatcaagaaggtggtgagcatctacggcagcagcatcgacgtggagctgcagcagagagccgtggagtacaacgccctgttcaagaagtacgaccacatgagaagcgccctgctggagagaatgcccgtgatggagaaggtgaccaccaacggccccaccgagatcgtgcagaccaacggcgagaccgagcccgcccccctggagaccaagcccccccccagcggcccccagcccaccagccaggccaacgacctgctggacctgctgggcggcaacgacatcacccccgtgatccccaccgcccccaccagcaagcccagcagcgccggcggcgagctgctggacctgctgggcgacatcaacctgaccggcgcccccgccgccgcccccgcccccgccagcgtgccccagatcagccagccccccttcctgctggacggcctgagcagccagcccctgttcaacgacatcgccgccggcatccccagcatcaccgcctacagcaagaacggcctgaagatcgagttcaccttcgagagaagcaacaccaaccccagcgtgaccgtgatcaccatccaggccagcaacagcaccgagctggacatgaccgacttcgtgttccaggccgccgtgcccaagaccttccagctgcagctgctgagccccagcagcagcatcgtgcccgccttcaacaccggcaccatcacccaggtgatcaaggtgctgaacccccagaagcagcagctgagaatgagaatcaagctgacctacaaccacaagggcagcgccatgcaggacctggccgaggtgaacaacttccccccccagagctggcagtag

SEQ ID NO: 71903 - DNA, 1698 bp, Artificial Sequence
  Description of Artificial Sequence: Synthetic coding sequence
atgttcggcagctgctgccactgctgcagaagacccagaagctgctggttccacagcagattcagagccgtgagcggcgtgcagagccaggccgtgggcgtggagaagagaagacagagaagctgggccagaagaggcagagagccccagggcctgctgagactgctggagggcagacccagaggcctgggccccggcggcagcgccagaagaggcgtgccctgctgcggcgtggccccccccagaatgcccgcccccatcagactgagagagctgatcagaaccatcagaaccgccagaacccaggccgaggagagagagatgatccagaaggagtgcgccgccatcagaagcagcttcagagaggaggacaacacctacagatgcagaaacgtggccaagctgctgtacatgcacatgctgggctaccccgcccacttcggccagctggagtgcctgaagctgatcgccagccagaagttcaccgacaagagaatcggctacctgggcgccatgctgctgctggacgagagacaggacgtgcacctgctgatgaccaactgcatcaagaacgacctgaaccacagcacccagttcgtgcagggcctggccctgtgcaccctgggctgcatgggcagcagcgagatgtgcagagacctggccggcgaggtggagaagctgctgaagaccagcaacagctacctgagaaagaaggccgccctgtgcgccgtgcacgtgatcagaaaggtgcccgagctgatggagatgttcctgcccgccaccaagaacctgctgaacgagaagaaccacggcgtgctgcacaccagcgtggtgctgctgaccgagatgtgcgagagaagccccgacatgctggcccacttcagaaaggagagcaagctggtgccccagctggtgagaatcctgaagaacctgatcatgagcggctacagccccgagcacgacgtgagcggcatcagcgaccccttcctgcaggtgagaatcctgagactgctgagaatcctgggcagaaacgacgacgacagcagcgaggccatgaacgacatcctggcccaggtggccaccaacaccgagaccagcaagaacgtgggcaacgccatcctgtacgagaccgtgctgaccatcatggacatcaagagcgagagcggcctgagagtgctggccatcaacatcctgggcagattcctgctgaacaacgacaagaacatcagatacgtggccctgaccagcctgctgaagaccgtgcagaccgaccacaacgccgtgcagagacacagaagcaccatcgtggactgcctgaaggacctggacgtgagcatcaagagaagagccatggagctgagcttcgccctggtgaacggcaacaacatcagaggcatgatgaaggagctgctgtacttcctggacagctgcgagcccgagttcaaggccgactgcgccagcggcatcttcctggccgccgagaagtacgcccccagcaagagatggcacatcgacaccatcatgagagtgctgaccaccgccggcagctacgtgagagacgacgccgtgcccaacctgatccagctgatcaccaacagcgtggagatgcacgcctacaccgtgcagagactgtacaaggccatcctgggcgactacagccccaccttcggcaccagcggctgcatggtgtacagatag

SEQ ID NO: 71904 - DNA, 2538 bp, Artificial Sequence
  Description of Artificial Sequence: Synthetic coding sequence
atggagaagaacatcaacctgagaaactgccagaccctgaacacctacgtgatgctgacccacctgagaatgcccgcccccatcagactgagagagctgatcagaaccatcagaaccgccagaacccaggccgaggagagagagatgatccagaaggagtgcgccgccatcagaagcagcttcagagaggaggacaacacctacagatgcagaaacgtggccaagctgctgtacatgcacatgctgggctaccccgcccacttcggccagctggagtgcctgaagctgatcgccagccagaagttcaccgacaagagaatcggctacctgggcgccatgctgctgctggacgagagacaggacgtgcacctgctgatgaccaactgcatcaagaacgacctgaaccacagcacccagttcgtgcagggcctggccctgtgcaccctgggctgcatgggcagcagcgagatgtgcagagacctggccggcgaggtggagaagctgctgaagaccagcaacagctacctgagaaagaaggccgccctgtgcgccgtgcacgtgatcagaaaggtgcccgagctgatggagatgttcctgcccgccaccaagaacctgctgaacgagaagaaccacggcgtgctgcacaccagcgtggtgctgctgaccgagatgtgcgagagaagccccgacatgctggcccacttcagaaagctggtgccccagctggtgagaatcctgaagaacctgatcatgagcggctacagccccgagcacgacgtgagcggcatcagcgaccccttcctgcaggtgagaatcctgagactgctgagaatcctgggcagaaacgacgacgacagcagcgaggccatgaacgacatcctggcccaggtggccaccaacaccgagaccagcaagaacgtgggcaacgccatcctgtacgagaccgtgctgaccatcatggacatcaagagcgagagcggcctgagagtgctggccatcaacatcctgggcagattcctgctgaacaacgacaagaacatcagatacgtggccctgaccagcctgctgaagaccgtgcagaccgaccacaacgccgtgcagagacacagaagcaccatcgtggactgcctgaaggacctggacgtgagcatcaagagaagagccatggagctgagcttcgccctggtgaacggcaacaacatcagaggcatgatgaaggagctgctgtacttcctggacagctgcgagcccgagttcaaggccgactgcgccagcggcatcttcctggccgccgagaagtacgcccccagcaagagatggcacatcgacaccatcatgagagtgctgaccaccgccggcagctacgtgagagacgacgccgtgcccaacctgatccagctgatcaccaacagcgtggagatgcacgcctacaccgtgcagagactgtacaaggccatcctgggcgactacagccagcagcccctggtgcaggtggccgcctggtgcatcggcgagtacggcgacctgctggtgagcggccagtgcgaggaggaggagcccatccaggtgaccgaggacgaggtgctggacatcctggagagcgtgctgatcagcaacatgagcaccagcgtgaccagaggctacgccctgaccgccatcatgaagctgagcaccagattcacctgcaccgtgaacagaatcaagaaggtggtgagcatctacggcagcagcatcgacgtggagctgcagcagagagccgtggagtacaacgccctgttcaagaagtacgaccacatgagaagcgccctgctggagagaatgcccgtgatggagaaggtgaccaccaacggccccaccgagatcgtgcagaccaacggcgagaccgagcccgcccccctggagaccaagcccccccccagcggcccccagcccaccagccaggccaacgacctgctggacctgctgggcggcaacgacatcacccccgtgatccccaccgcccccaccagcaagcccagcagcgccggcggcgagctgctggacctgctgggcgacatcaacctgaccggcgcccccgccgccgcccccgcccccgccagcgtgccccagatcagccagccccccttcctgctggacggcctgagcagccagcccctgttcaacgacatcgccgccggcatccccagcatcaccgcctacagcaagaacggcctgaagatcgagttcaccttcgagagaagcaacaccaaccccagcgtgaccgtgatcaccatccaggccagcaacagcaccgagctggacatgaccgacttcgtgttccaggccgccgtgcccaagaccttccagctgcagctgctgagccccagcagcagcatcgtgcccgccttcaacaccggcaccatcacccaggtgatcaaggtgctgaacccccagaagcagcagctgagaatgagaatcaagctgacctacaaccacaagggcagcgccatgcaggacctggccgaggtgaacaacttccccccccagagctggcagtag

SEQ ID NO: 71905 - DNA, 531 bp, Artificial Sequence
  Description of Artificial Sequence: Synthetic coding sequence
atgcccgcccccatcagactgagagagctgatcagaaccatcagaaccgccagaacccaggccgaggagagagagatgatccagaaggagtgcgccgccatcagaagcagcttcagagaggaggacaacacctacagatgcagaaacgtggccaagctgctgtacatgcacatgctgggctaccccgcccacttcggccagctggagtgcctgaagctgatcgccagccagaagttcaccgacaagagaatcggctacctgggcgccatgctgctgctggacgagagacaggacgtgcacctgctgatgaccaactgcatcaagaacgacctgaaccacagcacccagttcgtgcagggcctggccctgtgcaccctgggctgcatgggcagcagcgagatgtgcagagacctggccggcgaggtggagaagctgctgaagaccagcaacagctacctgagaaagaaggagatgatctacaagcagaccaacgtgaccggctacatcctgggcggcatccccaacagctag

SEQ ID NO: 71906 - DNA, 1047 bp, Artificial Sequence
  Description of Artificial Sequence: Synthetic coding sequence
atgaaggacaagatgtgcagagacctggccggcgaggtggagaagctgctgaagaccagcaacagctacctgagaaagaaggccgccctgtgcgccgtgcacgtgatcagaaaggtgcccgagctgatggagatgttcctgcccgccaccaagaacctgctgaacgagaagaaccacggcgtgctgcacaccagcgtggtgctgctgaccgagatgtgcgagagaagccccgacatgctggcccacttcagaaagctggtgccccagctggtgagaatcctgaagaacctgatcatgagcggctacagccccgagcacgacgtgagcggcatcagcgaccccttcctgcaggtgagaatcctgagactgctgagaatcctgggcagaaacgacgacgacagcagcgaggccatgaacgacatcctggcccaggtggccaccaacaccgagaccagcaagaacgtgggcaacgccatcctgtacgagaccgtgctgaccatcatggacatcaagagcgagagcggcctgagagtgctggccatcaacatcctgggcagattcctgctgaacaacgacaagaacatcagatacgtggccctgaccagcctgctgaagaccgtgcagaccgaccacaacgccgtgcagagacacagaagcaccatcgtggactgcctgaaggacctggacgtgagcatcaagagaagagccatggagctgagcttcgccctggtgaacggcaacaacatcagaggcatgatgaaggagctgctgtacttcctggacagctgcgagcccgagttcaaggccgactgcgccagcggcatcttcctggccgccgtgcccaagaccttccagctgcagctgctgagccccagcagcagcatcgtgcccgccttcaacaccggcaccatcacccaggtgatcaaggtgctgaacccccagaagcagcagctgagaatgagaatcaagctgacctacaaccacaagggcagcgccatgcaggacctggccgaggtgaacaacttccccccccagagctggcagtag

SEQ ID NO: 71907 - DNA, 1272 bp, Artificial Sequence
  Description of Artificial Sequence: Synthetic coding sequence
atgagcgccagcgccgtgtacgtgctggacctgaagggcaaggtgctgatctgcagaaactacagaggcgacgtggacatgagcgaggtggagcacttcatgcccatcctgatggagaaggaggaggagggcatgctgagccccatcctggcccacggcggcgtgagattcatgtggatcaagcacaacaacctgtacctggtggccaccagcaagaagaacgcctgcgtgagcctggtgttcagcttcctgtacaaggtggtgcaggtgttcagcgagtacttcaaggagctggaggaggagagcatcagagacaacttcgtgatcatctacgagctgctggacgagctgatggacttcggctacccccagaccaccgacagcaagatcctgcaggagtacatcacccaggagggccacaagctggagaccggcgcccccagaccccccgccaccgtgaccaacgccgtgagctggagaagcgagggcatcaagtacagaaagaacgaggtgttcctggacgtgatcgagagcgtgaacctgctggtgagcgccaacggcaacgtgctgagaagcgagatcgtgggcagcatcaagatgagagtgttcctgagcggcatgcccgagctgagactgggcctgaacgacaaggtgctgttcgacaacaccggcagaggcaagagcaagagcgtggagctggaggacgtgaagttccaccagtgcgtgagactgagcagattcgagaacgacagaaccatcagcttcatcccccccgacggcgagttcgagctgatgagctacagactgaacacccacgtgaagcccctgatctggatcgagagcgtgatcgagaagcacagccacagcagaatcgagtacatgatcaaggccaagagccagttcaagagaagaagcaccgccaacaacgtggagatccacatccccgtgcccaacgacgccgacagccccaagttcaagaccaccgtgggcagcgtgaagtgggtgcccgagaacagcgagatcgtgtggagcatcaagagcttccccggcggcaaggagtacctgatgagagcccacttcggcctgcccagcgtggaggccgaggacaaggagggcaagccccccatcagcgtgaagttcgagatcccctacttcaccaccagcggcatccaggtgagatacctgaagatcatcgagaagagcggctaccaggccctgccctgggtgagatacatcacccagaacggcgactaccagctgagaacccagtag

SEQ ID NO: 71908 - DNA, 1113 bp, Artificial Sequence
  Description of Artificial Sequence: Synthetic coding sequence
atgagcgccagcgccgtgtacgtgctggacctgaagggcaaggtgctgatctgcagaaactacagaggcgacgtggacatgagcgaggtggagcacttcatgcccatcctgatggagaaggaggaggagggcatgctgagccccatcctggcccacggcggcgtgagattcatgtggatcaagcacaacaacctgtacctggtggccaccagcaagaagaacgcctgcgtgagcctggtgttcagcttcctgtacaaggtggtgcaggtgttcagcgagtacttcaaggagctggaggaggagagcatcagagacaacttcgtgatcatctacgagctgctggacgagctgatggacttcggctacccccagaccaccgacagcaagatcctgcaggagtacatcacccaggagggccacaagctggagaccggcgcccccagaccccccgccaccgtgaccaacgccgtgagctggagaagcgagggcatcaagtacagaaagaacgaggtgttcctggacgtgatcgagagcgtgaacctgctggtgagcgccaacggcaacgtgctgagaagcgagatcgtgggcagcatcaagatgagagtgttcctgagcggcatgcccgagctgagactgggcctgaacgacaaggtgctgttcgacaacaccggcagaggcaagagcaagagcgtggagctggaggacgtgaagttccaccagtgcgtgagactgagcagattcgagaacgacagaaccatcagcttcatcccccccgacggcgagttcgagctgatgagctacagactgaacacccacgtgaagcccctgatctggatcgagagcgtgatcgagaagcacagccacagcagaatcgagtacatgatcaagggcggcaaggagtacctgatgagagcccacttcggcctgcccagcgtggaggccgaggacaaggagggcaagccccccatcagcgtgaagttcgagatcccctacttcaccaccagcggcatccaggtgagatacctgaagatcatcgagaagagcggctaccaggccctgccctgggtgagatacatcacccagaacggcgactaccagctgagaacccagtag

SEQ ID NO: 71909 - DNA, 1308 bp, Artificial Sequence
  Description of Artificial Sequence: Synthetic coding sequence
atgagcgccagcgccgtgtacgtgctggacctgaagggcaaggtgctgatctgcagaaactacagaggcgacgtggacatgagcgaggtggagcacttcatgcccatcctgatggagaaggaggaggagggcatgctgagccccatcctggcccacggcggcgtgagattcatgtggatcaagcacaacaacctgtacctggtggccaccagcaagaagaacgcctgcgtgagcctggtgttcagcttcctgtacaaggtggtgcaggtgttcagcgagtacttcaaggagctggaggaggagagcatcagagacaacttcgtgatcatctacgagctgctggacgagctgatggacttcggctacccccagaccaccgacagcaagatcctgcaggagtacatcacccaggagggccacaagctggagaccggcgcccccagaccccccgccaccgtgaccaacgccgtgagctggagaagcgagggcatcaagtacagaaagaacgaggtgttcctggacgtgatcgagagcgtgaacctgctgggcaagtaccccggcgtgggctggctgggccacaccgtgagcgccaacggcaacgtgctgagaagcgagatcgtgggcagcatcaagatgagagtgttcctgagcggcatgcccgagctgagactgggcctgaacgacaaggtgctgttcgacaacaccggcagaggcaagagcaagagcgtggagctggaggacgtgaagttccaccagtgcgtgagactgagcagattcgagaacgacagaaccatcagcttcatcccccccgacggcgagttcgagctgatgagctacagactgaacacccacgtgaagcccctgatctggatcgagagcgtgatcgagaagcacagccacagcagaatcgagtacatgatcaaggccaagagccagttcaagagaagaagcaccgccaacaacgtggagatccacatccccgtgcccaacgacgccgacagccccaagttcaagaccaccgtgggcagcgtgaagtgggtgcccgagaacagcgagatcgtgtggagcatcaagagcttccccggcggcaaggagtacctgatgagagcccacttcggcctgcccagcgtggaggccgaggacaaggagggcaagccccccatcagcgtgaagttcgagatcccctacttcaccaccagcggcatccaggtgagatacctgaagatcatcgagaagagcggctaccaggccctgccctgggtgagatacatcacccagaacggcgactaccagctgagaacccagtag

SEQ ID NO: 71910 - DNA, 1056 bp, Artificial Sequence
  Description of Artificial Sequence: Synthetic coding sequence
atgagcgccagcgccgtgtacgtgctggacctgaagggcaaggtggtgcaggtgttcagcgagtacttcaaggagctggaggaggagagcatcagagacaacttcgtgatcatctacgagctgctggacgagctgatggacttcggctacccccagaccaccgacagcaagatcctgcaggagtacatcacccaggagggccacaagctggagaccggcgcccccagaccccccgccaccgtgaccaacgccgtgagctggagaagcgagggcatcaagtacagaaagaacgaggtgttcctggacgtgatcgagagcgtgaacctgctggtgagcgccaacggcaacgtgctgagaagcgagatcgtgggcagcatcaagatgagagtgttcctgagcggcatgcccgagctgagactgggcctgaacgacaaggtgctgttcgacaacaccggcagaggcaagagcaagagcgtggagctggaggacgtgaagttccaccagtgcgtgagactgagcagattcgagaacgacagaaccatcagcttcatcccccccgacggcgagttcgagctgatgagctacagactgaacacccacgtgaagcccctgatctggatcgagagcgtgatcgagaagcacagccacagcagaatcgagtacatgatcaaggccaagagccagttcaagagaagaagcaccgccaacaacgtggagatccacatccccgtgcccaacgacgccgacagccccaagttcaagaccaccgtgggcagcgtgaagtgggtgcccgagaacagcgagatcgtgtggagcatcaagagcttccccggcggcaaggagtacctgatgagagcccacttcggcctgcccagcgtggaggccgaggacaaggagggcaagccccccatcagcgtgaagttcgagatcccctacttcaccaccagcggcatccaggtgagatacctgaagatcatcgagaagagcggctaccaggccctgccctgggtgagatacatcacccagaacggcgactaccagctgagaacccagtag

SEQ ID NO: 71911 - DNA, 1272 bp, Artificial Sequence
  Description of Artificial Sequence: Synthetic coding sequence
atgagcgccagcgccgtgttcatcctggacgtgaagggcaagcccctgatcagcagaaactacaagggcgacgtggccatgagcaagatcgagcacttcatgcccctgctggtgcagagagaggaggagggcgccctggcccccctgctgagccacggccaggtgcacttcctgtggatcaagcacagcaacctgtacctggtggccaccaccagcaagaacgccaacgccagcctggtgtacagcttcctgtacaagaccatcgaggtgttctgcgagtacttcaaggagctggaggaggagagcatcagagacaacttcgtgatcgtgtacgagctgctggacgagctgatggacttcggcttcccccagaccaccgacagcaagatcctgcaggagtacatcacccagcagagcaacaagctggagaccggcaagagcagagtgccccccaccgtgaccaacgccgtgagctggagaagcgagggcatcaagtacaagaagaacgaggtgttcatcgacgtgatcgagagcgtgaacctgctggtgaacgccaacggcagcgtgctgctgagcgagatcgtgggcaccatcaagctgaaggtgttcctgagcggcatgcccgagctgagactgggcctgaacgacagagtgctgttcgagctgaccggcagaagcaagaacaagagcgtggagctggaggacgtgaagttccaccagtgcgtgagactgagcagattcgacaacgacagaaccatcagcttcatcccccccgacggcgacttcgagctgatgagctacagactgagcacccaggtgaagcccctgatctggatcgagagcgtgatcgagaagttcagccacagcagagtggagatcatggtgaaggccaagggccagttcaagaagcagagcgtggccaacggcgtggagatcagcgtgcccgtgcccagcgacgccgacagccccagattcaagaccagcgtgggcagcgccaagtacgtgcccgagagaaacgtggtgatctggagcatcaagagcttccccggcggcaaggagtacctgatgagagcccacttcggcctgcccagcgtggagaaggaggaggtggagggcagaccccccatcggcgtgaagttcgagatcccctacttcaccgtgagcggcatccaggtgagatacatgaagatcatcgagaagagcggctaccaggccctgccctgggtgagatacatcacccagagcggcgactaccagctgagaaccagctag

SEQ ID NO: 71912 - DNA, 477 bp, Artificial Sequence
  Description of Artificial Sequence: Synthetic coding sequence
atgatgagattcatgctgctgttcagcagacagggcaagctgagactgcagaagtggtacctggccaccagcgacaaggagagaaagaagatggtgagagagctgatgcaggtggtgctggccagaaagcccaagatgtgcagcttcctggagtggagagacctgaaggtggtgtacaagagatacgccagcctgtacttctgctgcgccatcgagggccaggacaacgagctgatcaccctggagctgatccacagatacgtggagctgctggacaagtacttcggcagcgtgtgcgagctggacatcatcttcaacttcgagaaggcctacttcatcctggacgagttcctgatgggcggcgacgtgcaggacaccagcaagaagagcgtgctgaaggccatcgagcaggccgacctgctgcaggaggaggacgagagccccagaagcgtgctggaggagatgggcctggcctag

SEQ ID NO: 71913 - DNA, 477 bp, Artificial Sequence; identical to SEQ ID NO: 71912
  Description of Artificial Sequence: Synthetic coding sequence

SEQ ID NO: 71914 - DNA, 474 bp, Artificial Sequence
  Description of Artificial Sequence: Synthetic coding sequence
atgcagttcatgctgctgttcagcagacagggcaagctgagactgcagaagtggtacgtgcccctgagcgacaaggagaagaagaagatcaccagagagctggtgcagaccgtgctggccagaaagcccaagatgtgcagcttcctggagtggagagacctgaagatcgtgtacaagagatacgccagcctgtacttctgctgcgccatcgaggaccaggacaacgagctgatcaccctggagatcatccacagatacgtggagctgctggacaagtacttcggcagcgtgtgcgagctggacatcatcttcaacttcgagaaggcctacttcatcctggacgagttcctgctgggcggcgaggtgcaggagaccagcaagaagaacgtgctgaaggccatcgagcaggccgacctgctgcaggaggaggccgagacccccagaagcgtgctggaggagatcggcctgacctag

SEQ ID NO: 71915 - DNA, 462 bp, Artificial Sequence
  Description of Artificial Sequence: Synthetic coding sequence
atgctgctgttcagcagacagggcaagctgagactgcagaagtggtacgtgcccctgagcgacaaggagaagaagaagatcaccagagagctggtgcagaccgtgctggccagaaagcccaagatgtgcagcttcctggagtggagagacctgaagatcgtgtacaagagatacgccagcctgtacttctgctgcgccatcgaggaccaggacaacgagctgatcaccctggagatcatccacagatacgtggagctgctggacaagtacttcggcagcgtgtgcgagctggacatcatcttcaacttcgagaaggcctacttcatcctggacgagttcctgctgggcggcgaggtgcaggagaccagcaagaagaacgtgctgaaggccatcgagcaggccgacctgctgcaggagagccagaacgaggagtggggcggcctgagcgaggacatcctgtag

SEQ ID NO: 71916 - DNA, 483 bp, Artificial Sequence
  Description of Artificial Sequence: Synthetic coding sequence
atgcagttcatgctgctgttcagcagacagggcaagctgagactgcagaagtggtacgtgcccctgagcgacaaggagaagaagaagatcaccagagagctggtgcagaccgtgctggccagaaagcccaagatgtgcagcttcctggagtggagagacctgaagatcgtgtacaagagatacgccagcctgtacttctgctgcgccatcgaggaccaggacaacgagctgatcaccctggagatcatccacagatacgtggagctgctggacaagtacttcggcagcgtgtgcgagctggacatcatcttcaacttcgagaaggcctacttcatcctggacgagttcctgctgggcggcgaggtgcaggagaccagcaagaagaacgtgctgaaggccatcgagcaggccgacctgctgcaggagaagaccgagaccatgtaccacagcaagagcttcatcggcttcaagaaggcctactag

SEQ ID NO: 71917 - DNA, 609 bp, Artificial Sequence
  Description of Artificial Sequence: Synthetic coding sequence
atgcccgccggctgccccccccacagcaccaccgccagcctgccccagcacggcgacagaggcttccccttcgccgccgccgccgccgccggccaggccccccccagacccagacccgccgccgccatgcagttcatgctgctgttcagcagacagggcaagctgagactgcagaagtggtacgtgcccctgagcgacaaggagaagaagaagatcaccagagagctggtgcagaccgtgctggccagaaagcccaagatgtgcagcttcctggagtggagagacctgaagatcgtgtacaagagatacgccagcctgtacttctgctgcgccatcgaggaccaggacaacgagctgatcaccctggagatcatccacagatacgtggagctgctggacaagtacttcggcagcgtgtgcgagctggacatcatcttcaacttcgagaaggcctacttcatcctggacgagttcctgctgggcggcgaggtgcaggagaccagcaagaagaacgtgctgaaggccatcgagcaggccgacctgctgcaggagaagaccgagaccatgtaccacagcaagagcttcatcggcttcaagaaggcctactag

SEQ ID NO: 71918 - DNA, 441 bp, Artificial Sequence
  Description of Artificial Sequence: Synthetic coding sequence
tgaagacagggcaagctgagactgcagaagtggtacgtgcccctgagcgacaaggagaagaagaagatcaccagagagctggtgcagaccgtgctggccagaaagcccaagatgtgcagcttcctggagtggagagacctgaagatcgtgtacaagagatacgccagcctgtacttctgctgcgccatcgaggaccaggacaacgagctgatcaccctggagatcatccacagatacgtggagctgctggacaagtacttcggcagcgtgtgcgagctggacatcatcttcaacttcgagaaggcctacttcatcctggacgagttcctgctgggcggcgaggtgcaggagaccagcaagaagaacgtgctgaaggccatcgagcaggccgacctgctgcaggagcccagacacgagtacttcaacgtgcccgtgtactag

SEQ ID NO: 71919 - DNA, 462 bp, Artificial Sequence
  Description of Artificial Sequence: Synthetic coding sequence
tgactgctgttcagcagacagggcaagctgagactgcagaagtggtacgtgcccctgagcgacaaggagaagaagaagatcaccagagagctggtgcagaccgtgctggccagaaagcccaagatgtgcagcttcctggagtggagagacctgaagatcgtgtacaagagatacgccagcctgtacttctgctgcgccatcgaggaccaggacaacgagctgatcaccctggagatcatccacagatacgtggagctgctggacaagtacttcggcagcgtgtgcgagctggacatcatcttcaacttcgagaaggcctacttcatcctggacgagttcctgctgggcggcgaggtgcaggagaccagcaagaagaacgtgctgaaggccatcgagcaggccgacctgctgcaggagagccagaacgaggagtggggcggcctgagcgaggacatcctgtag

SEQ ID NO: 71920 - DNA, 588 bp, Artificial Sequence
  Description of Artificial Sequence: Synthetic coding sequence
atgcccgccggctgccccccccacagcaccaccgccagcctgccccagcacggcgacagaggcttccccttcgccgccgccgccgccgccggccaggccccccccagacccagacccgccgccgccatgcagttcatgctgctgttcagcagacagggcaagctgagactgcagaagtggtacgtgcccctgagcgacaaggagaagaagaagatcaccagagagctggtgcagaccgtgctggccagaaagcccaagatgtgcagcttcctggagtggagagacctgaagatcgtgtacaagagatacgccagcctgtacttctgctgcgccatcgaggaccaggacaacgagctgatcaccctggagatcatccacagatacgtggagctgctggacaagtacttcggcagcgtgtgcgagctggacatcatcttcaacttcgagaaggcctacttcatcctggacgagttcctgctgggcggcgaggtgcaggagaccagcaagaagaacgtgctgaaggccatcgagcaggccgacctgctgcaggagcccagacacgagtacttcaacgtgcccgtgtactag

SEQ ID NO: 71921 - DNA, 315 bp, Artificial Sequence
  Description of Artificial Sequence: Synthetic coding sequence
atgatcagattcatcctgatccagaacagagccggcaagaccagactggccaagtggtacatgcagttcgacgacgacgagaagcagaagctgatcgaggaggtgcacgccgtggtgaccgtgagagacgccaagcacaccaacttcgtggaggtgctgaacgagtacttccacaacgtgtgcgagctggacctggtgttcaacttctacaaggtgtacaccgtggtggacgagatgttcctggccggcgagatcagagagaccagccagaccaaggtgctgaagcagctgctgatgctgcagagcctggagtag

SEQ ID NO: 71922 - DNA, 2868 bp, Artificial Sequence
  Description of Artificial Sequence: Synthetic coding sequence
atgcccgccgtgagcaagggcgacggcatgagaggcctggccgtgttcatcagcgacatcagaaactgcaagagcaaggaggccgagatcaagagaatcaacaaggagctggccaacatcagaagcaagttcaagggcgacaaggccctggacggctacagcaagaagaagtacgtgtgcaagctgctgttcatcttcctgctgggccacgacatcgacttcggccacatggaggccgtgaacctgctgagcagcaacaagtacaccgagaagcagatcggctacctgttcatcagcgtgctggtgaacagcaacagcgagctgatcagactgatcaacaacgccatcaagaacgacctggccagcagaaaccccaccttcatgtgcctggccctgcactgcatcgccaacgtgggcagcagagagatgggcgaggccttcgccgccgacatccccagaatcctggtggccggcgacagcatggacagcgtgaagcagagcgccgccctgtgcctgctgagactgtacaaggccagccccgacctggtgcccatgggcgagtggaccgccagagtggtgcacctgctgaacgaccagcacatgggcgtggtgaccgccgccgtgagcctgatcacctgcctgtgcaagaagaaccccgacgacttcaagacctgcgtgagcctggccgtgagcagactgagcagaatcgtgagcagcgccagcaccgacctgcaggactacacctactacttcgtgcccgccccctggctgagcgtgaagctgctgagactgctgcagtgctaccccccccccgaggacgccgccgtgaagggcagactggtggagtgcctggagaccgtgctgaacaaggcccaggagccccccaagagcaagaaggtgcagcacagcaacgccaagaacgccatcctgttcgagaccatcagcctgatcatccactacgacagcgagcccaacctgctggtgagagcctgcaaccagctgggccagttcctgcagcacagagagaccaacctgagatacctggccctggagagcatgtgcaccctggccagcagcgagttcagccacgaggccgtgaagacccacatcgacaccgtgatcaacgccctgaagaccgagagagacgtgagcgtgagacagagagccgccgacctgctgtacgccatgtgcgacagaagcaacgccaagcagatcgtgagcgagatgctgagatacctggagaccgccgactacgccatcagagaggagatcgtgctgaaggtggccatcctggccgagaagtacgccgtggactacagctggtacgtggacaccatcctgaacctgatcagaatcgccggcgactacgtgagcgaggaggtgtggtacagagtgctgcagatcgtgaccaacagagacgacgtgcagggctacgccgccaagaccgtgttcgaggccctgcaggcccccgcctgccacgagaacatggtgaaggtgggcggctacatcctgggcgagttcggcaacctgatcgccggcgaccccagaagcagcccccccgtgcagttcagcctgctgcacagcaagttccacctgtgcagcgtggccaccagagccctgctgctgagcacctacatcaagttcatcaacctgttccccgagaccaaggccaccatccagggcgtgctgagagccggcagccagctgagaaacgccgacgtggagctgcagcagagagccgtggagtacctgaccctgagcagcgtggccagcaccgacgtgctggccaccgtgctggaggagatgccccccttccccgagagagagagcagcatcctggccaagctgaagagaaagaagggccccggcgccggcagcgccctggacgacggcagaagagaccccagcagcaacgacatcaacggcggcatggagcccacccccagcaccgtgagcacccccagccccagcgccgacctgctgggcctgagagccgcccccccccccgccgccccccccgccagcgccggcgccggcaacctgctggtggacgtgttcgacggccccgccgcccagcccagcctgggccccacccccgaggaggccttcctgagccccggccccgaggacatcggcccccccatccccgaggccgacgagctgctgaacaagttcgtgtgcaagaacaacggcgtgctgttcgagaaccagctgctgcagatcggcgtgaagagcgagttcagacagaacctgggcagaatgtacctgttctacggcaacaagaccagcgtgcagttccagaacttcagccccaccgtggtgcaccccggcgacctgcagacccagctggccgtgcagaccaagagagtggccgcccaggtggacggcggcgcccaggtgcagcaggtgctgaacatcgagtgcctgagagacttcctgaccccccccctgctgagcgtgagattcagatacggcggcgccccccaggccctgaccctgaagctgcccgtgaccatcaacaagttcttccagcccaccgagatggccgcccaggacttcttccagagatggaagcagctgagcctgccccagcaggaggcccagaagatcttcaaggccaaccaccccatggacgccgaggtgaccaaggccaagctgctgggcttcggcagcgccctgctggacaacgtggaccccaaccccgagaacttcgtgggcgccggcatcatccagaccaaggccctgcaggtgggctgcctgctgagactggagcccaacgcccaggcccagatgtacagactgaccctgagaaccagcaaggagcccgtgagcagacacctgtgcgagctgctggcccagcagttctag

SEQ ID NO: 71923 - DNA, 2934 bp, Artificial Sequence
  Description of Artificial Sequence: Synthetic coding sequence
atgcccgccgtgagcaagggcgacggcatgagaggcctggccgtgttcatcagcgacatcagaaactgcaagagcaaggaggccgagatcaagagaatcaacaaggagctggccaacatcagaagcaagttcaagggcgacaaggccctggacggctacagcaagaagaagtacgtgtgcaagctgctgttcatcttcctgctgggccacgacatcgacttcggccacatggaggccgtgaacctgctgagcagcaacaagtacaccgagaagcagatcggctacctgttcatcagcgtgctggtgaacagcaacagcgagctgatcagactgatcaacaacgccatcaagaacgacctggccagcagaaaccccaccttcatgtgcctggccctgcactgcatcgccaacgtgggcagcagagagatgggcgaggccttcgccgccgacatccccagaatcctggtggccggcgacagcatggacagcgtgaagcagagcgccgccctgtgcctgctgagactgtacaaggccagccccgacctggtgcccatgggcgagtggaccgccagagtggtgcacctgctgaacgaccagcacatgggcgtggtgaccgccgccgtgagcctgatcacctgcctgtgcaagaagaaccccgacgacttcaagacctgcgtgagcctggccgtgagcagactgagcagaatcgtgagcagcgccagcaccgacctgcaggactacacctactacttcgtgcccgccccctggctgagcgtgaagctgctgagactgctgcagtgctaccccccccccgaggacgccgccgtgaagggcagactggtggagtgcctggagaccgtgctgaacaaggcccaggagccccccaagagcaagaaggtgcagcacagcaacgccaagaacgccatcctgttcgagaccatcagcctgatcatccactacgacagcgagcccaacctgctggtgagagcctgcaaccagctgggccagttcctgcagcacagagagaccaacctgagatacctggccctggagagcatgtgcaccctggccagcagcgagttcagccacgaggccgtgaagacccacatcgacaccgtgatcaacgccctgaagaccgagagagacgtgagcgtgagacagagagccgccgacctgctgtacgccatgtgcgacagaagcaacgccaagcagatcgtgagcgagatgctgagatacctggagaccgccgactacgccatcagagaggagatcgtgctgaaggtggccatcctggccgagaagtacgccgtggactacagctggtacgtggacaccatcctgaacctgatcagaatcgccggcgactacgtgagcgaggaggtgtggtacagagtgctgcagatcgtgaccaacagagacgacgtgcagggctacgccgccaagaccgtgttcgaggccctgcaggcccccgcctgccacgagaacatggtgaaggtgggcggctacatcctgggcgagttcggcaacctgatcgccggcgaccccagaagcagcccccccgtgcagttcagcctgctgcacagcaagttccacctgtgcagcgtggccaccagagccctgctgctgagcacctacatcaagttcatcaacctgttccccgagaccaaggccaccatccagggcgtgctgagagccggcagccagctgagaaacgccgacgtggagctgcagcagagagccgtggagtacctgaccctgagcagcgtggccagcaccgacgtgctggccaccgtgctggaggagatgccccccttccccgagagagagagcagcatcctggccaagctgaagagaaagaagggccccggcgccggcagcgccctggacgacggcagaagagaccccagcagcaacgacatcaacggcggcatggagcccacccccagcaccgtgagcacccccagccccagcgccgacctgctgggcctgagagccgcccccccccccgccgccccccccgccagcgccggcgccggcaacctgctggtggacgtgttcgacggccccgccgcccagcccagcctgggccccacccccgaggaggccttcctgagcgagctggagccccccgcccccgagagccccatggccctgctggccgaccccgcccccgccgccgaccccggccccgaggacatcggcccccccatccccgaggccgacgagctgctgaacaagttcgtgtgcaagaacaacggcgtgctgttcgagaaccagctgctgcagatcggcgtgaagagcgagttcagacagaacctgggcagaatgtacctgttctacggcaacaagaccagcgtgcagttccagaacttcagccccaccgtggtgcaccccggcgacctgcagacccagctggccgtgcagaccaagagagtggccgcccaggtggacggcggcgcccaggtgcagcaggtgctgaacatcgagtgcctgagagacttcctgaccccccccctgctgagcgtgagattcagatacggcggcgccccccaggccctgaccctgaagctgcccgtgaccatcaacaagttcttccagcccaccgagatggccgcccaggacttcttccagagatggaagcagctgagcctgccccagcaggaggcccagaagatcttcaaggccaaccaccccatggacgccgaggtgaccaaggccaagctgctgggcttcggcagcgccctgctggacaacgtggaccccaaccccgagaacttcgtgggcgccggcatcatccagaccaaggccctgcaggtgggctgcctgctgagactggagcccaacgcccaggcccagatgtacagactgaccctgagaaccagcaaggagcccgtgagcagacacctgtgcgagctgctggcccagcagttctag

SEQ ID NO: 71924 - DNA, 1404 bp, Artificial Sequence
  Description of Artificial Sequence: Synthetic coding sequence
atgggcctggccctgcactgcatcgccagcgtgggcagcagagagatggccgaggccttcgccggcgagatccccaaggtgctggtggccggcgacaccatggacagcgtgaagcagagcgccgccctgtgcctgctgagactgtacagaaccagccccgacctggtgcccatgggcgactggaccagcagagtggtgcacctgctgaacgaccagcacctgggcgtggtgaccgccgccaccagcctgatcaccaccctggcccagaagaaccccgaggagttcaagaccagcgtgagcctggccgtgagcagactgagcagaatcgtgaccagcgccagcaccgacctgcaggactacacctactacttcgtgcccgccccctggctgagcgtgaagctgctgagactgctgcagtgctaccccccccccgaccccgccgtgagaggcagactgaccgagtgcctggagaccatcctgaacaaggcccaggagccccccaagagcaagaaggtgcagcacagcaacgccaagaacgccgtgctgttcgaggccatcagcctgatcatccaccacgacagcgagcccaacctgctggtgagagcctgcaaccagctgggccagttcctgcagcacagagagaccaacctgagatacctggccctggagagcatgtgcaccctggccagcagcgagttcagccacgaggccgtgaagacccacatcgagaccgtgatcaacgccctgaagaccgagagagacgtgagcgtgctgccccccaccccccccagaagcctgtgggagcagcagtgccactgcgcctggagaggcctgagcctgggcgtgtggcccagctggtggctgcacacctggagaagacccggccccctgggcggcgcccagctgaccctggtgctgctgcagagccagctggactgcttccccagacaggacttcaacctggagttcagaaacatctgcatctgcaacgacttctggcagaagcacgtgagctggcccgacgtgaccgtgctgctgagccagctgctgttcgtgaagggcgtgtgctacgcccccgccgtggccgaggccctggacgtgcagcccggcgaggagagacccgccggccccgccggcccccccggcctgcagggcaaggtgtgggccggcggcgccagactgagaggcgtgctggtgagcttcctgagcgagtgggccagccccggccacggcgccggcctgagccccagcaccggccccgtgcagagcagcctggagggcctgtggagaagagacgccagcgtgtggagcggcagcgagggcgccatcggcagaatgccctgcgccacctgcggcctgtgcctgacctgccacctggacagcgcccccagactgcacgtgtag

SEQ ID NO: 71925 - DNA, 2823 bp, Artificial Sequence
  Description of Artificial Sequence: Synthetic coding sequence
atgcccgccgtgagcaagggcgacggcatgagaggcctggccgtgttcatcagcgacatcagaaactgcaagagcaaggaggccgagatcaagagaatcaacaaggagctggccaacatcagaagcaagttcaagggcgacaaggccctggacggctacagcaagaagaagtacgtgtgcaagctgctgttcatcttcctgctgggccacgacatcgacttcggccacatggaggccgtgaacctgctgagcagcaacagatacaccgagaagcagatcggctacctgttcatcagcgtgctggtgaacagcaacagcgagctgatcagactgatcaacaacgccatcaagaacgacctggccagcagaaaccccaccttcatgggcctggccctgcactgcatcgccagcgtgggcagcagagagatggccgaggccttcgccggcgagatccccaaggtgctggtggccggcgacaccatggacagcgtgaagcagagcgccgccctgtgcctgctgagactgtacagaaccagccccgacctggtgcccatgggcgactggaccagcagagtggtgcacctgctgaacgaccagcacctgggcgtggtgaccgccgccaccagcctgatcaccaccctggcccagaagaaccccgaggagttcaagaccagcgtgagcctggccgtgagcagactgagcagaatcgtgaccagcgccagcaccgacctgcaggactacacctactacttcgtgcccgccccctggctgagcgtgaagctgctgagactgctgcagtgctaccccccccccgaggaccccgccgtgagaggcagactgaccgagtgcctggagaccatcctgaacaaggcccaggagccccccaagagcaagaaggtgcagcacagcaacgccaagaacgccgtgctgttcgaggccatcagcctgatcatccaccacgacagcgagcccaacctgctggtgagagcctgcaaccagctgggccagttcctgcagcacagagagaccaacctgagatacctggccctggagagcatgtgcaccctggccagcagcgagttcagccacgaggccgtgaagacccacatcgagaccgtgatcaacgccctgaagaccgagagagacgtgagcgtgagacagagagccgtggacctgctgtacgccatgtgcgacagaagcaacgccccccagatcgtggccgagatgctgagctacctggagaccgccgactacagcatcagagaggagatcgtgctgaaggtggccatcctggccgagaagtacgccgtggactacacctggtacgtggacaccatcctgaacctgatcagaatcgccggcgactacgtgagcgaggaggtgtggtacagagtgatccagatcgtgatcaacagagacgacgtgcagggctacgccgccaagaccgtgttcgaggccctgcaggcccccgcctgccacgagaacctggtgaaggtgggcggctacatcctgggcgagttcggcaacctgatcgccggcgaccccagaagcagccccctgatccagttccacctgctgcacagcaagttccacctgtgcagcgtgcccaccagagccctgctgctgagcacctacatcaagttcgtgaacctgttccccgaggtgaagcccaccatccaggacgtgctgagaagcgacagccagctgagaaacgccgacgtggagctgcagcagagagccgtggagtacctgagactgagcaccgtggccagcaccgacatcctggccaccgtgctggaggagatgccccccttccccgagagagagagcagcatcctggccaagctgaagaagaagaagggccccagcaccgtgaccgacctggaggacaccaagagagacagaagcgtggacgtgaacggcggccccgagcccgcccccgccagcaccagcgccgtgagcacccccagccccagcgccgacctgctgggcctgggcgccgccccccccgcccccgccggccccccccccagcagcggcggcagcggcctgctggtggacgtgttcagcgacagcgccagcgtggtggcccccctggcccccggcagcgaggacaacttcgccagattcgtgtgcaagaacaacggcgtgctgttcgagaaccagctgctgcagatcggcctgaagagcgagttcagacagaacctgggcagaatgttcatcttctacggcaacaagaccagcacccagttcctgaacttcacccccaccctgatctgcagcgacgacctgcagcccaacctgaacctgcagaccaagcccgtggaccccaccgtggagggcggcgcccaggtgcagcaggtggtgaacatcgagtgcgtgagcgacttcaccgaggcccccgtgctgaacatccagttcagatacggcggcaccttccagaacgtgagcgtgcagctgcccatcaccctgaacaagttcttccagcccaccgagatggccagccaggacttcttccagagatggaagcagctgagcaacccccagcaggaggtgcagaacatcttcaaggccaagcaccccatggacaccgaggtgaccaaggccaagatcatcggcttcggcagcgccctgctggaggaggtggaccccaaccccgccaacttcgtgggcgccggcatcatccacaccaagaccacccagatcggctgcctgctgagactggagcccaacctgcaggcccagatgtacagactgaccctgagaaccagcaaggaggccgtgagccagagactgtgcgagctgctgagcgcccagttctag

SEQ ID NO: 71926 - DNA, 1062 bp, Artificial Sequence
  Description of Artificial Sequence: Synthetic coding sequence
atgcccgccgtgagcaagggcgacggcatgagaggcctggccgtgttcatcagcgacatcagaaactgcaagagcaaggaggccgagatcaagagaatcaacaaggagctggccaacatcagaagcaagttcaagggcgacaaggccctggacggctacagcaagaagaagtacgtgtgcaagctgctgttcatcttcctgctgggccacgacatcgacttcggccacatggaggccgtgaacctgctgagcagcaacagatacaccgagaagcagatcggctacctgttcatcagcgtgctggtgaacagcaacagcgagctgatcagactgatcaacaacgccatcaagaacgacctggccagcagaaaccccaccttcatgggcctggccctgcactgcatcgccagcgtgggcagcagagagatggccgaggccttcgccggcgagatccccaaggtgctggtggccggcgacaccatggacagcgtgaagcagagcgccgccctgtgcctgctgagactgtacagaaccagccccgacctggtgcccatgggcgactggaccagcagagtggtgcacctgctgaacgaccagcacctgggcgtggtgaccgccgccaccagcctgatcaccaccctggcccagaagaaccccgaggagttcaagaccagcgtgagcctggccgtgagcagactgagcagaatcgtgaccagcgccagcaccgacctgcaggactacacctactacttcgtgcccgccccctggctgagcgtgaagctgctgagactgctgcagtgctaccccccccccgaccccgccgtgagaggcagactgaccgagtgcctggagaccatcctgaacaaggcccaggagccccccaagagcaagaaggtgcagcacagcaacgccaagaacgccgtgctgttcgaggccatcagcctgatcatccaccacgacagagagcccaacctgcaggcccagatgtacagactgaccctgagaaccagcaaggaggccgtgagccagagactgtgcgagctgctgagcgcccagttctag

SEQ ID NO: 71927 - DNA, 1971 bp, Artificial Sequence
  Description of Artificial Sequence: Synthetic coding sequence
atgcccgccgtgagcaagggcgacggcatgagaggcctggccgtgttcatcagcgacatcagaaactgcaagagcaaggaggccgagatcaagagaatcaacaaggagctggccaacatcagaagcaagttcaagggcgacaaggccctggacggctacagcaagaagaagtacgtgtgcaagctgctgttcatcttcctgctgggccacgacatcgacttcggccacatggaggccgtgaacctgctgagcagcaacagatacaccgagaagcagatcggctacctgttcatcagcgtgctggtgaacagcaacagcgagctgatcagactgatcaacaacgccatcaagaacgacctggccagcagaaaccccaccttcatgggcctggccctgcactgcatcgccagcgtgggcagcagagagatggccgaggccttcgccggcgagatccccaaggtgctggtggccggcgacaccatggacagcgtgaagcagagcgccgccctgtgcctgctgagactgtacagaaccagccccgacctggtgcccatgggcgactggaccagcagagtggtgcacctgctgaacgaccagcacctgggcgtggtgaccgccgccaccagcctgatcaccaccctggcccagaagaaccccgaggagttcaagaccagcgtgagcctggccgtgagcagactgagcagaatcgtgaccagcgccagcaccgacctgcaggactacacctactacttcgtgcccgccccctggctgagcgtgaagctgctgagactgctgcagtgctaccccccccccgaggaccccgccgtgagaggcagactgaccgagtgcctggagaccatcctgaacaaggcccaggagccccccaagagcaagaaggtgcagcacagcaacgccaagaacgccgtgctgttcgaggccatcagcctgatcatccaccacgacagcgagcccaacctgctggtgagagcctgcaaccagctgggccagttcctgcagcacagagagaccaacctgagatacctggccctggagagcatgtgcaccctggccagcagcgagttcagccacgaggccgtgaagacccacatcgagaccgtgatcaacgccctgaagaccgagagagacgtgagcgtgagacagagagccgtggacctgctgtacgccatgtgcgacagaagcaacgccccccagatcgtggccgagatgctgagctacctggagaccgccgactacagcatcagagaggagatcgtgctgaaggtggccatcctggccgagaagtacgccgtggactacacctggtacgtggacaccatcctgaacctgatcagaatcgccggcgactacgtgagcgaggaggtgtggtacagagtgatccagatcgtgatcaacagagacgacgtgcagggctacgccgccaagaccgtgttcgaggccctgcaggcccccgcctgccacgagaacctggtgaaggtgggcggctacatcctgggcgagttcggcaacctgatcgccggcgaccccagaagcagccccctgatccagttccacctgctgcacagcaagttccacctgtgcagcgtgcccaccagagccctgctgctgagcacctacatcaagttcgtgaacctgttccccgaggtgaagcccaccatccaggacgtgctgagaagcgacagccagctgagaaacgccgacgtggagctgcagcagagagccgtggagtacctgagactgagcaccgtggccagcaccgacatcctggccaccgtgctggaggagatgccccccttccccgagagagagagcagcatcctggccaagctgaagaagaagaagggccccagcaccgtgaccgacctggaggacaccaagagagacagaagcgtggacgtgaacggcggccccgagcccgcccccgccagcaccagcgccgtgctgtgcctgtag

SEQ ID NO: 71928 - DNA, 2820 bp, Artificial Sequence
  Description of Artificial Sequence: Synthetic coding sequence
atgcccgccgtgagcaagggcgacggcatgagaggcctggccgtgttcatcagcgacatcagaaactgcaagagcaaggaggccgagatcaagagaatcaacaaggagctggccaacatcagaagcaagttcaagggcgacaaggccctggacggctacagcaagaagaagtacgtgtgcaagctgctgttcatcttcctgctgggccacgacatcgacttcggccacatggaggccgtgaacctgctgagcagcaacagatacaccgagaagcagatcggctacctgttcatcagcgtgctggtgaacagcaacagcgagctgatcagactgatcaacaacgccatcaagaacgacctggccagcagaaaccccaccttcatgggcctggccctgcactgcatcgccagcgtgggcagcagagagatggccgaggccttcgccggcgagatccccaaggtgctggtggccggcgacaccatggacagcgtgaagcagagcgccgccctgtgcctgctgagactgtacagaaccagccccgacctggtgcccatgggcgactggaccagcagagtggtgcacctgctgaacgaccagcacctgggcgtggtgaccgccgccaccagcctgatcaccaccctggcccagaagaaccccgaggagttcaagaccagcgtgagcctggccgtgagcagactgagcagaatcgtgaccagcgccagcaccgacctgcaggactacacctactacttcgtgcccgccccctggctgagcgtgaagctgctgagactgctgcagtgctaccccccccccgaccccgccgtgagaggcagactgaccgagtgcctggagaccatcctgaacaaggcccaggagccccccaagagcaagaaggtgcagcacagcaacgccaagaacgccgtgctgttcgaggccatcagcctgatcatccaccacgacagcgagcccaacctgctggtgagagcctgcaaccagctgggccagttcctgcagcacagagagaccaacctgagatacctggccctggagagcatgtgcaccctggccagcagcgagttcagccacgaggccgtgaagacccacatcgagaccgtgatcaacgccctgaagaccgagagagacgtgagcgtgagacagagagccgtggacctgctgtacgccatgtgcgacagaagcaacgccccccagatcgtggccgagatgctgagctacctggagaccgccgactacagcatcagagaggagatcgtgctgaaggtggccatcctggccgagaagtacgccgtggactacacctggtacgtggacaccatcctgaacctgatcagaatcgccggcgactacgtgagcgaggaggtgtggtacagagtgatccagatcgtgatcaacagagacgacgtgcagggctacgccgccaagaccgtgttcgaggccctgcaggcccccgcctgccacgagaacctggtgaaggtgggcggctacatcctgggcgagttcggcaacctgatcgccggcgaccccagaagcagccccctgatccagttccacctgctgcacagcaagttccacctgtgcagcgtgcccaccagagccctgctgctgagcacctacatcaagttcgtgaacctgttccccgaggtgaagcccaccatccaggacgtgctgagaagcgacagccagctgagaaacgccgacgtggagctgcagcagagagccgtggagtacctgagactgagcaccgtggccagcaccgacatcctggccaccgtgctggaggagatgccccccttccccgagagagagagcagcatcctggccaagctgaagaagaagaagggccccagcaccgtgaccgacctggaggacaccaagagagacagaagcgtggacgtgaacggcggccccgagcccgcccccgccagcaccagcgccgtgagcacccccagccccagcgccgacctgctgggcctgggcgccgccccccccgcccccgccggccccccccccagcagcggcggcagcggcctgctggtggacgtgttcagcgacagcgccagcgtggtggcccccctggcccccggcagcgaggacaacttcgccagattcgtgtgcaagaacaacggcgtgctgttcgagaaccagctgctgcagatcggcctgaagagcgagttcagacagaacctgggcagaatgttcatcttctacggcaacaagaccagcacccagttcctgaacttcacccccaccctgatctgcagcgacgacctgcagcccaacctgaacctgcagaccaagcccgtggaccccaccgtggagggcggcgcccaggtgcagcaggtggtgaacatcgagtgcgtgagcgacttcaccgaggcccccgtgctgaacatccagttcagatacggcggcaccttccagaacgtgagcgtgcagctgcccatcaccctgaacaagttcttccagcccaccgagatggccagccaggacttcttccagagatggaagcagctgagcaacccccagcaggaggtgcagaacatcttcaaggccaagcaccccatggacaccgaggtgaccaaggccaagatcatcggcttcggcagcgccctgctggaggaggtggaccccaaccccgccaacttcgtgggcgccggcatcatccacaccaagaccacccagatcggctgcctgctgagactggagcccaacctgcaggcccagatgtacagactgaccctgagaaccagcaaggaggccgtgagccagagactgtgcgagctgctgagcgcccagttctag

SEQ ID NO: 71929 - DNA, 2040 bp, Artificial Sequence
  Description of Artificial Sequence: Synthetic coding sequence
atgcccgccgtgagcaagggcgacggcatgagaggcctggccgtgttcatcagcgacatcagaaactgcaagagcaaggaggccgagatcaagagaatcaacaaggagctggccaacatcagaagcaagttcaagggcgacaaggccctggacggctacagcaagaagaagtacgtgtgcaagctgctgttcatcttcctgctgggccacgacatcgacttcggccacatggaggccgtgaacctgctgagcagcaacagatacaccgagaagcagatcggctacctgttcatcagcgtgctggtgaacagcaacagcgagctgatcagactgatcaacaacgccatcaagaccgagagagacgtgagcgtgagacagagagccgtggacctgctgtacgccatgtgcgacagaagcaacgccccccagatcgtggccgagatgctgagctacctggagaccgccgactacagcatcagagaggagatcgtgctgaaggtggccatcctggccgagaagtacgccgtggactacacctggtacgtggacaccatcctgaacctgatcagaatcgccggcgactacgtgagcgaggaggtgtggtacagagtgatccagatcgtgatcaacagagacgacgtgcagggctacgccgccaagaccgtgttcgaggccctgcaggcccccgcctgccacgagaacctggtgaaggtgggcggctacatcctgggcgagttcggcaacctgatcgccggcgaccccagaagcagccccctgatccagttccacctgctgcacagcaagttccacctgtgcagcgtgcccaccagagccctgctgctgagcacctacatcaagttcgtgaacctgttccccgaggtgaagcccaccatccaggacgtgctgagaagcgacagccagctgagaaacgccgacgtggagctgcagcagagagccgtggagtacctgagactgagcaccgtggccagcaccgacatcctggccaccgtgctggaggagatgccccccttccccgagagagagagcagcatcctggccaagctgaagaagaagaagggccccagcaccgtgaccgacctggaggacaccaagagagacagaagcgtggacgtgaacggcggccccgagcccgcccccgccagcaccagcgccgtgagcacccccagccccagcgccgacctgctgggcctgggcgccgccccccccgcccccgccggccccccccccagcagcggcggcagcggcctgctggtggacgtgttcagcgacagcgccagcgtggtggcccccctggcccccggcagcgaggacaacttcgccagattcgtgtgcaagaacaacggcgtgctgttcgagaaccagctgctgcagatcggcctgaagagcgagttcagacagaacctgggcagaatgttcatcttctacggcaacaagaccagcacccagttcctgaacttcacccccaccctgatctgcagcgacgacctgcagcccaacctgaacctgcagaccaagcccgtggaccccaccgtggagggcggcgcccaggtgcagcaggtggtgaacatcgagtgcgtgagcgacttcaccgaggcccccgtgctgaacatccagttcagatacggcggcaccttccagaacgtgagcgtgcagctgcccatcaccctgaacaagttcttccagcccaccgagatggccagccaggacttcttccagagatggaagcagctgagcaacccccagcaggaggtgcagaacatcttcaaggccaagcaccccatggacaccgaggtgaccaaggccaagatcatcggcttcggcagcgccctgctggaggaggtggaccccaaccccgccaacttcgtgggcgccggcatcatccacaccaagaccacccagatcggctgcctgctgagactggagcccaacctgcaggcccagatgtacagactgaccctgagaaccagcaaggaggccgtgagccagagactgtgcgagctgctgagcgcccagttctag

SEQ ID NO: 71930 - DNA, 2031 bp, Artificial Sequence
  Description of Artificial Sequence: Synthetic coding sequence
atgcccgccgtgagcaagggcgacggcatgagaggcctggccgtgttcatcagcgacatcagaaactgcaagagcaaggaggccgagatcaagagaatcaacaaggagctggccaacatcagaagcaagttcaagggcgacaaggccctggacggctacagcaagaagaagtacgtgtgcaagctgctgttcatcttcctgctgggccacgacatcgacttcggccacatggaggccgtgaacctgctgagcagcaacagatacaccgagaagcagatcggctacctgttcatcagcgtgctggtgaacagcaacagcgagctgatcagactgatcaacaacaccgagagagacgtgagcgtgagacagagagccgtggacctgctgtacgccatgtgcgacagaagcaacgccccccagatcgtggccgagatgctgagctacctggagaccgccgactacagcatcagagaggagatcgtgctgaaggtggccatcctggccgagaagtacgccgtggactacacctggtacgtggacaccatcctgaacctgatcagaatcgccggcgactacgtgagcgaggaggtgtggtacagagtgatccagatcgtgatcaacagagacgacgtgcagggctacgccgccaagaccgtgttcgaggccctgcaggcccccgcctgccacgagaacctggtgaaggtgggcggctacatcctgggcgagttcggcaacctgatcgccggcgaccccagaagcagccccctgatccagttccacctgctgcacagcaagttccacctgtgcagcgtgcccaccagagccctgctgctgagcacctacatcaagttcgtgaacctgttccccgaggtgaagcccaccatccaggacgtgctgagaagcgacagccagctgagaaacgccgacgtggagctgcagcagagagccgtggagtacctgagactgagcaccgtggccagcaccgacatcctggccaccgtgctggaggagatgccccccttccccgagagagagagcagcatcctggccaagctgaagaagaagaagggccccagcaccgtgaccgacctggaggacaccaagagagacagaagcgtggacgtgaacggcggccccgagcccgcccccgccagcaccagcgccgtgagcacccccagccccagcgccgacctgctgggcctgggcgccgccccccccgcccccgccggccccccccccagcagcggcggcagcggcctgctggtggacgtgttcagcgacagcgccagcgtggtggcccccctggcccccggcagcgaggacaacttcgccagattcgtgtgcaagaacaacggcgtgctgttcgagaaccagctgctgcagatcggcctgaagagcgagttcagacagaacctgggcagaatgttcatcttctacggcaacaagaccagcacccagttcctgaacttcacccccaccctgatctgcagcgacgacctgcagcccaacctgaacctgcagaccaagcccgtggaccccaccgtggagggcggcgcccaggtgcagcaggtggtgaacatcgagtgcgtgagcgacttcaccgaggcccccgtgctgaacatccagttcagatacggcggcaccttccagaacgtgagcgtgcagctgcccatcaccctgaacaagttcttccagcccaccgagatggccagccaggacttcttccagagatggaagcagctgagcaacccccagcaggaggtgcagaacatcttcaaggccaagcaccccatggacaccgaggtgaccaaggccaagatcatcggcttcggcagcgccctgctggaggaggtggaccccaaccccgccaacttcgtgggcgccggcatcatccacaccaagaccacccagatcggctgcctgctgagactggagcccaacctgcaggcccagatgtacagactgaccctgagaaccagcaaggaggccgtgagccagagactgtgcgagctgctgagcgcccagttctag

SEQ ID NO: 71931 - DNA, 2814 bp, Artificial Sequence
  Description of Artificial Sequence: Synthetic coding sequence
atgaccgacagcaagtacttcaccaccaacaagaagggcgagatcttcgagctgaaggccgagctgaacaacgagaagaaggagaagagaaaggaggccgtgaagaaggtgatcgccgccatgaccgtgggcaaggacgtgagcagcctgttccccgacgtggtgaactgcatgcagaccgacaacctggagctgaagaagctggtgtacctgtacctgatgaactacgccaagagccagcccgacatggccatcatggccgtgaacagcttcgtgaaggactgcgaggaccccaaccccctgatcagagccctggccgtgagaaccatgggctgcatcagagtggacaagatcaccgagtacctgtgcgagcccctgagaaagtgcctgaaggacgaggacccctacgtgagaaagaccgccgccgtgtgcgtggccaagctgcacgacatcaacgcccagatggtggaggaccagggcttcctggacagcctgagagacctgatcgccgacagcaaccccatggtggtggccaacgccgtggccgccctgagcgagatcagcgagagccaccccaacagcaacctgctggacctgaacccccagaacatcaacaagctgctgaccgccctgaacgagtgcaccgagtggggccagatcttcatcctggactgcctgagcaactacaaccccaaggacgacagagaggcccagagcatctgcgagagagtgacccccagactgagccacgccaacagcgccgtggtgctgagcgccgtgaaggtgctgatgaagttcctggagctgctgcccaaggacagcgactactacaacatgctgctgaagaagctggccccccccctggtgaccctgctgagcggcgagcccgaggtgcagtacgtggccctgagaaacatcaacctgatcgtgcagaagagacccgagatcctgaagcaggagatcaaggtgttcttcgtgaagtacaacgaccccatctacgtgaagctggagaagctggacatcatgatcagactggccagccaggccaacatcgcccaggtgctggccgagctgaaggagtacgccaccgaggtggacgtggacttcgtgagaaaggccgtgagagccatcggcagatgcgccatcaaggtggagcagagcgccgagagatgcgtgagcaccctgctggacctgatccagaccaaggtgaactacgtggtgcaggaggccatcgtggtgatcagagacatcttcagaaagtaccccaacaagtacgagagcatcatcgccaccctgtgcgagaacctggacagcctggacgagcccgacgccagagccgccatgatctggatcgtgggcgagtacgccgagagaatcgacaacgccgacgagctgctggagagcttcctggagggcttccacgacgagagcacccaggtgcagctgaccctgctgaccgccatcgtgaagctgttcctgaagaagcccagcgagacccaggagctggtgcagcaggtgctgagcctggccacccaggacagcgacaaccccgacctgagagacagaggctacatctactggagactgctgagcaccgaccccgtgaccgccaaggaggtggtgctgagcgagaagcccctgatcagcgaggagaccgacctgatcgagcccaccctgctggacgagctgatctgccacatcggcagcctggccagcgtgtaccacaagccccccaacgccttcgtggagggcagccacggcatccacagaaagcacctgcccatccaccacggcagcaccgacgccggcgacagccccgtgggcaccaccaccgccaccaacctggagcagccccaggtgatccccagccagggcgacctgctgggcgacctgctgaacctggacctgggcccccccgtgaacgtgccccaggtgagcagcatgcagatgggcgccgtggacctgctgggcggcggcctggacagcctggtgggccagagcttcatccccagcagcgtgcccgccaccttcgcccccagccccacccccgccgtggtgagcagcggcctgaacgacctgttcgagctgagcaccggcatcggcatggcccccggcggctacgtggcccccaaggccgtgtggctgcccgccgtgaaggccaagggcctggagatcagcggcaccttcacccacagacagggccacatctacatggagatgaacttcaccaacaaggccctgcagcacatgaccgacttcgccatccagttcaacaagaacagcttcggcgtgatccccagcacccccctggccatccacacccccctgatgcccaaccagagcatcgacgtgagcctgcccctgaacaccctgggccccgtgatgaagatggagcccctgaacaacctgcaggtggccgtgaagaacaacatcgacgtgttctacttcagctgcctgatccccctgaacgtgctgttcgtggaggacggcaagatggagagacaggtgttcctggccacctggaaggacatccccaacgagaacgagctgcagttccagatcaaggagtgccacctgaacgccgacaccgtgagcagcaagctgcagaacaacaacgtgtacaccatcgccaagagaaacgtggagggccaggacatgctgtaccagagcctgaagctgaccaacggcatctggatcctggccgagctgagaatccagcccggcaaccccaactacaccctgagcctgaagtgcagagcccccgaggtgagccagtacatctaccaggtgtacgacagcatcctgaagaactag

SEQ ID NO: 71932 - DNA, 2856 bp, Artificial Sequence
  Description of Artificial Sequence: Synthetic coding sequence
atgaccgacagcaagtacttcaccaccaacaagaagggcgagatcttcgagctgaaggccgagctgaacaacgagaagaaggagaagagaaaggaggccgtgaagaaggtgatcgccgccatgaccgtgggcaaggacgtgagcagcctgttccccgacgtggtgaactgcatgcagaccgacaacctggagctgaagaagctggtgtacctgtacctgatgaactacgccaagagccagcccgacatggccatcatggccgtgaacagcttcgtgaaggactgcgaggaccccaaccccctgatcagagccctggccgtgagaaccatgggctgcatcagagtggacaagatcaccgagtacctgtgcgagcccctgagaaagtgcctgaaggacgaggacccctacgtgagaaagaccgccgccgtgtgcgtggccaagctgcacgacatcaacgcccagatggtggaggaccagggcttcctggacagcctgagagacctgatcgccgacagcaaccccatggtggtggccaacgccgtggccgccctgagcgagatcagcgagagccaccccaacagcaacctgctggacctgaacccccagaacatcaacaagctgctgaccgccctgaacgagtgcaccgagtggggccagatcttcatcctggactgcctgagcaactacaaccccaaggacgacagagaggcccagagcatctgcgagagagtgacccccagactgagccacgccaacagcgccgtggtgctgagcgccgtgaaggtgctgatgaagttcctggagctgctgcccaaggacagcgactactacaacatgctgctgaagaagctggccccccccctggtgaccctgctgagcggcgagcccgaggtgcagtacgtggccctgagaaacatcaacctgatcgtgcagaagagacccgagatcctgaagcaggagatcaaggtgttcttcgtgaagtacaacgaccccatctacgtgaagctggagaagctggacatcatgatcagactggccagccaggccaacatcgcccaggtgctggccgagctgaaggagtacgccaccgaggtggacgtggacttcgtgagaaaggccgtgagagccatcggcagatgcgccatcaaggtggagcagagcgccgagagatgcgtgagcaccctgctggacctgatccagaccaaggtgaactacgtggtgcaggaggccatcgtggtgatcagagacatcttcagaaagtaccccaacaagtacgagagcatcatcgccaccctgtgcgagaacctggacagcctggacgagcccgacgccagagccgccatgatctggatcgtgggcgagtacgccgagagaatcgacaacgccgacgagctgctggagagcttcctggagggcttccacgacgagagcacccaggtgcagctgaccctgctgaccgccatcgtgaagctgttcctgaagaagcccagcgagacccaggagctggtgcagcaggtgctgagcctggccacccaggacagcgacaaccccgacctgagagacagaggctacatctactggagactgctgagcaccgaccccgtgaccgccaaggaggtggtgctgagcgagaagcccctgatcagcgaggagaccgacctgatcgagcccaccctgctggacgagctgatctgccacatcggcagcctggccagcgtgtaccacaagccccccaacgccttcgtggagggcagccacggcatccacagaaagcacctgcccatccaccacggcagcaccgacgccggcgacagccccgtgggcaccaccaccgccaccaacctggagcagccccaggtgatccccagccagggcgacctgctgggcgacctgctgaacctggacctgggcccccccgtgaacgtgccccaggtgagcagcatgcagatgggcgccgtggacctgctgggcggcggcctggacagcctgctgggcagcgacctgggcggcggcatcggcggcagccccgccgtgggccagagcttcatccccagcagcgtgcccgccaccttcgcccccagccccacccccgccgtggtgagcagcggcctgaacgacctgttcgagctgagcaccggcatcggcatggcccccggcggctacgtggcccccaaggccgtgtggctgcccgccgtgaaggccaagggcctggagatcagcggcaccttcacccacagacagggccacatctacatggagatgaacttcaccaacaaggccctgcagcacatgaccgacttcgccatccagttcaacaagaacagcttcggcgtgatccccagcacccccctggccatccacacccccctgatgcccaaccagagcatcgacgtgagcctgcccctgaacaccctgggccccgtgatgaagatggagcccctgaacaacctgcaggtggccgtgaagaacaacatcgacgtgttctacttcagctgcctgatccccctgaacgtgctgttcgtggaggacggcaagatggagagacaggtgttcctggccacctggaaggacatccccaacgagaacgagctgcagttccagatcaaggagtgccacctgaacgccgacaccgtgagcagcaagctgcagaacaacaacgtgtacaccatcgccaagagaaacgtggagggccaggacatgctgtaccagagcctgaagctgaccaacggcatctggatcctggccgagctgagaatccagcccggcaaccccaactacaccctgagcctgaagtgcagagcccccgaggtgagccagtacatctaccaggtgtacgacagcatcctgaagaactag

SEQ ID NO: 71933 - DNA, 2856 bp, Artificial Sequence; identical to SEQ ID NO: 71932
  Description of Artificial Sequence: Synthetic coding sequence

SEQ ID NO: 71934 - DNA, 2643 bp, Artificial Sequence
  Description of Artificial Sequence: Synthetic coding sequence
atgcagaccgacaacctggagctgaagaagctggtgtacctgtacctgatgaactacgccaagagccagcccgacatggccatcatggccgtgaacagcttcgtgaaggactgcgaggaccccaaccccctgatcagagccctggccgtgagaaccatgggctgcatcagagtggacaagatcaccgagtacctgtgcgagcccctgagaaagtgcctgaaggacgaggacccctacgtgagaaagaccgccgccgtgtgcgtggccaagctgcacgacatcaacgcccagatggtggaggaccagggcttcctggacagcctgagagacctgatcgccgacagcaaccccatggtggtggccaacgccgtggccgccctgagcgagatcagcgagagccaccccaacagcaacctgctggacctgaacccccagaacatcaacaagctgctgaccgccctgaacgagtgcaccgagtggggccagatcttcatcctggactgcctgagcaactacaaccccaaggacgacagagaggcccagagcatctgcgagagagtgacccccagactgagccacgccaacagcgccgtggtgctgagcgccgtgaaggtgctgatgaagttcctggagctgctgcccaaggacagcgactactacaacatgctgctgaagaagctggccccccccctggtgaccctgctgagcggcgagcccgaggtgcagtacgtggccctgagaaacatcaacctgatcgtgcagaagagacccgagatcctgaagcaggagatcaaggtgttcttcgtgaagtacaacgaccccatctacgtgaagctggagaagctggacatcatgatcagactggccagccaggccaacatcgcccaggtgctggccgagctgaaggagtacgccaccgaggtggacgtggacttcgtgagaaaggccgtgagagccatcggcagatgcgccatcaaggtggagcagagcgccgagagatgcgtgagcaccctgctggacctgatccagaccaaggtgaactacgtggtgcaggaggccatcgtggtgatcagagacatcttcagaaagtaccccaacaagtacgagagcatcatcgccaccctgtgcgagaacctggacagcctggacgagcccgacgccagagccgccatgatctggatcgtgggcgagtacgccgagagaatcgacaacgccgacgagctgctggagagcttcctggagggcttccacgacgagagcacccaggtgcagctgaccctgctgaccgccatcgtgaagctgttcctgaagaagcccagcgagacccaggagctggtgcagcaggtgctgagcctggccacccaggacagcgacaaccccgacctgagagacagaggctacatctactggagactgctgagcaccgaccccgtgaccgccaaggaggtggtgctgagcgagaagcccctgatcagcgaggagaccgacctgatcgagcccaccctgctggacgagctgatctgccacatcggcagcctggccagcgtgtaccacaagccccccaacgccttcgtggagggcagccacggcatccacagaaagcacctgcccatccaccacggcagcaccgacgccggcgacagccccgtgggcaccaccaccgccaccaacctggagcagccccaggtgatccccagccagggcgacctgctgggcgacctgctgaacctggacctgggcccccccgtgaacgtgccccaggtgagcagcatgcagatgggcgccgtggacctgctgggcggcggcctggacagcctggtgggccagagcttcatccccagcagcgtgcccgccaccttcgcccccagccccacccccgccgtggtgagcagcggcctgaacgacctgttcgagctgagcaccggcatcggcatggcccccggcggctacgtggcccccaaggccgtgtggctgcccgccgtgaaggccaagggcctggagatcagcggcaccttcacccacagacagggccacatctacatggagatgaacttcaccaacaaggccctgcagcacatgaccgacttcgccatccagttcaacaagaacagcttcggcgtgatccccagcacccccctggccatccacacccccctgatgcccaaccagagcatcgacgtgagcctgcccctgaacaccctgggccccgtgatgaagatggagcccctgaacaacctgcaggtggccgtgaagaacaacatcgacgtgttctacttcagctgcctgatccccctgaacgtgctgttcgtggaggacggcaagatggagagacaggtgttcctggccacctggaaggacatccccaacgagaacgagctgcagttccagatcaaggagtgccacctgaacgccgacaccgtgagcagcaagctgcagaacaacaacgtgtacaccatcgccaagagaaacgtggagggccaggacatgctgtaccagagcctgaagctgaccaacggcatctggatcctggccgagctgagaatccagcccggcaaccccaactacaccctgagcctgaagtgcagagcccccgaggtgagccagtacatctaccaggtgtacgacagcatcctgaagaactag

SEQ ID NO: 71935 - DNA, 2067 bp, Artificial Sequence
  Description of Artificial Sequence: Synthetic coding sequence
atgaagttcctggagctgctgcccaaggacagcgactactacaacatgctgctgaagaagctggccccccccctggtgaccctgctgagcggcgagcccgaggtgcagtacgtggccctgagaaacatcaacctgatcgtgcagaagagacccgagatcctgaagcaggagatcaaggtgttcttcgtgaagtacaacgaccccatctacgtgaagctggagaagctggacatcatgatcagactggccagccaggccaacatcgcccaggtgctggccgagctgaaggagtacgccaccgaggtggacgtggacttcgtgagaaaggccgtgagagccatcggcagatgcgccatcaaggtggagcagagcgccgagagatgcgtgagcaccctgctggacctgatccagaccaaggtgaactacgtggtgcaggaggccatcgtggtgatcagagacatcttcagaaagtaccccaacaagtacgagagcatcatcgccaccctgtgcgagaacctggacagcctggacgagcccgacgccagagccgccatgatctggatcgtgggcgagtacgccgagagaatcgacaacgccgacgagctgctggagagcttcctggagggcttccacgacgagagcacccaggtgcagctgaccctgctgaccgccatcgtgaagctgttcctgaagaagcccagcgagacccaggagctggtgcagcaggtgctgagcctggccacccaggacagcgacaaccccgacctgagagacagaggctacatctactggagactgctgagcaccgaccccgtgaccgccaaggaggtggtgctgagcgagaagcccctgatcagcgaggagaccgacctgatcgagcccaccctgctggacgagctgatctgccacatcggcagcctggccagcgtgtaccacaagccccccaacgccttcgtggagggcagccacggcatccacagaaagcacctgcccatccaccacggcagcaccgacgccggcgacagccccgtgggcaccaccaccgccaccaacctggagcagccccaggtgatccccagccagggcgacctgctgggcgacctgctgaacctggacctgggcccccccgtgaacgtgccccaggtgagcagcatgcagatgggcgccgtggacctgctgggcggcggcctggacagcctgctgggcagcgacctgggcggcggcatcggcggcagccccgccgtgggccagagcttcatccccagcagcgtgcccgccaccttcgcccccagccccacccccgccgtggtgagcagcggcctgaacgacctgttcgagctgagcaccggcatcggcatggcccccggcggctacgtggcccccaaggccgtgtggctgcccgccgtgaaggccaagggcctggagatcagcggcaccttcacccacagacagggccacatctacatggagatgaacttcaccaacaaggccctgcagcacatgaccgacttcgccatccagttcaacaagaacagcttcggcgtgatccccagcacccccctggccatccacacccccctgatgcccaaccagagcatcgacgtgagcctgcccctgaacaccctgggccccgtgatgaagatggagcccctgaacaacctgcaggtggccgtgaagaacaacatcgacgtgttctacttcagctgcctgatccccctgaacgtgctgttcgtggaggacggcaagatggagagacaggtgttcctggccacctggaaggacatccccaacgagaacgagctgcagttccagatcaaggagtgccacctgaacgccgacaccgtgagcagcaagctgcagaacaacaacgtgtacaccatcgccaagagaaacgtggagggccaggacatgctgtaccagagcctgaagctgaccaacggcatctggatcctggccgagctgagaatccagcccggcaaccccaactacaccctgagcctgaagtgcagagcccccgaggtgagccagtacatctaccaggtgtacgacagcatcctgaagaactag

SEQ ID NO: 71936 - DNA, 1308 bp, Artificial Sequence
  Description of Artificial Sequence: Synthetic coding sequence
atgatcggcggcctgttcatctacaaccacaagggcgaggtgctgatcagcagagtgtacagagacgacatcggcagaaacgccgtggacgccttcagagtgaacgtgatccacgccagacagcaggtgagaagccccgtgaccaacatcgccagaaccagcttcttccacgtgaagagaagcaacatctggctggccgccgtgaccaagcagaacgtgaacgccgccatggtgttcgagttcctgtacaagatgtgcgacgtgatggccgcctacttcggcaagatcagcgaggagaacatcaagaacaacttcgtgctgatctacgagctgctggacgagatcctggacttcggctacccccagaacagcgagaccggcgccctgaagaccttcatcacccagcagggcatcaagagccagcaccagaccaaggaggagcagagccagatcaccagccaggtgaccggccagatcggctggagaagagagggcatcaagtacagaagaaacgagctgttcctggacgtgctggagagcgtgaacctgctgatgagcccccagggccaggtgctgagcgcccacgtgagcggcagagtggtgatgaagagctacctgagcggcatgcccgagtgcaagttcggcatgaacgacaagatcgtgatcgagaagcagggcaagggcaccgccgacgagaccagcaagagcggcaagcagagcatcgccatcgacgactgcaccttccaccagtgcgtgagactgagcaagttcgacagcgagagaagcatcagcttcatcccccccgacggcgagttcgagctgatgagatacagaaccaccaaggacatcatcctgcccttcagagtgatccccctggtgagagaggtgggcagaaccaagctggaggtgaaggtggtgatcaagagcaacttcaagcccagcctgctggcccagaagatcgaggtgagaatccccacccccctgaacaccagcggcgtgcaggtgatctgcatgaagggcaaggccaagtacaaggccagcgagaacgccatcgtgtggaagatcaagagaatggccggcatgaaggagagccagatcagcgccgagatcgagctgctgcccaccaacgacaagaagaagtgggccagaccccccatcagcatgaacttcgaggtgcccttcgcccccagcggcctgaaggtgagatacctgaaggtgttcgagcccaagctgaactacagcgaccacgacgtgatcaagtgggtgagatacatcggcagaagcggcatctacgagaccagatgctag

SEQ ID NO: 71937 - DNA, 1302 bp, Artificial Sequence
  Description of Artificial Sequence: Synthetic coding sequence
atgatcggcggcctgttcatctacaaccacaagggcgaggtgctgatcagcagagtgtacagagacgacatcggcagaaacgccgtggacgccttcagagtgaacgtgatccacgccagacagcaggtgagaagccccgtgaccaacatcgccagaaccagcttcttccacgtgaagagaagcaacatctggctggccgccgtgaccaagcagaacgtgaacgccgccatggtgttcgagttcctgtacaagatgtgcgacgtgatggccgcctacttcggcaagatcagcgaggagaacatcaagaacaacttcgtgctgatctacgagctgctggacgagatcctggacttcggctacccccagaacagcgagaccggcgccctgaagaccttcatcacccagcagggcatcaagagccagaccaaggaggagcagagccagatcaccagccaggtgaccggccagatcggctggagaagagagggcatcaagtacagaagaaacgagctgttcctggacgtgctggagagcgtgaacctgctgatgagcccccagggccaggtgctgagcgcccacgtgagcggcagagtggtgatgaagagctacctgagcggcatgcccgagtgcaagttcggcatgaacgacaagatcgtgatcgagaagcagggcaagggcaccgccgacgagaccagcaagagcggcaagcagagcatcgccatcgacgactgcaccttccaccagtgcgtgagactgagcaagttcgacagcgagagaagcatcagcttcatcccccccgacggcgagttcgagctgatgagatacagaaccaccaaggacatcatcctgcccttcagagtgatccccctggtgagagaggtgggcagaaccaagctggaggtgaaggtggtgatcaagagcaacttcaagcccagcctgctggcccagaagatcgaggtgagaatccccacccccctgaacaccagcggcgtgcaggtgatctgcatgaagggcaaggccaagtacaaggccagcgagaacgccatcgtgtggaagatcaagagaatggccggcatgaaggagagccagatcagcgccgagatcgagctgctgcccaccaacgacaagaagaagtgggccagaccccccatcagcatgaacttcgaggtgcccttcgcccccagcggcctgaaggtgagatacctgaaggtgttcgagcccaagctgaactacagcgaccacgacgtgatcaagtgggtgagatacatcggcagaagcggcatctacgagaccagatgctag

SEQ ID NO: 71938 - DNA, 1302 bp, Artificial Sequence; identical to SEQ ID NO: 71937
  Description of Artificial Sequence: Synthetic coding sequence

SEQ ID NO: 71939 - DNA, 342 bp, Artificial Sequence
  Description of Artificial Sequence: Synthetic coding sequence
atgatcggcggcctgttcatctacaaccacaagggcgaggtgctgatcagcagagtgtacagagacgacatcggcagaaacgccgtggacgccttcagagtgaacgtgatccacgccagacagcaggtgagaagccccgtgaccaacatcgccagaaccagcttcttccacgtgaagagaagcaacatctggctggccgccgtgaccaagcagaacgtgaacgccgccatggtgttcgagttcctgtacaagatgtgcgacgtgatggccgcctacttcggcaagatcagcgaggagaacatcaagaacaacttcgtgctgatctacgagctgctggactag

SEQ ID NO: 71940 - DNA, 1263 bp, Artificial Sequence
  Description of Artificial Sequence: Synthetic coding sequence
atgatcggcggcctgttcatctacaaccacaagggcgaggtgctgatcagcagagtgtacagagacgacatcggcagaaacgccgtggacgccttcagagtgaacgtgatccacgccagacagcaggtgagaagccccgtgaccaacatctggctggccgccgtgaccaagcagaacgtgaacgccgccatggtgttcgagttcctgtacaagatgtgcgacgtgatggccgcctacttcggcaagatcagcgaggagaacatcaagaacaacttcgtgctgatctacgagctgctggacgagatcctggacttcggctacccccagaacagcgagaccggcgccctgaagaccttcatcacccagcagggcatcaagagccagaccaaggaggagcagagccagatcaccagccaggtgaccggccagatcggctggagaagagagggcatcaagtacagaagaaacgagctgttcctggacgtgctggagagcgtgaacctgctgatgagcccccagggccaggtgctgagcgcccacgtgagcggcagagtggtgatgaagagctacctgagcggcatgcccgagtgcaagttcggcatgaacgacaagatcgtgatcgagaagcagggcaagggcaccgccgacgagaccagcaagagcggcaagcagagcatcgccatcgacgactgcaccttccaccagtgcgtgagactgagcaagttcgacagcgagagaagcatcagcttcatcccccccgacggcgagttcgagctgatgagatacagaaccaccaaggacatcatcctgcccttcagagtgatccccctggtgagagaggtgggcagaaccaagctggaggtgaaggtggtgatcaagagcaacttcaagcccagcctgctggcccagaagatcgaggtgagaatccccacccccctgaacaccagcggcgtgcaggtgatctgcatgaagggcaaggccaagtacaaggccagcgagaacgccatcgtgtggaagatcaagagaatggccggcatgaaggagagccagatcagcgccgagatcgagctgctgcccaccaacgacaagaagaagtgggccagaccccccatcagcatgaacttcgaggtgcccttcgcccccagcggcctgaaggtgagatacctgaaggtgttcgagcccaagctgaactacagcgaccacgacgtgatcaagtgggtgagatacatcggcagaagcggcatctacgagaccagatgctag

SEQ ID NO: 71941 - DNA, 1128 bp, Artificial Sequence
  Description of Artificial Sequence: Synthetic coding sequence
atgatcggcggcctgttcatctacaaccacaagggcgaggtgctgatcagcagagtgtacagagacgacatcggcagaaacgccgtggccgcctacttcggcaagatcagcgaggagaacatcaagaacaacttcgtgctgatctacgagctgctggacgagatcctggacttcggctacccccagaacagcgagaccggcgccctgaagaccttcatcacccagcagggcatcaagagccagcaccagaccaaggaggagcagagccagatcaccagccaggtgaccggccagatcggctggagaagagagggcatcaagtacagaagaaacgagctgttcctggacgtgctggagagcgtgaacctgctgatgagcccccagggccaggtgctgagcgcccacgtgagcggcagagtggtgatgaagagctacctgagcggcatgcccgagtgcaagttcggcatgaacgacaagatcgtgatcgagaagcagggcaagggcaccgccgacgagaccagcaagagcggcaagcagagcatcgccatcgacgactgcaccttccaccagtgcgtgagactgagcaagttcgacagcgagagaagcatcagcttcatcccccccgacggcgagttcgagctgatgagatacagaaccaccaaggacatcatcctgcccttcagagtgatccccctggtgagagaggtgggcagaaccaagctggaggtgaaggtggtgatcaagagcaacttcaagcccagcctgctggcccagaagatcgaggtgagaatccccacccccctgaacaccagcggcgtgcaggtgatctgcatgaagggcaaggccaagtacaaggccagcgagaacgccatcgtgtggaagatcaagagaatggccggcatgaaggagagccagatcagcgccgagatcgagctgctgcccaccaacgacaagaagaagtgggccagaccccccatcagcatgaacttcgaggtgcccttcgcccccagcggcctgaaggtgagatacctgaaggtgttcgagcccaagctgaactacagcgaccacgacgtgatcaagtgggtgagatacatcggcagaagcggcatctacgagaccagatgctag

SEQ ID NO: 71942 - DNA, 429 bp, Artificial Sequence
  Description of Artificial Sequence: Synthetic coding sequence
atgatcagattcatcctgatccagaacagagccggcaagaccagactggccaagtggtacatgcagttcgacgacgacgagaagcagaagctgatcgaggaggtgcacgccgtggtgaccgtgagagacgccaagcacaccaacttcgtggagttcagaaacttcaagatcatctacagaagatacgccggcctgtacttctgcatctgcgtggacgtgaacgacaacaacctggcctacctggaggccatccacaacttcgtggaggtgctgaacgagtacttccacaacgtgtgcgagctggacctggtgttcaacttctacaaggtgtacaccgtggtggacgagatgttcctggccggcgagatcagagagaccagccagaccaaggtgctgaagcagctgctgatgctgcagagcctggagtag

SEQ ID NO: 71943 - DNA, 315 bp, Artificial Sequence; identical to SEQ ID NO: 71921
  Description of Artificial Sequence: Synthetic coding sequence

SEQ ID NO: 71944 - DNA, 3285 bp, Artificial Sequence
  Description of Artificial Sequence: Synthetic coding sequence
atgagcagcaacagcttcccctacaacgagcagagcggcggcggcgaggccaccgagctgggccaggaggccaccagcaccatcagccccagcggcgccttcggcctgttcagcagcgacctgaagaagaacgaggacctgaagcagatgctggagagcaacaaggacagcgccaagctggacgccatgaagagaatcgtgggcatgatcgccaagggcaagaacgccagcgagctgttccccgccgtggtgaagaacgtggccagcaagaacatcgagatcaagaagctggtgtacgtgtacctggtgagatacgccgaggagcagcaggacctggccctgctgagcatcagcaccttccagagagccctgaaggaccccaaccagctgatcagagccagcgccctgagagtgctgagcagcatcagagtgcccatcatcgtgcccatcatgatgctggccatcaaggaggccagcgccgacctgagcccctacgtgagaaagaacgccgcccacgccatccagaagctgtacagcctggaccccgagcagaaggagatgctgatcgaggtgatcgagaagctgctgaaggacaagagcaccctggtggccggcagcgtggtgatggccttcgaggaggtgtgccccgacagaatcgacctgatccacaagaactacagaaagctgtgcaacctgctggtggacgtggaggagtggggccaggtggtgatcatccacatgctgaccagatacgccagaacccagttcgtgagcccctggaaggagggcgacgagctggaggacaacggcaagaacttctacgagagcgacgacgaccagaaggagaagaccgacaagaagaagaagccctacaccatggaccccgaccacagactgctgatcagaaacaccaagcccctgctgcagagcagaaacgccgccgtggtgatggccgtggcccagctgtactggcacatcagccccaagagcgaggccggcatcatcagcaagagcctggtgagactgctgagaagcaacagagaggtgcagtacatcgtgctgcagaacatcgccaccatgagcatccagagaaagggcatgttcgagccctacctgaagagcttctacgtgagaagcaccgaccccaccatgatcaagaccctgaagctggagatcctgaccaacctggccaacgaggccaacatcagcaccctgctgagagagttccagacctacgtgaagagccaggacaagcagttcgccgccgccaccatccagaccatcggcagatgcgccaccaacatcctggaggtgaccgacacctgcctgaacggcctggtgtgcctgctgagcaacagagacgagatcgtggtggccgagagcgtggtggtgatcaagaagctgctgcagatgcagcccgcccagcacggcgagatcatcaagcacatggccaagctgctggacagcatcaccgtgcccgtggccagagccagcatcctgtggctgatcggcgagaactgcgagagagtgcccaagatcgcccccgacgtgctgagaaagatggccaagagcttcaccagcgaggacgacctggtgaagctgcagatcctgaacctgggcgccaagctgtacctgaccaacagcaagcagaccaagctgctgacccagtacatcctgaacctgggcaagtacgaccagaactacgacatcagagacagaaccagattcatcagacagctgatcgtgcccaacgtgaagagcggcgccctgagcaagtacgccaagaagatcttcctggcccagaagcccgcccccctgctggagagccccttcaaggacagagaccacttccagctgggcaccctgagccacaccctgaacatcaaggccaccggctacctggagctgagcaactggcccgaggtggcccccgaccccagcgtgagaaacgtggaggtgatcgagctggccaaggagtggacccccgccggcaaggccaagcaggagaacagcgccaagaagttctacagcgagagcgaggaggaggaggacagcagcgacagcagcagcgacagcgagagcgagagcggcagcgagagcggcgagcagggcgagagcggcgaggagggcgacagcaacgaggacagcagcgaggacagcagcagcgagcaggacagcgagagcggcagagagagcggcctggagaacaagagaaccgccaagagaaacagcaaggccaagggcaagagcgacagcgaggacggcgagaaggagaacgagaagagcaagaccagcgacagcagcaacgacgagagcagcagcatcgaggacagcagcagcgacagcgagagcgagagcgagcccgagagcgagagcgagagcagaagagtgaccaaggagaaggagaagaagaccaagcaggacagaacccccctgaccaaggacgtgagcctgctggacctggacgacttcaaccccgtgagcacccccgtggccctgcccacccccgccctgagccccagcctgatggccgacctggagggcctgcacctgagcaccagcagcagcgtgatcagcgtgagcacccccgccttcgtgcccaccaagacccacgtgctgctgcacagaatgagcggcaagggcctggccgcccactacttcttccccagacagccctgcatcttcggcgacaagatggtgagcatccagatcaccctgaacaacaccaccgacagaaagatcgagaacatccacatcggcgagaagaagctgcccatcggcatgaagatgcacgtgttcaaccccatcgacagcctggagcccgagggcagcatcaccgtgagcatgggcatcgacttctgcgacagcacccagaccgccagcttccagctgtgcaccaaggacgactgcttcaacgtgaacatccagccccccgtgggcgagctgctgctgcccgtggccatgagcgagaaggacttcaagaaggagcagggcgtgctgaccggcatgaacgagaccagcgccgtgatcatcgccgccccccagaacttcacccccagcgtgatcttccagaaggtggtgaacgtggccaacgtgggcgccgtgcccagcggccaggacaacatccacagattcgccgccaagaccgtgcacagcggcagcctgatgctggtgaccgtggagctgaaggagggcagcaccgcccagctgatcatcaacaccgagaagaccgtgatcggcagcgtgctgctgagagagctgaagcccgtgctgagccagggctag

SEQ ID NO: 71945 - DNA, 1698 bp, Artificial Sequence
  Description of Artificial Sequence: Synthetic coding sequence
atgagcagcaacagcttcccctacaacgagcagagcggcggcggcgaggccaccgagctgggccaggaggccaccagcaccatcagccccagcggcgccttcggcctgttcagcagcgacctgaagaagaacgaggacctgaagcagatgctggagagcaacaaggacagcgccatcaaggaggccagcgccgacctgagcccctacgtgagaaagaacgccgcccacgccatccagaagctgtacagcctggaccccgagcagaaggagatgctgatcgaggtgatcgagaagctgctgaaggacaagagcaccctggtggccggcagcgtggtgatggccttcgaggaggtgtgccccgacagaatcgacctgatccacaagaactacagaaagctgtgcaacctgctggtggacgtggaggagtggggccaggtggtgatcatccacatgctgaccagatacgccagaacccagttcgtgagcccctggaaggagggcgacgagctggaggacaacggcaagaacttctacgagagcgacgacgaccagaaggagaagaccgacaagaagaagaagccctacaccatggaccccgaccacagactgctgatcagaaacaccaagcccctgctgcagagcagaaacgccgccgtggtgatggccgtggcccagctgtactggcacatcagccccaagagcgaggccggcatcatcagcaagagcctggtgagactgctgagaagcaacagagaggtgcagtacatcgtgctgcagaacatcgccaccatgagcatccagagaaagggcatgttcgagccctacctgaagagcttctacgtgagaagcaccgaccccaccatgatcaagaccctgaagctggagatcctgaccaacctggccaacgaggccaacatcagcaccctgctgagagagttccagacctacgtgaagagccaggacaagcagttcgccgccgccaccatccagaccatcggcagatgcgccaccaacatcctggaggtgaccgacacctgcctgaacggcctggtgtgcctgctgagcaacagagacgagatcgtggtggccgagagcgtggtggtgatcaagaagctgctgcagatgcagcccgcccagcacggcgagatcatcaagcacatggccaagctgctggacagcatcaccgtgcccgtggccagagccagcatcctgtggctgatcggcgagaactgcgagagagtgcccaagatcgcccccgacgtgctgagaaagatggccaagagcttcaccagcgaggacgacctggtgaagctgcagatcctgaacctgggcgccaagctgtacctgaccaacagcaagcagaccaagctgctgacccagtacatcctgaacctgggcaagtacgaccagaactacgacatcagagacagaaccagattcatcagacagctgatcgtgcccaacgtgaagagcggcgccctgagcaagtacgccaagaagatcttcctggcccagaagcccgcccccctgctggagagccccttcaaggacagagaccacttccagctgggcaccctgagccacaccctgaacatcaaggccaccggctacctggagctgagcaactggcccgaggtggcccccgaccccagcgtgagaaacgtggaggtgatcgagctggtggtgctgagcgagtag

SEQ ID NO: 71946 - DNA, 2403 bp, Artificial Sequence
  Description of Artificial Sequence: Synthetic coding sequence
atgagcagcaacagcttcccctacaacgagcagagcggcggcggcgaggccaccgagctgggccaggaggccaccagcaccatcagccccagcggcgccttcggcctgttcagcagcgacctgaagaagaacgaggacctgaagcagatgctggagagcaacaaggacagcgccaagctggacgccatgaagagaatcgtgggcatgatcgccaagggcaagaacgccagcgagctgttccccgccgtggtgaagaacgtggccagcaagaacatcgagatcaagaagctggtgtacgtgtacctggtgagatacgccgaggagcagcaggacctggccctgctgagcatcagcaccttccagagagccctgaaggaccccaaccagctgatcagagccagcgccctgagagtgctgagcagcatcagagtgcccatcatcgtgcccatcatgatgctggccatcaaggaggccagcgccgacctgagcccctacgtgagaaagaacgccgcccacgccatccagaagctgtacagcctggaccccgagcagaaggagatgctgatcgaggtgatcgagaagctgctgaaggacaagagcaccctggtggccggcagcgtggtgatggccttcgaggaggtgtgccccgacagaatcgacctgatccacaagaactacagaaagctgtgcaacctgctggtggacgtggaggagtggggccaggtggtgatcatccacatgctgaccagatacgccagaacccagttcgtgagcccctggaaggagggcgacgagctggaggacaacggcaagaacttctacgagagcgacgacgaccagaaggagaagaccgacaagaagaagaagccctacaccatggaccccgaccacagactgctgatcagaaacaccaagcccctgctgcagagcagaaacgccgccgtggtgatggccgtggcccagctgtactggcacatcagccccaagagcgaggccggcatcatcagcaagagcctggtgagactgctgagaagcaacagagaggtgcagtacatcgtgctgcagaacatcgccaccatgagcatccagagaaagggcatgttcgagccctacctgaagagcttctacgtgagaagcaccgaccccaccatgatcaagaccctgaagctggagatcctgaccaacctggccaacgaggccaacatcagcaccctgctgagagagttccagacctacgtgaagagccaggacaagcagttcgccgccgccaccatccagaccatcggcagatgcgccaccaacatcctggaggtgaccgacacctgcctgaacggcctggtgtgcctgctgagcaacagagacgagatcgtggtggccgagagcgtggtggtgatcaagaagctgctgcagatgcagcccgcccagcacggcgagatcatcaagcacatggccaagctgctggacagcatcaccgtgcccgtggccagagccagcatcctgtggctgatcggcgagaactgcgagagagtgcccaagatcgcccccgacgtgctgagaaagatggccaagagcttcaccagcgaggacgacctggtgaagctgcagatcctgaacctgggcgccaagctgtacctgaccaacagcaagcagaccaagctgctgacccagtacatcctgaacctgggcaagtacgaccagaactacgacatcagagacagaaccagattcatcagacagctgatcgtgcccaacgtgaagagcggcgccctgagcaagtacgccaagaagatcttcctggcccagaagcccgcccccctgctggagagccccttcaaggacagagaccacttccagctgggcaccctgagccacaccctgaacatcaaggccaccggctacctggagctgagcaactggcccgaggtggcccccgaccccagcgtgagaaacgtggaggtgatcgagctggccaaggagtggacccccgccggcaaggccaagcaggagaacagcgccaagaagttctacagcgagagcgaggaggaggaggacagcagcgacagcagcagcgacagcgagagcgagagcggcagcgagagcggcgagcagggcgagagcggcgaggagggcgacagcaacgaggacagcagcgaggacagcagcagcgagcaggacagcgagagcggcagagagagcggcctggagaacaagagaaccgccaagagaaacagcaaggccaagggcaagagcgacagcgaggacggcgagaaggagaacgagaagagcaagaccagcgacagcagcaacgacgagagcagcagcatcgaggacagcagcagcgacagcgagagcgagagcgagcccgagagcgagagcgagagcagaagagtgaccaaggagtag

SEQ ID NO: 71947 - DNA, 582 bp, Artificial Sequence
  Description of Artificial Sequence: Synthetic coding sequence
atgatcaaggccatcctgatcttcaacaaccacggcaagcccagactgagcaagttctaccagccctacagcgaggacacccagcagcagatcatcagagagaccttccacctggtgagcaagagagacgagaacgtgtgcaacttcctggagggcggcctgctgatcggcggcagcgacaacaagctgatctacagacactacgccaccctgtacttcgtgttctgcgtggacagcagcgagagcgagctgggcatcctggacctgatccaggtgttcgtggagaccctggacaagtgcttcgagaacgtgtgcgagctggacctgatcttccacgtggacaaggtgcacaacatcctggccgagatggtgatgggcggcatggtgctggagaccaacatgaacgagatcgtgacccagatcgacgcccagaacaagctggagaagagcgaggccggcctggccggcgcccccgccagagccgtgagcgccgtgaagaacatgaacctgcccgagatccccagaaacatcaacatcggcgacatcagcatcaaggtgcccaacctgcccagcttcaagtag

SEQ ID NO: 71948 - DNA, 450 bp, Artificial Sequence
  Description of Artificial Sequence: Synthetic coding sequence
atgatcaagttcttcctgatggtgaacaagcagggccagaccagactgagcaagtactacgagcacgtggacatcaacaagagaaccctgctggagaccgaggtgatcaagagctgcctgagcagaagcaacgagcagtgcagcttcatcgagtacaaggacttcaagctgatctacagacagtacgccgccctgttcatcgtggtgggcgtgaacgacaccgagaacgagatggccatctacgagttcatccacaacttcgtggaggtgctggacgagtacttcagcagagtgagcgagctggacgtgagcttcttcaacaccgtgttccacagcacctggcagatgcacagcggcccctaccagaccagaagctgcagcgtgacccaggccggcgtgcagagatgcgaccacggcagcctgcaccccggcagccccggcctgaagtag

SEQ ID NO: 71949 - DNA, 408 bp, Artificial Sequence
  Description of Artificial Sequence: Synthetic coding sequence
atgatcaagttcttcctgatggtgaacaagcagggccagaccagactgagcaagtactacgagcacgtggacatcaacaagagaaccctgctggagaccgaggtgatcaagagctgcctgagcagaagcaacgagcagtgcagcttcatcgagtacaaggacttcaagctgatctacagacagtacgccgccctgttcatcgtggtgggcgtgaacgacaccgagaacgagatggccatctacgagttcatccacaacttcgtggaggtgctggacgagtacttcagcagagtggagcccatcgacgagctgcccaagatctgcagcgccctggagccccagcagacctgcttcagccccgacagcagcagcttcaagggcgccgccagcaccacccccatctactag

SEQ ID NO: 71950 - DNA, 2220 bp, Artificial Sequence
  Description of Artificial Sequence: Synthetic coding sequence
atgccctacctgggcagcgaggacgtggtgaaggagctgaagaaggccctgtgcaacccccacatccaggccgacagactgagatacagaaacgtgatccagagagtgatcagatacatgacccagggcctggacatgagcggcgtgttcatggagatggtgaaggccagcgccaccgtggacatcgtgcagaagaagctggtgtacctgtacatgtgcacctacgcccccctgaagcccgacctggccctgctggccatcaacaccctgtgcaaggactgcagcgaccccaaccccatggtgagaggcctggccctgagaagcatgtgcagcctgagaatgcccggcgtgcaggagtacatccagcagcccatcctgaacggcctgagagacaaggccagctacgtgagaagagtggccgtgctgggctgcgccaagatgcacaacctgcacggcgacagcgaggtggacggcgccctggtgaacgagctgtacagcctgctgagagaccaggaccccatcgtggtggtgaactgcctgagaagcctggaggagatcctgaagcaggagggcggcgtggtgatcaacaagcccatcgcccaccacctgctgaacagaatgagcaagctggaccagtggggccaggccgaggtgctgaacttcctgctgagataccagcccagaagcgaggaggagctgttcgacatcctgaacctgctggacagcttcctgaagagcagcagccccggcgtggtgatgggcgccaccaagctgttcctgatcctggccaagatgttcccccacgtgcagaccgacgtgctggtgagagtgaagggccccctgctggccgcctgcagcagcgagagcagagagctgtgcttcgtggccctgtgccacgtgagacagatcctgcacagcctgcccggccacttcagcagccactacaagaagttcttctgcagctacagcgagccccactacatcaagctgcagaaggtggaggtgctgtgcgagctggtgaacgacgagaacgtgcagcaggtgctggaggagctgagaggctactgcaccgacgtgagcgccgacttcgcccaggccgccatcttcgccatcggcggcatcgccagaacctacaccgaccagtgcgtgcagatcctgaccgagctgctgggcctgagacaggagcacatcaccaccgtggtggtgcagaccttcagagacctggtgtggctgtgcccccagtgcaccgaggccgtgtgccaggccctgcccggctgcgaggagaacatccaggacagcgagggcaagcaggccctgatctggctgctgggcgtgcacggcgagagaatccccaacgccccctacgtgctggaggacttcgtggagaacgtgaagagcgagaccttccccgccgtgaagatggagctgctgaccgccctgctgagactgttcctgagcagacccgccgagtgccaggacatgctgggcagactgctgtactactgcatcgaggaggagaaggacatggccgtgagagacagaggcctgttctactacagactgctgctggtgggcatcgacgaggtgaagagaatcctgtgcagccccaagagcgaccccaccctgggcctgctggaggaccccgccgagagacccgtgaacagctgggccagcgacttcaacaccctggtgcccgtgtacggcaaggcccactgggccaccatcagcaagtgccagggcgccgagagatgcgaccccgagctgcccaagaccagcagcttcgccgccagcggccccctgatccccgaggagaacaaggagagagtgcaggagctgcccgacagcggcgccctgatgctggtgcccaacagacagctgaccgccgactacttcgagaagacctggctgagcctgaaggtggcccaccagcaggtgctgccctggagaggcgagttccaccccgacaccctgcagatggccctgcaggtggtgaacatccagaccatcgccatgagcagagccggcagcagaccctggaaggcctacctgagcgcccaggacgacaccggctgcctgttcctgaccgagctgctgctggagcccggcaacagcgagatgcagatcagcgtgaagcagaacgaggccagaaccgagaccctgaacagcttcatcagcgtgctggagaccgtgatcggcaccatcgaggagatcaagagctag

SEQ ID NO: 71951 - DNA, 891 bp, Artificial Sequence
  Description of Artificial Sequence: Synthetic coding sequence
atgccctacctgggcagcgaggacgtggtgaaggagctgaagaaggccctgtgcaacccccacatccaggccgacagactgagatacagaaacgtgatccagagagtgatcagaatgcccggcgtgcaggagtacatccagcagcccatcctgaacggcctgagagacaaggccagctacgtgagaagagtggccgtgctgggctgcgccaagatgcacaacctgcacggcgacagcgaggtggacggcgccctggtgaacgagctgtacagcctgctgagagaccaggaccccatcgtggtggtgaactgcctgagaagcctggaggagatcctgaagcaggagggcggcgtggtgatcaacaagcccatcgcccaccacctgctgaacagaatgagcaagctggaccagtggggccaggccgaggtgctgaacttcctgctgagataccagcccagaagcgaggaggagctgttcgacatcctgaacctgctggacagcttcctgaagagcagcagccccggcgtggtgatgggcgccaccaagctgttcctgatcctggccaagatgttcccccacgtgcagaccgacgtgctggtgagagtgaagggccccctgctggccgcctgcagcagcgagagcagagagctgtgcttcgtggccctgtgccacgtgagacagatcctgcacagcctgcccggccacttcagcagccactacaagaagttcttctgcagctacagcgagccccactacatcaagctgcagaaggtggaggtgctgtgcgagctggtgaacgacgagaacgtgcagcaggtgctggaggagctgagaggctactgcaccgacgtgagcgccgacttcgcccaggccgccatcttcgccatctag

SEQ ID NO: 71952 - DNA, 909 bp, Artificial Sequence
  Description of Artificial Sequence: Synthetic coding sequence
atgccctacctgggcagcgaggacgtggtgaaggagctgaagaaggccctgtgcaacccccacatccaggccgacagactgagatacagaaacgtgatccagagagtgatcagatacatgacccagggcctggacatgagcggcgtgttcatggagatggtgaaggccagcgccaccgtggacatcgtgcagaagaagctggtgtacctgtacatgtgcacctacgcccccctgaagcccgacctggccctgctggccatcaacaccctgtgcaaggactgcagcgaccccaaccccatggtgagaggcctggccctgagaagcatgtgcagcctgagaatgagcaagctggaccagtggggccaggccgaggtgctgaacttcctgctgagataccagcccagaagcgaggaggagctgttcgacatcctgaacctgctggacagcttcctgaagagcagcagccccggcgtggtgatgggcgccaccaagctgttcctgatcctggccaagatgttcccccacgtgcagaccgacgtgctggtgagagtgaagggccccctgctggccgcctgcagcagcgagagcagagagctgtgcttcgtggccctgtgccacgtgagacagatcctgcacagcctgcccggccacttcagcagccactacaagaagttcttctgcagctacagcgagccccactacatcaagctgcagaaggtggaggtgctgtgcgagctggtgaacgacgagaacgtgcagcaggtgctggaggagctgagaggctactgcaccgacgtgagcgccgacttcgcccaggccgccatcttcgccatcggcagatgcctgctgctgttcctgctggagaacctggaccagcccgccagaaagctgtggctggaggagccctag

SEQ ID NO: 71953 - DNA, 1716 bp, Artificial Sequence
  Description of Artificial Sequence: Synthetic coding sequence
atgccctacctgggcagcgaggacgtggtgaaggagctgaagaaggccctgtgcaacccccacatccaggccgacagactgagatacagaaacgtgatccagagagtgatcagaatgagcaagctggaccagtggggccaggccgaggtgctgaacttcctgctgagataccagcccagaagcgaggaggagctgttcgacatcctgaacctgctggacagcttcctgaagagcagcagccccggcgtggtgatgggcgccaccaagctgttcctgatcctggccaagatgttcccccacgtgcagaccgacgtgctggtgagagtgaagggccccctgctggccgcctgcagcagcgagagcagagagctgtgcttcgtggccctgtgccacgtgagacagatcctgcacagcctgcccggccacttcagcagccactacaagaagttcttctgcagctacagcgagccccactacatcaagctgcagaaggtggaggtgctgtgcgagctggtgaacgacgagaacgtgcagcaggtgctggaggagctgagaggctactgcaccgacgtgagcgccgacttcgcccaggccgccatcttcgccatcggcggcatcgccagaacctacaccgaccagtgcgtgcagatcctgaccgagctgctgggcctgagacaggagcacatcaccaccgtggtggtgcagaccttcagagacctggtgtggctgtgcccccagtgcaccgaggccgtgtgccaggccctgcccggctgcgaggagaacatccaggacagcgagggcaagcaggccctgatctggctgctgggcgtgcacggcgagagaatccccaacgccccctacgtgctggaggacttcgtggagaacgtgaagagcgagaccttccccgccgtgaagatggagctgctgaccgccctgctgagactgttcctgagcagacccgccgagtgccaggacatgctgggcagactgctgtactactgcatcgaggaggagaaggacatggccgtgagagacagaggcctgttctactacagactgctgctggtgggcatcgacgaggtgaagagaatcctgtgcagccccaagagcgaccccaccctgggcctgctggaggaccccgccgagagacccgtgaacagctgggccagcgacttcaacaccctggtgcccgtgtacggcaaggcccactgggccaccatcagcaagtgccagggcgccgagagatgcgaccccgagctgcccaagaccagcagcttcgccgccagcggccccctgatccccgaggagaacaaggagagagtgcaggagctgcccgacagcggcgccctgatgctggtgcccaacagacagctgaccgccgactacttcgagaagacctggctgagcctgaaggtggcccaccagcaggtgctgccctggagaggcgagttccaccccgacaccctgcagatggccctgcaggtggtgaacatccagaccatcgccatgagcagagccggcagcagaccctggaaggcctacctgagcgcccaggacgacaccggctgcctgttcctgaccgagctgctgctggagcccggcaacagcgagatgcagatcagcgtgaagcagaacgaggccagaaccgagaccctgaacagcttcatcagcgtgctggagaccgtgatcggcaccatcgaggagatcaagagctag

SEQ ID NO: 71954 - DNA, 2220 bp, Artificial Sequence; identical to SEQ ID NO: 71950
  Description of Artificial Sequence: Synthetic coding sequence

SEQ ID NO: 71955 - DNA, 789 bp, Artificial Sequence
  Description of Artificial Sequence: Synthetic coding sequence
atgccctacctgggcagcgaggacgtggtgaaggagctgaagaaggccctgtgcaacccccacatccaggccgacagactgagatacagaaacgtgatccagagagtgatcagatacatgacccagggcctggacatgagcggcgtgttcatggagatggtgaaggccagcgccaccgtggacatcgtgcagaagaagctggtgtacctgtacatgtgcacctacgcccccctgaagcccgacctggccctgctggccatcaacaccctgtgcaaggactgcagcgaccccaaccccatggtgagaggcctggccctgagaagcatgtgcagcctgagaatgcccggcgtgcaggagtacatccagcagcccatcctgaacggcctgagagacaaggccagctacgtgagaagagtggccgtgctgggctgcgccaagatgcacaacctgcacggcgacagcgaggtggacggcgccctggtgaacgagctgtacagcctgctgagagaccaggaccccatcgtggtggtgaactgcctgagaagcctggaggagatcctgaagcaggagggcggcgtggtgatcaacaagcccatcgcccaccacctgctgaacagaatgagcaagctggaccagtggggccaggccgaggtgctgaacttcctgctgagataccagcccagaagcgaggaggagctgttcgacatcctgaacctgctggacagcttcctgaagagcagcagccccggcgtggtgatgggcgccaccaagctgttcctgatcctgtag

SEQ ID NO: 71956 - DNA, 528 bp, Artificial Sequence
  Description of Artificial Sequence: Synthetic coding sequence
atgccctacctgggcagcgaggacgtggtgaaggagctgaagaaggccctgtgcaacccccacatccaggccgacagactgagatacagaaacgtgatccagagagtgatcagaatgagcaagctggaccagtggggccaggccgaggtgctgaacttcctgctgagataccagcccagaagcgaggaggagctgttcgacatcctgaacctgctggacagcttcctgaagagcagcagccccggcgtggtgatgggcgccaccaagctgttcctgatcctggccaagatgttcccccacgtgcagaccgacgtgctggtgagagtgaagggccccctgctggccgcctgcagcagcgagagcagagagctgtgcttcgtggccctgtgccacgtgagacagatcctgcacagcctgcccggccacttcagcagccactacaagaagttcttctgcagctacagcgagccccactacatcaagctgcagaaggtggaggtgctgtgcgagctggtgaacgacgagtag

SEQ ID NO: 71957 - DNA, 3414 bp, Artificial Sequence
  Description of Artificial Sequence: Synthetic coding sequence
atgagcgacatcgtggagaagaccctgaccgccctgcccggcctgttcctgcagaaccagcccggcggcggccccgccgccgccaaggccagcttcagcagcagactgggcagcctggtgagaggcatcaccgccctgaccagcaagcacgaggaggagaagctgatccagcaggagctgagcagcctgaaggccaccgtgagcgcccccaccaccaccctgaagatgatgaaggagtgcatggtgagactgatctactgcgagatgctgggctacgacgccagcttcggctacatccacgccatcaagctggcccagcagggcaacctgctggagaagagagtgggctacctggccgtgagcctgttcctgcacgagagccacgagctgctgctgctgctggtgaacaccgtggtgaaggacctgcagagcaccaacctggtggaggtgtgcatggccctgaccgtggtgagccagatcttcccctgcgagatgatccccgccgtgctgcccctgatcgaggacaagctgcagcacagcaaggagatcgtgagaagaaaggccgtgctggccctgtacaagttccacctgatcgcccccaaccaggtgcagcacatccacatcaagttcagaaaggccctgtgcgacagagacgtgggcgtgatggccgccagcctgcacatctacctgagaatgatcaaggagaacagcagcggctacaaggacctgaccggcagcttcgtgaccatcctgaagcaggtggtgggcggcaagctgcccgtggagttcaactaccacagcgtgcccgccccctggctgcagatccagctgctgagaatcctgggcctgctgggcaaggacgaccagagaaccagcgagctgatgtacgacgtgctggacgagagcctgagaagagccgagctgaaccacaacgtgacctacgccatcctgttcgagtgcgtgcacaccgtgtacagcatctaccccaagagcgagctgctggagaaggccgccaagtgcatcggcaagttcgtgctgagccccaagatcaacctgaagtacctgggcctgaaggccctgacctacgtgatccagcaggaccccaccctggccctgcagcaccagatgaccatcatcgagtgcctggaccaccccgaccccatcatcaagagagagaccctggagctgctgtacagaatcaccaacgcccagaacatcaccgtgatcgtgcagaagatgctggagtacctgcaccagagcaaggaggagtacgtgatcgtgaacctggtgggcaagatcgccgagctggccgagaagtacgcccccgacaacgcctggttcatccagaccatgaacgccgtgttcagcgtgggcggcgacgtgatgcaccccgacatccccaacaacttcctgagactgctggccgagggcttcgacgacgagaccgaggaccagcagctgagactgtacgccgtgcagagctacctgaccctgctggacatggagaacgtgttctacccccagagattcctgcaggtgatgagctgggtgctgggcgagtacagctacctgctggacaaggagacccccgaggaggtgatcgccaagctgtacaagctgctgatgaacgacagcgtgagcagcgagaccaaggcctggctgatcgccgccgtgaccaagctgaccagccaggcccacagcagcaacaccgtggagagactgatccacgagttcaccatcagcctggacacctgcatgagacagcacgccttcgagctgaagcacctgcacgagaacgtggagctgatgaagagcctgctgcccgtggacagaagctgcgaggacctggtggtggacgccagcctgagcttcctggacggcttcgtggccgagggcctgagccagggcgccgccccctacaagcccccccaccagagacaggaggagaagctgagccaggagaaggtgctgaacttcgagccctacggcctgagcttcagcagcagcggcttcaccggcagacagagccccgccggcatcagcctgggcagcgacgtgagcggcaacagcgccgagaccggcctgaaggagaccaacagcctgaagctggagggcatcaagaagctgtggggcaaggagggctacctgcccaagaaggagagcaagaccggcgacgagagcggcgccctgcccgtgccccaggagagcatcatggagaacgtggaccaggccatcaccaagaaggaccagagccaggtgctgacccagagcaaggaggagaaggagaagcagctgctggccagcagcctgttcgtgggcctgggcagcgagagcaccatcaacctgctgggcaaggccgacaccgtgagccacaagttcagaagaaagagcaaggtgaaggaggccaagagcggcgagaccaccagcacccacaacatgacctgcagcagcttcagcagcctgagcaacgtggcctacgaggacgactactacagcaacaccctgcacgacaccggcgacaaggagctgaagaagttcagcctgaccagcgagctgctggacagcgagagcctgaccgagctgcccctggtggagaagttcagctactgcagcctgagcacccccagcctgttcgccaacaacaacatggagatcttccaccccccccagagcaccgccgccagcgtggccaaggagagcagcctggccagcagcttcctggaggagaccaccgagtacatccacagcaacgccatggaggtgtgcaacaacgagaccatcagcgtgagcagctacaagatctggaaggacgactgcctgctgatggtgtggagcgtgaccaacaagagcggcctggagctgaagagcgccgacctggagatcttccccgccgagaacttcaaggtgaccgagcagcccggctgctgcctgcccgtgatggaggccgagagcaccaagagcttccagtacagcgtgcagatcgagaagcccttcaccgagggcaacctgaccggcttcatcagctaccacatgatggacacccacagcgcccagctggagttcagcgtgaacctgagcctgctggacttcatcagacccctgaagatcagcagcgacgacttcggcaagctgtggctgagcttcgccaacgacgtgaagcagaacgtgaagatgagcgagagccaggccgccctgcccagcgccctgaagaccctgcagcagaagctgagactgcacatcatcgagatcatcggcaacgagggcctgctggcctgccagctgctgcccagcatcccctgcctgctgcactgcagagtgcacgccgacgtgctggccctgtggttcagaagcagctgcagcaccctgcccgactacctgctgtaccagtgccagaaggtgatggagggcagctag

SEQ ID NO: 71958 - DNA, 1362 bp, Artificial Sequence
  Description of Artificial Sequence: Synthetic coding sequence
atgatcagccagttcttcatcctgagcagcaagggcgaccccctgatctacaaggacttcagaggcgacagcggcggcagagacgtggccgagctgttctacagaaagctgaccggcctgcccggcgacgagagccccgtggtgatgcaccaccacggcagacacttcatccacatcagacacagcggcctgtacctggtggtgaccaccagcgagaacgtgagccccttcagcctgctggagctgctgagcagactggccaccctgctgggcgactactgcggcagcctgggcgagggcaccatcagcagaaacgtggccctggtgtacgagctgctggacgaggtgctggactacggctacgtgcagaccaccagcaccgagatgctgagaaacttcatccagaccgaggccgtggtgagcaagcccttcagcctgttcgacctgagcagcgtgggcctgttcggcgccgagacccagcagagcaaggtggcccccagcagcgccgccagcagacccgtgctgagcagcagaagcgaccagagccagaagaacgaggtgttcctggacgtggtggagagactgagcgtgctgatcgccagcaacggcagcctgctgaaggtggacgtgcagggcgagatcagactgaagagcttcctgcccagcggcagcgagatgagaatcggcctgaccgaggagttctgcgtgggcaagagcgagctgagaggctacggccccggcatcagagtggacgaggtgagcttccacagcagcgtgaacctggacgagttcgagagccacagaatcctgagactgcagcccccccagggcgagctgaccgtgatgagataccagctgagcgacgacctgcccagccccctgcccttcagactgttccccagcgtgcagtgggacagaggcagcggcagactgcaggtgtacctgaagctgagatgcgacctgctgagcaagagccaggccctgaacgtgagactgcacctgcccctgcccagaggcgtggtgagcctgagccaggagctgagcagccccgagcagaaggccgagctggccgagggcgccctgagatgggacctgcccagagtgcagggcggcagccagctgagcggcctgttccagatggacgtgcccggcccccccggcccccccagccacggcctgagcaccagcgccagccccctgggcctgggccccgccagcctgagcttcgagctgcccagacacacctgcagcggcctgcaggtgagattcctgagactggccttcagaccctgcggcaacgccaacccccacaagtgggtgagacacctgagccacagcgacgcctacgtgatcagaatctag

SEQ ID NO: 71959 - DNA, 1362 bp, Artificial Sequence; identical to SEQ ID NO: 71958
  Description of Artificial Sequence: Synthetic coding sequence

SEQ ID NO: 71960 - DNA, 1653 bp, Artificial Sequence
  Description of Artificial Sequence: Synthetic coding sequence
atgagcgccgcctggatccccgccctgggcctgggcgtgtgcctgctgctgctgcccggccccgccggcagcgagggcgccgcccccatcgccatcacctgcttcaccagaggcctggacatcagaaaggagaaggccgacgtgctgtgccccggcggctgccccctggaggagttcagcgtgtacggcaacatcgtgtacgccagcgtgagcagcatctgcggcgccgccgtgcacagaggcgtgatcagcaacagcggcggccccgtgagagtgtacagcctgcccggcagagagaactacagcagcgtggacgccaacggcatccagagccagatgctgagcagatggagcgccagcttcaccgtgaccaagggcaagagcagcacccaggaggccaccggccaggccgtgagcaccgcccacccccccaccggcaagagactgaagaagacccccgagaagaagaccggcaacaaggactgcaaggccgacatcgccttcctgatcgacggcagcttcaacatcggccagagaagattcaacctgcagaagaacttcgtgggcaaggtggccctgatgctgggcatcggcaccgagggcccccacgtgggcctggtgcaggccagcgagcaccccaagatcgagttctacctgaagaacttcaccagcgccaaggacgtgctgttcgccatcaaggaggtgggcttcagaggcggcaacagcaacaccggcaaggccctgaagcacaccgcccagaagttcttcaccgtggacgccggcgtgagaaagggcatccccaaggtggtggtggtgttcatcgacggctggcccagcgacgacatcgaggaggccggcatcgtggccagagagttcggcgtgaacgtgttcatcgtgagcgtggccaagcccatccccgaggagctgggcatggtgcaggacgtgaccttcgtggacaaggccgtgtgcagaaacaacggcttcttcagctaccacatgcccaactggttcggcaccaccaagtacgtgaagcccctggtgcagaagctgtgcacccacgagcagatgatgtgcagcaagacctgctacaacagcgtgaacatcgccttcctgatcgacggcagcagcagcgtgggcgacagcaacttcagactgatgctggagttcgtgagcaacatcgccaagaccttcgagatcagcgacatcggcgccaagatcgccgccgtgcagttcacctacgaccagagaaccgagttcagcttcaccgactacagcaccaaggagaacgtgctggccgtgatcagaaacatcagatacatgagcggcggcaccgccaccggcgacgccatcagcttcaccgtgagaaacgtgttcggccccatcagagagagccccaacaagaacttcctggtgatcgtgaccgacggccagagctacgacgacgtgcagggccccgccgccgccgcccacgacgccggcatcaccatcttcagcgtgggcgtggcctgggcccccctggacgacctgaaggacatggccagcaagcccaaggagagccacgccttcttcaccagagagttcaccggcctggagcccatcgtgagcgacgtgatcagaggcatctgcagagacttcctggagagccagcagtag

SEQ ID NO: 71961 - DNA, 435 bp, Artificial Sequence
  Description of Artificial Sequence: Synthetic coding sequence
atgatcaagttcttcctgatggtgaacaagcagggccagaccagactgagcaagtactacgagcacgtggacatcaacaagagaaccctgctggagaccgaggtgatcaagagctgcctgagcagaagcaacgagcagtgcagcttcatcgagtacaaggacttcaagctgatctacagacagtacgccgccctgttcatcgtggtgggcgtgaacgacaccgagaacgagatggccatctacgagttcatccacaacttcgtggaggtgctggacgagtacttcagcagagtggtgaagggccacatcatgttcaacctggacaaggtgcacatcatcctggacgagatggtgctgaacggctgcatcgtggagaccaacagagccagaatcctggcccccctgctgatcctggacaagatgagcgagagctag

SEQ ID NO: 71962 - DNA, 435 bp, Artificial Sequence
  Description of Artificial Sequence: Synthetic coding sequence
atgatcaagttcttcctgatggtgaacaagcagggccagaccagactgagcaagtactacgagcacgtggacatcaacaagagaaccctgctggagaccgaggtgatcaagagctgcctgagcagaagcaacgagcagtgcagcttcatcgagtacaaggacttcaagctgatctacagacagtacgccgccctgttcatcgtggtgggcgtgaacgacaccgagaacgagatggccatctacgagttcatccacaacttcgtggaggtgctggacgagtacttcagcagagtgagcgagctggacatcatgttcaacctggacaaggtgcacatcatcctggacgagatggtgctgaacggctgcatcgtggagaccaacagagccagaatcctggcccccctgctgatcctggacaagatgagcgagagctag

SEQ ID NO: 71963 - DNA, 27 bp, Artificial Sequence
  Description of Artificial Sequence: Synthetic coding sequence
atgatcaagttcttcctgatggtgtag

SEQ ID NO: 71964 - DNA, 297 bp, Artificial Sequence
  Description of Artificial Sequence: Synthetic coding sequence
atgatcaagttcttcctgatggtgaacaagcagggccagaccagactgagcaagtactacgagcacgtggacatcaacaagagaaccctgctggagaccgaggtgatcaagagctgcctgagcagaagcaacgagcagtgcagcttcatcgagtacaaggacttcaagctgatctacagacagtacgccgccctgttcatcgtggtgggcgtgaacgacaccgagaacgagatggccatctacgagttcatccacaacttcgtggaggtgctggacgagtacttcagcagagtgtag

SEQ ID NO: 71965 - DNA, 402 bp, Artificial Sequence
  Description of Artificial Sequence: Synthetic coding sequence
atgatcaagttcttcctgatggtgaacaagcagggccagaccagactgagcaagtactacgagcacgtggacatcaacaagagaaccctgctggagaccgaggtgatcaagagctgcctgagcagaagcaacgagcagtgcagcttcatcgagtacaaggacttcaagctgatctacagacagtacgccgccctgttcatcgtggtgggcgtgaacgacaccgagaacgagatggccatctacgagttcatccacaacttcgtggaggtgctggacgagtacttcagcagagtgagcgagctggacatcatgttcaacctggacaaggtgcacatcatcctggacgagatggtgctgaacggctgcatcgtggagaccaacagagccagaatcctggcctag

SEQ ID NO: 71966 - DNA, 4611 bp, Artificial Sequence
  Description of Artificial Sequence: Synthetic coding sequence
atgggcgtggtgaacttcgtgttcagagccagcgaggacctgcaggtgctggagaactacagcgacgcccccatgacccccaagcagatcctgcaggtgatcgaggccgagggcctgaaggagatgagcggcaccagccccctggcctgcctgaacgccatgctgcacagcaacagcagaggcggcgagggcctgttctacaagctgcccggcagaatcagcctgttcaccctgaagaaggacgccctgcagtggagcagacaccccgccaccgtggagggcgaggagcccgaggacaccgccgacgtggagagctgcggcagcaacgaggccagcaccgtgagcggcgagaacgacgtgagcctggacgagaccagcagcaacgccagctgcagcaccgagagccagagcagacccctgagcaaccccagagacagctacagagccagcagccaggccaacaagcagaagaagaagaccggcgtgatgctgcccagagtggtgctgacccccctgaaggtgaacggcgcccacgtggagagcgccagcggcttcagcggctgccacgccgacggcgagagcggcagccccagcagcagcagcagcggcagcctggccctgggcagcgccgccatcagaggccaggccgaggtgacccaggaccccgcccccctgctgagaggcttcagaaagcccgccaccggccagatgaagagaaacagaggcgaggagatcgacttcgagacccccggcagcatcctggtgaacaccaacctgagagccctgatcaacagcagaaccttccacgccctgcccagccacttccagcagcagctgctgttcctgctgcccgaggtggacagacaggtgggcaccgacggcctgctgagactgagcagcagcgccctgaacaacgagttcttcacccacgccgcccagagctggagagagagactggccgacggcgagttcacccacgagatgcaggtgagaatcagacaggagatggagaaggagaagaaggtggagcagtggaaggagaagttcttcgaggactactacggccagaagctgggcctgaccaaggaggagagcctgcagcagaacgtgggccaggaggaggccgagatcaagagcggcctgtgcgtgcccggcgagagcgtgagaatccagagaggccccgccaccagacagagagacggccacttcaagaagagaagcagacccgacctgagaaccagagccagaagaaacctgtacaagaagcaggagagcgagcaggccggcgtggccaaggacgccaagagcgtggccagcgacgtgcccctgtacaaggacggcgaggccaagaccgaccccgccggcctgagcagcccccacctgcccggcaccagcagcgccgcccccgacctggagggccccgagttccccgtggagagcgtggccagcagaatccaggccgagcccgacaacctggccagagccagcgccagccccgacagaatccccagcctgccccaggagaccgtggaccaggagcccaaggaccagaagagaaagagcttcgagcaggccgccagcgccagcttccccgagaagaagcccagactggaggacagacagagcttcagaaacaccatcgagagcgtgcacaccgagaagccccagcccaccaaggaggagcccaaggtgccccccatcagaatccagctgagcagaatcaagcccccctgggtggtgaagggccagcccacctaccagatctgccccagaatcatccccaccaccgagagcagctgcagaggctggaccggcgccagaaccctggccgacatcaaggccagagccctgcaggtgagaggcgccagaggccaccactgccacagagaggccgccaccaccgccatcggcggcggcggcggccccggcggcggcggcggcggcgccaccgacgagggcggcggcagaggcagcagcagcggcgacggcggcgaggcctgcggccaccccgagcccagaggcggccccagcacccccggcaagtgcaccagcgacctgcagagaacccagctgctgcccccctaccccctgaacggcgagcacacccaggccggcaccgccatgagcagagccagaagagaggacctgcccagcctgagaaaggaggagagctgcctgctgcagagagccaccgtgggcctgaccgacggcctgggcgacgccagccagctgcccgtggcccccaccggcgaccagccctgccaggccctgcccctgctgagcagccagaccagcgtggccgagagactggtggagcagccccagctgcaccccgacgtgagaaccgagtgcgagagcggcaccaccagctgggagagcgacgacgaggagcagggccccaccgtgcccgccgacaacggccccatcctgagcctggtgggcgacgacaccctggagaagggcaccggccaggccctggacagccaccccaccatgaaggaccccgtgaacgtgacccccagcagcacccccgagagcagccccaccgactgcctgcagaacagagccttcgacgacgagctgggcctgggcggcagctgcccccccatgagagagagcgacaccagacaggagaacctgaagaccaaggccctggtgagcaacagcagcctgcactggatccccatccccagcaacgacgaggtggtgaagcagcccaagcccgagagcagagagcacatccccagcgtggagccccaggtgggcgaggagtgggagaaggccgcccccaccccccccgccctgcccggcgacctgaccgccgaggagggcctggaccccctggacagcctgaccagcctgtggaccgtgcccagcagaggcggcagcgacagcaacggcagctactgccagcaggtggacatcgagaagctgaagatcaacggcgacagcgaggccctgagcccccacggcgagagcaccgacaccgccagcgacttcgagggccacctgaccgaggacagcagcgaggccgacaccagagaggccgccgtgaccaagggcagcagcgtggacaaggacgagaagcccaactggaaccagagcgcccccctgagcaaggtgaacggcgacatgagactggtgaccagaaccgacggcatggtggccccccagagctgggtgagcagagtgtgcgccgtgagacagaagatccccgacagcctgctgctggccagcaccgagtaccagcccagagccgtgtgcctgagcatgcccggcagcagcgtggaggccaccaaccccctggtgatgcagctgctgcagggcagcctgcccctggagaaggtgctgccccccgcccacgacgacagcatgagcgagagcccccaggtgcccctgaccaaggaccagagccacggcagcctgagaatgggcagcctgcacggcctgggcaagaacagcggcatggtggacggcagcagccccagcagcctgagagccctgaaggagcccctgctgcccgacagctgcgagaccggcaccggcctggccagaatcgaggccacccaggcccccggcgccccccagaagaactgcaaggccgtgcccagcttcgacagcctgcaccccgtgaccaaccccatcaccagcagcagaaagctggaggagatggacagcaaggagcagttcagcagcttcagctgcgaggaccagaaggaggtgagagccatgagccaggacagcaacagcaacgccgcccccggcaagagccccggcgacctgaccaccagcagaacccccagattcagcagccccaacgtgatcagcttcggccccgagcagaccggcagagccctgggcgaccagagcaacgtgaccggccagggcaagaagctgttcggcagcggcaacgtggccgccaccctgcagagacccagacccgccgaccccatgcccctgcccgccgagatcccccccgtgttccccagcggcaagctgggccccagcaccaacagcatgagcggcggcgtgcagacccccagagaggactgggcccccaagccccacgccttcgtgggcagcgtgaagaacgagaagaccttcgtgggcggccccctgaaggccaacgccgagaacagaaaggccaccggccacagccccctggagctggtgggccacctggagggcatgcccttcgtgatggacctgcccttctggaagctgcccagagagcccggcaagggcctgagcgagcccctggagcccagcagcctgcccagccagctgagcatcaagcaggccttctacggcaagctgagcaagctgcagctgagcagcaccagcttcaactacagcagcagcagccccaccttccccaagggcctggccggcagcgtggtgcagctgagccacaaggccaacttcggcgccagccacagcgccagcctgagcctgcagatgttcaccgacagcagcaccgtggagagcatcagcctgcagtgcgcctgcagcctgaaggccatgatcatgtgccagggctgcggcgccttctgccacgacgactgcatcggccccagcaagctgtgcgtgctgtgcctggtggtgagatag

SEQ ID NO: 71967 - DNA, 4626 bp, Artificial Sequence
  Description of Artificial Sequence: Synthetic coding sequence
atgaaggacaagcagaagaagaagaaggagagaacctgggccgaggccgccagactggtgctggagaactacagcgacgcccccatgacccccaagcagatcctgcaggtgatcgaggccgagggcctgaaggagatgagaagcggcaccagccccctggcctgcctgaacgccatgctgcacagcaacagcagaggcggcgagggcctgttctacaagctgcccggcagaatcagcctgttcaccctgaagaaggacgccctgcagtggagcagacaccccgccaccgtggagggcgaggagcccgaggacaccgccgacgtggagagctgcggcagcaacgaggccagcaccgtgagcggcgagaacgacgtgagcctggacgagaccagcagcaacgccagctgcagcaccgagagccagagcagacccctgagcaaccccagagacagctacagagccagcagccaggccaacaagcagaagaagaagaccggcgtgatgctgcccagagtggtgctgacccccctgaaggtgaacggcgcccacgtggagagcgccagcggcttcagcggctgccacgccgacggcgagagcggcagccccagcagcagcagcagcggcagcctggccctgggcagcgccgccatcagaggccaggccgaggtgacccaggaccccgcccccctgctgagaggcttcagaaagcccgccaccggccagatgaagagaaacagaggcgaggagatcgacttcgagacccccggcagcatcctggtgaacaccaacctgagagccctgatcaacagcagaaccttccacgccctgcccagccacttccagcagcagctgctgttcctgctgcccgaggtggacagacaggtgggcaccgacggcctgctgagactgagcagcagcgccctgaacaacgagttcttcacccacgccgcccagagctggagagagagactggccgacggcgagttcacccacgagatgcaggtgagaatcagacaggagatggagaaggagaagaaggtggagcagtggaaggagaagttcttcgaggactactacggccagaagctgggcctgaccaaggaggagagcctgcagcagaacgtgggccaggaggaggccgagatcaagagcggcctgtgcgtgcccggcgagagcgtgagaatccagagaggccccgccaccagacagagagacggccacttcaagaagagaagcagacccgacctgagaaccagagccagaagaaacctgtacaagaagcaggagagcgagcaggccggcgtggccaaggacgccaagagcgtggccagcgacgtgcccctgtacaaggacggcgaggccaagaccgaccccgccggcctgagcagcccccacctgcccggcaccagcagcgccgcccccgacctggagggccccgagttccccgtggagagcgtggccagcagaatccaggccgagcccgacaacctggccagagccagcgccagccccgacagaatccccagcctgccccaggagaccgtggaccaggagcccaaggaccagaagagaaagagcttcgagcaggccgccagcgccagcttccccgagaagaagcccagactggaggacagacagagcttcagaaacaccatcgagagcgtgcacaccgagaagccccagcccaccaaggaggagcccaaggtgccccccatcagaatccagctgagcagaatcaagcccccctgggtggtgaagggccagcccacctaccagatctgccccagaatcatccccaccaccgagagcagctgcagaggctggaccggcgccagaaccctggccgacatcaaggccagagccctgcaggtgagaggcgccagaggccaccactgccacagagaggccgccaccaccgccatcggcggcggcggcggccccggcggcggcggcggcggcgccaccgacgagggcggcggcagaggcagcagcagcggcgacggcggcgaggcctgcggccaccccgagcccagaggcggccccagcacccccggcaagtgcaccagcgacctgcagagaacccagctgctgcccccctaccccctgaacggcgagcacacccaggccggcaccgccatgagcagagccagaagagaggacctgcccagcctgagaaaggaggagagctgcctgctgcagagagccaccgtgggcctgaccgacggcctgggcgacgccagccagctgcccgtggcccccaccggcgaccagccctgccaggccctgcccctgctgagcagccagaccagcgtggccgagagactggtggagcagccccagctgcaccccgacgtgagaaccgagtgcgagagcggcaccaccagctgggagagcgacgacgaggagcagggccccaccgtgcccgccgacaacggccccatcctgagcctggtgggcgacgacaccctggagaagggcaccggccaggccctggacagccaccccaccatgaaggaccccgtgaacgtgacccccagcagcacccccgagagcagccccaccgactgcctgcagaacagagccttcgacgacgagctgggcctgggcggcagctgcccccccatgagagagagcgacaccagacaggagaacctgaagaccaaggccctggtgagcaacagcagcctgcactggatccccatccccagcaacgacgaggtggtgaagcagcccaagcccgagagcagagagcacatccccagcgtggagccccaggtgggcgaggagtgggagaaggccgcccccaccccccccgccctgcccggcgacctgaccgccgaggagggcctggaccccctggacagcctgaccagcctgtggaccgtgcccagcagaggcggcagcgacagcaacggcagctactgccagcaggtggacatcgagaagctgaagatcaacggcgacagcgaggccctgagcccccacggcgagagcaccgacaccgccagcgacttcgagggccacctgaccgaggacagcagcgaggccgacaccagagaggccgccgtgaccaagggcagcagcgtggacaaggacgagaagcccaactggaaccagagcgcccccctgagcaaggtgaacggcgacatgagactggtgaccagaaccgacggcatggtggccccccagagctgggtgagcagagtgtgcgccgtgagacagaagatccccgacagcctgctgctggccagcaccgagtaccagcccagagccgtgtgcctgagcatgcccggcagcagcgtggaggccaccaaccccctggtgatgcagctgctgcagggcagcctgcccctggagaaggtgctgccccccgcccacgacgacagcatgagcgagagcccccaggtgcccctgaccaaggaccagagccacggcagcctgagaatgggcagcctgcacggcctgggcaagaacagcggcatggtggacggcagcagccccagcagcctgagagccctgaaggagcccctgctgcccgacagctgcgagaccggcaccggcctggccagaatcgaggccacccaggcccccggcgccccccagaagaactgcaaggccgtgcccagcttcgacagcctgcaccccgtgaccaaccccatcaccagcagcagaaagctggaggagatggacagcaaggagcagttcagcagcttcagctgcgaggaccagaaggaggtgagagccatgagccaggacagcaacagcaacgccgcccccggcaagagccccggcgacctgaccaccagcagaacccccagattcagcagccccaacgtgatcagcttcggccccgagcagaccggcagagccctgggcgaccagagcaacgtgaccggccagggcaagaagctgttcggcagcggcaacgtggccgccaccctgcagagacccagacccgccgaccccatgcccctgcccgccgagatcccccccgtgttccccagcggcaagctgggccccagcaccaacagcatgagcggcggcgtgcagacccccagagaggactgggcccccaagccccacgccttcgtgggcagcgtgaagaacgagaagaccttcgtgggcggccccctgaaggccaacgccgagaacagaaaggccaccggccacagccccctggagctggtgggccacctggagggcatgcccttcgtgatggacctgcccttctggaagctgcccagagagcccggcaagggcctgagcgagcccctggagcccagcagcctgcccagccagctgagcatcaagcaggccttctacggcaagctgagcaagctgcagctgagcagcaccagcttcaactacagcagcagcagccccaccttccccaagggcctggccggcagcgtggtgcagctgagccacaaggccaacttcggcgccagccacagcgccagcctgagcctgcagatgttcaccgacagcagcaccgtggagagcatcagcctgcagtgcgcctgcagcctgaaggccatgatcatgtgccagggctgcggcgccttctgccacgacgactgcatcggccccagcaagctgtgcgtgctgtgcctggtggtgagatag

SEQ ID NO: 71968 - DNA, 4626 bp, Artificial Sequence; identical to SEQ ID NO: 71967
  Description of Artificial Sequence: Synthetic coding sequence

SEQ ID NO: 71969 - DNA, 4389 bp, Artificial Sequence
  Description of Artificial Sequence: Synthetic coding sequence
atgctgagcttccccaacctgaaccaggtgctggagaactacagcgacgcccccatgacccccaagcagatcctgcaggtgatcgaggccgagggcctgaaggagatgagcagcggcaccagccccctggcctgcctgaacgccatgctgcacagcaacagcagaggcggcgagggcctgttctacaagctgcccggcagaatcagcctgttcaccctgaagaaggacgccctgcagtggagcagacaccccgccaccgtggagggcgaggagcccgaggacaccgccgacgtggagagctgcggcagcaacgaggccagcaccgtgagcggcgagaacgacgtgagcctggacgagaccagcagcaacgccagctgcagcaccgagagccagagcagacccctgagcaaccccagagacagctacagagccagcagccaggccaacaagcagaagaagaagaccggcgtgatgctgcccagagtggtgctgacccccctgaaggtgaacggcgcccacgtggagagcgccagcggccagatgaagagaaacagaggcgaggagatcgacttcgagacccccggcagcatcctggtgaacaccaacctgagagccctgatcaacagcagaaccttccacgccctgcccagccacttccagcagcagctgctgttcctgctgcccgaggtggacagacaggtgggcaccgacggcctgctgagactgagcagcagcgccctgaacaacgagttcttcacccacgccgcccagagctggagagagagactggccgacggcgagttcacccacgagatgcaggtgagaatcagacaggagatggagaaggagaagaaggtggagcagtggaaggagaagttcttcgaggactactacggccagaagctgggcctgaccaaggaggagagcctgcagcagaacgtgggccaggaggaggccgagatcaagagcggcctgtgcgtgcccggcgagagcgtgagaatccagagaggccccgccaccagacagagagacggccacttcaagaagagaagcagacccgacctgagaaccagagccagaagaaacctgtacaagaagcaggagagcgagcaggccggcgtggccaaggacgccaagagcgtggccagcgacgtgcccctgtacaaggacggcgaggccaagaccgaccccgccggcctgagcagcccccacctgcccggcaccagcagcgccgcccccgacctggagggccccgagttccccgtggagagcgtggccagcagaatccaggccgagcccgacaacctggccagagccagcgccagccccgacagaatccccagcctgccccaggagaccgtggaccaggagcccaaggaccagaagagaaagagcttcgagcaggccgccagcgccagcttccccgagaagaagcccagactggaggacagacagagcttcagaaacaccatcgagagcgtgcacaccgagaagccccagcccaccaaggaggagcccaaggtgccccccatcagaatccagctgagcagaatcaagcccccctgggtggtgaagggccagcccacctaccagatctgccccagaatcatccccaccaccgagagcagctgcagaggctggaccggcgccagaaccctggccgacatcaaggccagagccctgcaggtgagaggcgccagaggccaccactgccacagagaggccaccgacgagggcggcggcagaggcagcagcagcggcgacggcggcgaggcctgcggccaccccgagcccagaggcggccccagcacccccggcaagtgcaccagcgacctgcagagaacccagctgctgcccccctaccccctgaacggcgagcacacccaggccggcaccgccatgagcagagccagaagagaggacctgcccagcctgagaaaggaggagagctgcctgctgcagagagccaccgtgggcctgaccgacggcctgggcgacgccagccagctgcccgtggcccccaccggcgaccagccctgccaggccctgcccctgctgagcagccagaccagcgtggccgagagactggtggagcagccccagctgcaccccgacgtgagaaccgagtgcgagagcggcaccaccagctgggagagcgacgacgaggagcagggccccaccgtgcccgccgacaacggccccatcctgagcctggtgggcgacgacaccctggagaagggcaccggccaggccctggacagccaccccaccatgaaggaccccgtgaacgtgacccccagcagcacccccgagagcagccccaccgactgcctgcagaacagagccttcgacgacgagctgggcctgggcggcagctgcccccccatgagagagagcgacaccagacaggagaacctgaagaccaaggccctggtgagcaacagcagcctgcactggatccccatccccagcaacgacgaggtggtgaagcagcccaagcccgagagcagagagcacatccccagcgtggagccccaggtgggcgaggagtgggagaaggccgcccccaccccccccgccctgcccggcgacctgaccgccgaggagggcctggaccccctggacagcctgaccagcctgtggaccgtgcccagcagaggcggcagcgacagcaacggcagctactgccagcaggtggacatcgagaagctgaagatcaacggcgacagcgaggccctgagcccccacggcgagagcaccgacaccgccagcgacttcgagggccacctgaccgaggacagcagcgaggccgacaccagagaggccgccgtgaccaagggcagcagcgtggacaaggacgagaagcccaactggaaccagagcgcccccctgagcaaggtgaacggcgacatgagactggtgaccagaaccgacggcatggtggccccccagagctgggtgagcagagtgtgcgccgtgagacagaagatccccgacagcctgctgctggccagcaccgagtaccagcccagagccgtgtgcctgagcatgcccggcagcagcgtggaggccaccaaccccctggtgatgcagctgctgcagggcagcctgcccctggagaaggtgctgccccccgcccacgacgacagcatgagcgagagcccccaggtgcccctgaccaaggaccagagccacggcagcctgagaatgggcagcctgcacggcctgggcaagaacagcggcatggtggacggcagcagccccagcagcctgagagccctgaaggagcccctgctgcccgacagctgcgagaccggcaccggcctggccagaatcgaggccacccaggcccccggcgccccccagaagaactgcaaggccgtgcccagcttcgacagcctgcaccccgtgaccaaccccatcaccagcagcagaaagctggaggagatggacagcaaggagcagttcagcagcttcagctgcgaggaccagaaggaggtgagagccatgagccaggacagcaacagcaacgccgcccccggcaagagccccggcgacctgaccaccagcagaacccccagattcagcagccccaacgtgatcagcttcggccccgagcagaccggcagagccctgggcgaccagagcaacgtgaccggccagggcaagaagctgttcggcagcggcaacgtggccgccaccctgcagagacccagacccgccgaccccatgcccctgcccgccgagatcccccccgtgttccccagcggcaagctgggccccagcaccaacagcatgagcggcggcgtgcagacccccagagaggactgggcccccaagccccacgccttcgtgggcagcgtgaagaacgagaagaccttcgtgggcggccccctgaaggccaacgccgagaacagaaaggccaccggccacagccccctggagctggtgggccacctggagggcatgcccttcgtgatggacctgcccttctggaagctgcccagagagcccggcaagggcctgagcgagcccctggagcccagcagcctgcccagccagctgagcatcaagcaggccttctacggcaagctgagcaagctgcagctgagcagcaccagcttcaactacagcagcagcagccccaccttccccaagggcctggccggcagcgtggtgcagctgagccacaaggccaacttcggcgccagccacagcgccagcctgagcctgcagatgttcaccgacagcagcaccgtggagagcatcagcctgcagtgcgcctgcagcctgaaggccatgatcatgtgccagggctgcggcgccttctgccacgacgactgcatcggccccagcaagctgtgcgtgctgtgcctggtggtgagatag

SEQ ID NO: 71970 - DNA, 4626 bp, Artificial Sequence; identical to SEQ ID NO: 71967
  Description of Artificial Sequence: Synthetic coding sequence

SEQ ID NO: 71971 - DNA, 225 bp, Artificial Sequence
  Description of Artificial Sequence: Synthetic coding sequence
tgatgggccgaggccgccagactggtgctggagaactacagcgacgcccccatgacccccaagcagatcctgcaggtgatcgaggccgagggcctgaaggagatgagaagcggcaccagccccctggcctgcctgaacgccatgctgcacagcaacagcagaggcggcgagggcctgttctacaagctgcccggcagaatcagcctgttcaccctgaaggtgtag

SEQ ID NO: 71972 - DNA, 258 bp, Artificial Sequence
  Description of Artificial Sequence: Synthetic coding sequence
atgaaggacaagcagaagaagaagaaggagagaacctgggccgaggccgccagactggtgctggagaactacagcgacgcccccatgacccccaagcagatcctgcaggtgatcgaggccgagggcctgaaggagatgagaagcggcaccagccccctggcctgcctgaacgccatgctgcacagcaacagcagaggcggcgagggcctgttctacaagctgcccggcagaatcagcctgttcaccctgaaggtgtag

SEQ ID NO: 71973 - DNA, 255 bp, Artificial Sequence
  Description of Artificial Sequence: Synthetic coding sequence
atgaaggacaagcagaagaagaagaaggagagaacctgggccgaggccgccagactggtgctggagaactacagcgacgcccccatgacccccaagcagatcctgcaggtgatcgaggccgagggcctgaaggagatgagcggcaccagccccctggcctgcctgaacgccatgctgcacagcaacagcagaggcggcgagggcctgttctacaagctgcccggcagaatcagcctgttcaccctgaagagatag

SEQ ID NO: 71974 - DNA, 2757 bp, Artificial Sequence
  Description of Artificial Sequence: Synthetic coding sequence
atgaagagaaccaagtgcgccgacatcgacgtggagacccccgacagcatcctggtgaacaccaacctgagagccctgatcaacaagcacaccttcagcgtgctgcccggcgactgccagcagagactgctgctgctgctgcccgaggtggacagacaggtgggccccgacggcctgatgaagctgaacggcagcgccctgaacaacgagttcttcaccagcgccgcccagggctggaaggagagactgagcgagggcgagttcacccccgagatgcaggtgagaatcagacaggagatcgagaaggagaagaaggtggagccctggaaggagcagttcttcgagagctactacggccagagcagcggcctgagcctggaggacagcaagaagctgaccgccagccccagcgaccccaaggtgaagaagacccccgccgagcagcccaagagcatgcccgtgagcgaggccagcctgatcagaatcgtgcccgtggtgagccagagcgagtgcaaggaggaggccctgcagatgagcagccccggcagaaaggaggagtgcgagagccagggcgaggtgcagcccaacttcagcaccagcagcgagcccctgctgagcagcgccctgaacacccacgagctgagcagcatcctgcccatcaagtgccccaaggacgaggacctgctggagcagaagcccgtgaccagcgccgagcaggagagcgagaagaaccacctgaccaccgccagcaactacaacaagagcgagagccaggagagcctggtgaccagccccagcaagcccaagagccccggcgtggagaagcccatcgtgaagcccaccgccggcgccggcccccaggagaccaacatgaaggagcccctggccaccctggtggaccagagccccgagagcctgaagagaaagagcagcctgacccaggaggaggcccccgtgagctgggagaagagacccagagtgaccgagaacagacagcaccagcagcccttccaggtgagcccccagcccttcctgaacagaggcgacagaatccaggtgagaaaggtgccccccctgaagatccccgtgagcagaatcagccccatgcccttccaccccagccaggtgagccccagagccagattccccgtgagcatcaccagccccaacagaaccggcgccagaaccctggccgacatcaaggccaaggcccagctggtgaaggcccagagagccgccgccgccgccgccgccgccgccgccgccgccgccagcgtgggcggcaccatccccggccccggccccggcggcggccagggccccggcgagggcggcgagggccagaccgccagaggcggcagccccggcagcgacagagtgagcgagaccggcaagggccccaccctggagctggccggcaccggcagcagaggcggcaccagagagctgctgccctgcggccccgagacccagccccagagcgagaccaagaccacccccagccaggcccagccccacagcgtgagcggcgcccagctgcagcagaccccccccgtgccccccacccccgccgtgagcggcgcctgcaccagcgtgcccagccccgcccacatcgagaagctggacaacgagaagctgaaccccaccagagccaccgccaccgtggccagcgtgagccacccccagggccccagcagctgcagacaggagaaggcccccagccccaccggcttccagctggaggacatcagcaccagccagagattcatgctgggcttcgccggcagaagaaccagcaagcccgccatggccggccactacctgctgaacatcagcacctacggcagaggcagcgagagcttcagaagaacccacagcgtgaaccccgaggacagattctgcctgagcagccccaccgaggccctgaagatgggctacaccgactgcaagaacgccaccggcgagagcagcagcagcaaggaggacgacaccgacgaggagagcaccggcgacgagcaggagagcgtgaccgtgaaggaggagccccaggtgagccagagcgccggcaagggcgacaccagcagcggcccccacagcagagagaccctgagcaccagcgactgcctggccagcaagaacgtgaaggccgagatccccctgaacgagcagaccaccctgagcaaggagaactacctgttcaccagaggccagaccttcgacgagaagaccctggccagagacctgatccaggccgcccagaagcagatggcccacgccgtgagaggcaaggccatcagaagcagccccgagctgttcagcagcaccgtgctgcccctgcccgccgacagccccacccaccagcccctgctgctgccccccctgcagacccccaagctgtacggcagccccacccagatcggccccagctacagaggcatgatcaacgtgagcaccagcagcgacatggaccacaacagcgccgtgcccggcagccaggtgagcagcaacgtgggcgacgtgatgagcttcagcgtgaccgtgaccaccatccccgccagccaggccatgaaccccagcagccacggccagaccatccccgtgcaggccttcagcgaggagaacagcatcgagggcacccccagcaagtgctactgcagactgaaggccatgatcatgtgcaagggctgcggcgccttctgccacgacgactgcatcggccccagcaagctgtgcgtgagctgcctggtggtgagatag

SEQ ID NO: 71975 - DNA, 4224 bp, Artificial Sequence
  Description of Artificial Sequence: Synthetic coding sequence
atgagccacaaggagatcctgcaggtgatccagagagagggcctgaaggagatcagcagcggcaccagccccctggcctgcctgaacgccatgctgcacaccaacagcagaggcgaggagggcatcttctacaaggtgcccggcagaatgggcgtgtacaccctgaagaaggacgtgcccgacggcgtgaaggagctgagcgagggcagcgaggagagcagcgacggccagagcgacagccagagcagcgagaacagcagcagcagcagcgacggcggcagcaacaaggagggcaagaagagcagatggaagagaaaggtgagcagcagcagcccccagagcggctgccccagccccaccatccccgccggcaaggtgatcagccccagccagaagcacagcaagaaggccctgaagcaggccctgaagcagcagcagcagaagaagcagcagcagcagtgcagacccagcatcagcatcagcagcaaccagcacctgagcctgaagaccgtgaaggccgccagcgacagcgtgcccgccaagcccgccacctgggagggcaagcagagcgacggccagaccggcagcccccagaacagcaacagcagcttcagcagcagcgtgaaggtggagaacaccctgctgggcctgggcaagaagagcttccagagaagcgagagactgcacaccagacagatgaagagaaccaagtgcgccgacatcgacgtggagacccccgacagcatcctggtgaacaccaacctgagagccctgatcaacaagcacaccttcagcgtgctgcccggcgactgccagcagagactgctgctgctgctgcccgaggtggacagacaggtgggccccgacggcctgatgaagctgaacggcagcgccctgaacaacgagttcttcaccagcgccgcccagggctggaaggagagactgagcgagggcgagttcacccccgagatgcaggtgagaatcagacaggagatcgagaaggagaagaaggtggagccctggaaggagcagttcttcgagagctactacggccagagcagcggcctgagcctggaggacagcaagaagctgaccgccagccccagcgaccccaaggtgaagaagacccccgccgagcagcccaagagcatgcccgtgagcgaggccagcctgatcagaatcgtgcccgtggtgagccagagcgagtgcaaggaggaggccctgcagatgagcagccccggcagaaaggaggagtgcgagagccagggcgaggtgcagcccaacttcagcaccagcagcgagcccctgctgagcagcgccctgaacacccacgagctgagcagcatcctgcccatcaagtgccccaaggacgaggacctgctggagcagaagcccgtgaccagcgccgagcaggagagcgagaagaaccacctgaccaccgccagcaactacaacaagagcgagagccaggagagcctggtgaccagccccagcaagcccaagagccccggcgtggagaagcccatcgtgaagcccaccgccggcgccggcccccaggagaccaacatgaaggagcccctggccaccctggtggaccagagccccgagagcctgaagagaaagagcagcctgacccaggaggaggcccccgtgagctgggagaagagacccagagtgaccgagaacagacagcaccagcagcccttccaggtgagcccccagcccttcctgaacagaggcgacagaatccaggtgagaaaggtgccccccctgaagatccccgtgagcagaatcagccccatgcccttccaccccagccaggtgagccccagagccagattccccgtgagcatcaccagccccaacagaaccggcgccagaaccctggccgacatcaaggccaaggcccagctggtgaaggcccagagagccgccgccgccgccgccgccgccgccgccgccgccgccagcgtgggcggcaccatccccggccccggccccggcggcggccagggccccggcgagggcggcgagggccagaccgccagaggcggcagccccggcagcgacagagtgagcgagaccggcaagggccccaccctggagctggccggcaccggcagcagaggcggcaccagagagctgctgccctgcggccccgagacccagccccagagcgagaccaagaccacccccagccaggcccagccccacagcgtgagcggcgcccagctgcagcagaccccccccgtgccccccacccccgccgtgagcggcgcctgcaccagcgtgcccagccccgcccacatcgagaagctggacaacgagaagctgaaccccaccagagccaccgccaccgtggccagcgtgagccacccccagggccccagcagctgcagacaggagaaggcccccagccccaccggccccgccctgatcagcggcgccagccccgtgcactgcgccgccgacggcaccgtggagctgaaggccggccccagcaagaacatccccaaccccagcgccagcagcaagaccgacgccagcgtgcccgtggccgtgacccccagccccctgaccagcctgctgaccaccgccaccctggagaagctgcccgtgccccaggtgagcgccaccaccgcccccgccggcagcgccccccccagcagcaccctgcccgccgccagcagcctgaagacccccggcaccagcctgaacatgaacggccccaccctgagacccaccagcagcatccccgccaacaaccccctggtgacccagctgctgcagggcaaggacgtgcccatggagcagatcctgcccaagcccctgaccaaggtggagatgaagaccgtgcccctgaccgccaaggaggagagaggcatgggcgccctgatcgccaccaacaccaccgagaacagcaccagagaggaggtgaacgagagacagagccaccccgccacccagcagcagctgggcaagaccctgcagagcaagcagctgccccaggtgcccagacccctgcagctgttcagcgccaaggagctgagagacagcagcatcgacacccaccagtaccacgagggcctgagcaaggccacccaggaccagatcctgcagaccctgatccagagagtgagaagacagaacctgctgagcgtggtgccccccagccagttcaacttcgcccacagcggcttccagctggaggacatcagcaccagccagagattcatgctgggcttcgccggcagaagaaccagcaagcccgccatggccggccactacctgctgaacatcagcacctacggcagaggcagcgagagcttcagaagaacccacagcgtgaaccccgaggacagattctgcctgagcagccccaccgaggccctgaagatgggctacaccgactgcaagaacgccaccggcgagagcagcagcagcaaggaggacgacaccgacgaggagagcaccggcgacgagcaggagagcgtgaccgtgaaggaggagccccaggtgagccagagcgccggcaagggcgacaccagcagcggcccccacagcagagagaccctgagcaccagcgactgcctggccagcaagaacgtgaaggccgagatccccctgaacgagcagaccaccctgagcaaggagaactacctgttcaccagaggccagaccttcgacgagaagaccctggccagagacctgatccaggccgcccagaagcagatggcccacgccgtgagaggcaaggccatcagaagcagccccgagctgttcagcagcaccgtgctgcccctgcccgccgacagccccacccaccagcccctgctgctgccccccctgcagacccccaagctgtacggcagccccacccagatcggccccagctacagaggcatgatcaacgtgagcaccagcagcgacatggaccacaacagcgccgtgcccggcagccaggtgagcagcaacgtgggcgacgtgatgagcttcagcgtgaccgtgaccaccatccccgccagccaggccatgaaccccagcagccacggccagaccatccccgtgcaggccttcagcgaggagaacagcatcgagggcacccccagcaagtgctactgcagactgaaggccatgatcatgtgcaagggctgcggcgccttctgccacgacgactgcatcggccccagcaagctgtgcgtgagctgcctggtggtgagatag

SEQ ID NO: 71976 - DNA, 2757 bp, Artificial Sequence; identical to SEQ ID NO: 71974
  Description of Artificial Sequence: Synthetic coding sequence

SEQ ID NO: 71977 - DNA, 4308 bp, Artificial Sequence
  Description of Artificial Sequence: Synthetic coding sequence
atgagagagaagggcagaagaaagaagggcagaacctgggccgaggccgccaagaccgtgctggagaagtaccccaacacccccatgagccacaaggagatcctgcaggtgatccagagagagggcctgaaggagatcagaagcggcaccagccccctggcctgcctgaacgccatgctgcacaccaacagcagaggcgaggagggcatcttctacaaggtgcccggcagaatgggcgtgtacaccctgaagaaggacgtgcccgacggcgtgaaggagctgagcgagggcagcgaggagagcagcgacggccagagcgacagccagagcagcgagaacagcagcagcagcagcgacggcggcagcaacaaggagggcaagaagagcagatggaagagaaaggtgagcagcagcagcccccagagcggctgccccagccccaccatccccgccggcaaggtgatcagccccagccagaagcacagcaagaaggccctgaagcaggccctgaagcagcagcagcagaagaagcagcagcagcagtgcagacccagcatcagcatcagcagcaaccagcacctgagcctgaagaccgtgaaggccgccagcgacagcgtgcccgccaagcccgccacctgggagggcaagcagagcgacggccagaccggcagcccccagaacagcaacagcagcttcagcagcagcgtgaaggtggagaacaccctgctgggcctgggcaagaagagcttccagagaagcgagagactgcacaccagacagatgaagagaaccaagtgcgccgacatcgacgtggagacccccgacagcatcctggtgaacaccaacctgagagccctgatcaacaagcacaccttcagcgtgctgcccggcgactgccagcagagactgctgctgctgctgcccgaggtggacagacaggtgggccccgacggcctgatgaagctgaacggcagcgccctgaacaacgagttcttcaccagcgccgcccagggctggaaggagagactgagcgagggcgagttcacccccgagatgcaggtgagaatcagacaggagatcgagaaggagaagaaggtggagccctggaaggagcagttcttcgagagctactacggccagagcagcggcctgagcctggaggacagcaagaagctgaccgccagccccagcgaccccaaggtgaagaagacccccgccgagcagcccaagagcatgcccgtgagcgaggccagcctgatcagaatcgtgcccgtggtgagccagagcgagtgcaaggaggaggccctgcagatgagcagccccggcagaaaggaggagtgcgagagccagggcgaggtgcagcccaacttcagcaccagcagcgagcccctgctgagcagcgccctgaacacccacgagctgagcagcatcctgcccatcaagtgccccaaggacgaggacctgctggagcagaagcccgtgaccagcgccgagcaggagagcgagaagaaccacctgaccaccgccagcaactacaacaagagcgagagccaggagagcctggtgaccagccccagcaagcccaagagccccggcgtggagaagcccatcgtgaagcccaccgccggcgccggcccccaggagaccaacatgaaggagcccctggccaccctggtggaccagagccccgagagcctgaagagaaagagcagcctgacccaggaggaggcccccgtgagctgggagaagagacccagagtgaccgagaacagacagcaccagcagcccttccaggtgagcccccagcccttcctgaacagaggcgacagaatccaggtgagaaaggtgccccccctgaagatccccgtgagcagaatcagccccatgcccttccaccccagccaggtgagccccagagccagattccccgtgagcatcaccagccccaacagaaccggcgccagaaccctggccgacatcaaggccaaggcccagctggtgaaggcccagagagccgccgccgccgccgccgccgccgccgccgccgccgccagcgtgggcggcaccatccccggccccggccccggcggcggccagggccccggcgagggcggcgagggccagaccgccagaggcggcagccccggcagcgacagagtgagcgagaccggcaagggccccaccctggagctggccggcaccggcagcagaggcggcaccagagagctgctgccctgcggccccgagacccagccccagagcgagaccaagaccacccccagccaggcccagccccacagcgtgagcggcgcccagctgcagcagaccccccccgtgccccccacccccgccgtgagcggcgcctgcaccagcgtgcccagccccgcccacatcgagaagctggacaacgagaagctgaaccccaccagagccaccgccaccgtggccagcgtgagccacccccagggccccagcagctgcagacaggagaaggcccccagccccaccggccccgccctgatcagcggcgccagccccgtgcactgcgccgccgacggcaccgtggagctgaaggccggccccagcaagaacatccccaaccccagcgccagcagcaagaccgacgccagcgtgcccgtggccgtgacccccagccccctgaccagcctgctgaccaccgccaccctggagaagctgcccgtgccccaggtgagcgccaccaccgcccccgccggcagcgccccccccagcagcaccctgcccgccgccagcagcctgaagacccccggcaccagcctgaacatgaacggccccaccctgagacccaccagcagcatccccgccaacaaccccctggtgacccagctgctgcagggcaaggacgtgcccatggagcagatcctgcccaagcccctgaccaaggtggagatgaagaccgtgcccctgaccgccaaggaggagagaggcatgggcgccctgatcgccaccaacaccaccgagaacagcaccagagaggaggtgaacgagagacagagccaccccgccacccagcagcagctgggcaagaccctgcagagcaagcagctgccccaggtgcccagacccctgcagctgttcagcgccaaggagctgagagacagcagcatcgacacccaccagtaccacgagggcctgagcaaggccacccaggaccagatcctgcagaccctgatccagagagtgagaagacagaacctgctgagcgtggtgccccccagccagttcaacttcgcccacagcggcttccagctggaggacatcagcaccagccagagattcatgctgggcttcgccggcagaagaaccagcaagcccgccatggccggccactacctgctgaacatcagcacctacggcagaggcagcgagagcttcagaagaacccacagcgtgaaccccgaggacagattctgcctgagcagccccaccgaggccctgaagatgggctacaccgactgcaagaacgccaccggcgagagcagcagcagcaaggaggacgacaccgacgaggagagcaccggcgacgagcaggagagcgtgaccgtgaaggaggagccccaggtgagccagagcgccggcaagggcgacaccagcagcggcccccacagcagagagaccctgagcaccagcgactgcctggccagcaagaacgtgaaggccgagatccccctgaacgagcagaccaccctgagcaaggagaactacctgttcaccagaggccagaccttcgacgagaagaccctggccagagacctgatccaggccgcccagaagcagatggcccacgccgtgagaggcaaggccatcagaagcagccccgagctgttcagcagcaccgtgctgcccctgcccgccgacagccccacccaccagcccctgctgctgccccccctgcagacccccaagctgtacggcagccccacccagatcggccccagctacagaggcatgatcaacgtgagcaccagcagcgacatggaccacaacagcgccgtgcccggcagccaggtgagcagcaacgtgggcgacgtgatgagcttcagcgtgaccgtgaccaccatccccgccagccaggccatgaaccccagcagccacggccagaccatccccgtgcaggccttcagcgaggagaacagcatcgagggcacccccagcaagtgctactgcagactgaaggccatgatcatgtgcaagggctgcggcgccttctgccacgacgactgcatcggccccagcaagctgtgcgtgagctgcctggtggtgagatag

SEQ ID NO: 71978 - DNA, 6747 bp, Artificial Sequence
  Description of Artificial Sequence: Synthetic coding sequence
atgaaggacaagagaaagaagaaggacagaacctgggccgaggccgccagactggccctggagaagcaccccaacagccccatgaccgccaagcagatcctggaggtgatccagaaggagggcctgaaggagaccagcggcaccagccccctggcctgcctgaacgccatgctgcacaccaacaccagaatcggcgacggcaccttcttcaagatccccggcaagagcggcctgtacgccctgaagaaggaggagagcagctgccccgccgacggcaccctggacctggtgtgcgagagcgagctggacggcaccgacatggccgaggccaacgcccacggcgaggagaacggcgtgtgcagcaagcaggtgaccgacgaggccagcagcaccagagacagcagcctgaccaacaccgccgtgcagagcaagctggtgagcagcttccagcagcacaccaagaaggccctgaagcaggccctgagacagcagcagaagagaagaaacggcgtgagcatgatggtgaacaagaccgtgcccagagtggtgctgacccccctgaaggtgagcgacgagcagagcgacagccccagcggcagcgagagcaagaacggcgaggccgacagcagcgacaaggagatgaagcacggccagaagagccccaccggcaagcagaccagccagcacctgaagagactgaagaagagcggcctgggccacctgaagtggaccaaggccgaggacatcgacatcgagacccccggcagcatcctggtgaacaccaacctgagagccctgatcaacaagcacaccttcgccagcctgccccagcacttccagcagtacctgctgctgctgctgcccgaggtggacagacagatgggcagcgacggcatcctgagactgagcaccagcgccctgaacaacgagttcttcgcctacgccgcccagggctggaagcagagactggccgagggcgagttcacccccgagatgcagctgagaatcagacaggagatcgagaaggagaagaagaccgagccctggaaggagaagttcttcgagagattctacggcgagaagctgggcatgagcagagaggagagcgtgaagctgaccaccggccccaacaacgccggcgcccagagcagcagcagctgcggcaccagcggcctgcccgtgagcgcccagaccgccctggccgagcagcagcccaagagcatgaagagccccgccagccccgagcccggcttctgcgccaccctgtgccccatggtggagatcccccccaaggacatcatggccgagctggagagcgaggacatcctgatccccgaggagagcgtgatccaggaggagatcgccgaggaggtggagaccagcatctgcgagtgccaggacgagaaccacaagaccatccccgagttcagcgaggaggccgagagcctgaccaacagccacgaggagccccagatcgccccccccgaggacaacctggagagctgcgtgatgatgaacgacgtgctggagaccctgccccacatcgaggtgaagatcgagggcaagagcgagagcccccaggaggagatgaccgtggtgatcgaccagctggaggtgtgcgacagcctgatccccagcaccagcagcatgacccacgtgagcgacaccgagcacaaggagagcgagaccgccgtggagaccagcacccccaagatcaagaccggcagcagcagcctggagggccagttccccaacgagggcatcgccatcgacatggagctgcagagcgaccccgaggagcagctgagcgagaacgcctgcatcagcgagaccagcttcagcagcgagagccccgagggcgcctgcaccagcctgcccagccccggcggcgagacccagagcaccagcgaggagagctgcacccccgccagcctggagaccaccttctgcagcgaggtgagcagcaccgagaacaccgacaagtacaaccagagaaacagcaccgacgagaacttccacgccagcctgatgagcgagatcagccccatcagcaccagccccgagatcagcgaggccagcctgatgagcaacctgcccctgaccagcgaggccagccccgtgagcaacctgcccctgaccagcgagaccagccccatgagcgacctgcccctgaccagcgagaccagcagcgtgagcagcatgctgctgaccagcgagaccaccttcgtgagcagcctgcccctgcccagcgagaccagccccatcagcaacagcagcatcaacgagagaatggcccaccagcagagaaagagccccagcgtgagcgaggagcccctgagcccccagaaggacgagagcagcgccaccgccaagcccctgggcgagaacctgaccagccagcagaagaacctgagcaacacccccgagcccatcatcatgagcagcagcagcatcgcccccgaggccttccccagcgaggacctgcacaacaagaccctgagccagcagacctgcaagagccacgtggacaccgagaagccctaccccgccagcatccccgagctggccagcaccgagatgatcaaggtgaagaaccacagcgtgctgcagagaaccgagaagaaggtgctgcccagccccctggagctgagcgtgttcagcgagggcaccgacaacaagggcaacgagctgcccagcgccaagctgcaggacaagcagtacatcagcagcgtggacaaggcccccttcagcgagggcagcagaaacaagacccacaagcagggcagcacccagagcagactggagaccagccacaccagcaagagcagcgagcccagcaagagccccgacggcatcagaaacgagagcagagacagcgagatcagcaagagaaagaccgccgagcagcacagcttcggcatctgcaaggagaagagagccagaatcgaggacgaccagagcaccagaaacatcagcagcagcagcccccccgagaaggagcagccccccagagaggagcccagagtgccccccctgaagatccagctgagcaagatcggcccccccttcatcatcaagagccagcccgtgagcaagcccgagagcagagccagcaccagcaccagcgtgagcggcggcagaaacaccggcgccagaaccctggccgacatcaaggccagagcccagcaggccagagcccagagagaggccgccgccgccgccgccgtggccgccgccgccagcatcgtgagcggcgccatgggcagccccggcgagggcggcaagaccagaaccctggcccacatcaaggagcagaccaaggccaagctgttcgccaagcaccaggccagagcccacctgttccagaccagcaaggagaccagactgcccccccccctgagcagcaaggagggcccccccaacctggaggtgagcagcacccccgagaccaagatggagggcagcaccggcgtgatcatcgtgaaccccaactgcagaagccccagcaacaagagcgcccacctgagagagaccaccaccgtgctgcagcagagcctgaaccccagcaagctgcccgagaccgccaccgacctgagcgtgcacagcagcgacgagaacatccccgtgagccacctgagcgagaagatcgtgagcagcaccagcagcgagaacagcagcgtgcccatgctgttcaacaagaacagcgtgcccgtgagcgtgtgcagcaccgccatcagcggcgccatcaaggagcaccccttcgtgagcagcgtggacaagagcagcgtgctgatgagcgtggacagcgccaacaccaccatcagcgcctgcaacatcagcatgctgaagaccatccagggcaccgacaccccctgcatcgccatcatccccaagtgcatcgagagcacccccatcagcgccaccaccgagggcagcagcatcagcagcagcatggacgacaagcagctgctgatcagcagcagcagcgccagcaacctggtgagcacccagtacaccagcgtgcccacccccagcatcggcaacaacctgcccaacctgagcaccagcagcgtgctgatcccccccatgggcatcaacaacagattccccagcgagaagatcgccatccccggcagcgaggagcaggccaccgtgagcatgggcaccaccgtgagagccgccctgagctgcagcgacagcgtggccgtgaccgacagcctggtggcccaccccaccgtggccatgttcaccggcaacatgctgaccatcaacagctacgacagcccccccaagctgagcgccgagagcctggacaagaacagcggccccagaaacagagccgacaacagcggcaagccccagcagccccccggcggcttcgcccccgccgccatcaacagaagcatcccctgcaaggtgatcgtggaccacagcaccaccctgaccagcagcctgagcctgaccgtgagcgtggagagcagcgaggccagcctggacctgcagggcagacccgtgagaaccgaggccagcgtgcagcccgtggcctgcccccaggtgagcgtgatcagcagacccgagcccgtggccaacgagggcatcgaccacagcagcaccttcatcgccgccagcgccgccaagcaggacagcaagaccctgcccgccacctgcaccagcctgagagagctgcccctggtgcccgacaagctgaacgagcccaccgcccccagccacaacttcgccgagcaggccagaggccccgcccccttcaagagcgaggccgacaccacctgcagcaaccagtacaaccccagcaacagaatctgctggaacgacgacggcatgagaagcaccggccagcccctggtgacccacagcggcagcagcaagcagaaggagtacctggagcagagctgccccaaggccatcaagaccgagcacgccaactacctgaacgtgagcgagctgcaccccagaaacctggtgaccaacgtggccctgcccgtgaagagcgagctgcacgaggccgacaagggcttcagaatggacaccgaggacttccccggccccgagctgcccccccccgccgccgagggcgccagcagcgtgcagcagacccagaacatgaaggccagcaccagcagccccatggaggaggccatcagcctggccaccgacgccctgaagagagtgcccggcgccggcagcagcggctgcagactgagcagcgtggaggccaacaaccccctggtgacccagctgctgcagggcaacctgcccctggagaaggtgctgccccagcccagactgggcgccaagctggagatcaacagactgcccctgcccctgcagaccaccagcgtgggcaagaccgcccccgagagaaacgtggagatcccccccagcagccccaaccccgacggcaagggctacctggccggcaccctggcccccctgcagatgagaaagagagagaaccaccccaagaagagagtggccagaaccgtgggcgagcacacccaggtgaagtgcgagcccggcaagctgctggtggagcccgacgtgaagggcgtgccctgcgtgatcagcagcggcatcagccagctgggccacagccagcccttcaagcaggagtggctgaacaagcacagcatgcagaacagaatcgtgcacagccccgaggtgaagcagcagaagagactgctgcccagctgcagcttccagcagaacctgttccacgtggacaagaacggcggcttccacaccgacgccggcaccagccacagacagcagttctaccagatgcccgtggccgccagaggccccatccccaccgccgccctgctgcaggccagcagcaagacccccgtgggctgcaacgccttcgccttcaacagacacctggagcagaagggcctgggcgaggtgagcctgagcagcgccccccaccagctgagactggccaacatgctgagccccaacatgcccatgaaggagggcgacgaggtgggcggcaccgcccacaccatgcccaacaaggccctggtgcacccccccccccccccccccccccccccccccccccccctggccctgcccccccccccccccccccccccccccctgcccccccccctgcccaacgccgaggtgcccagcgaccagaagcagccccccgtgaccatggagaccaccaagagactgagctggccccagagcaccggcatctgcagcaacatcaagagcgagcccctgagcttcgaggagggcctgagcagcagctgcgagctgggcatgaagcaggtgagctacgaccagaacgagatgaaggagcagctgaaggccttcgccctgaagagcgccgacttcagcagctacctgctgagcgagccccagaagcccttcacccagctggccgcccagaagatgcaggtgcagcagcagcagcagctgtgcggcaactaccccaccatccacttcggcagcaccagcttcaagagagccgccagcgccatcgagaagagcatcggcatcctgggcagcggcagcaaccccgccaccggcctgagcggccagaacgcccagatgcccgtgcagaacttcgccgacagcagcaacgccgacgagctggagctgaagtgcagctgcagactgaaggccatgatcgtgtgcaagggctgcggcgccttctgccacgacgactgcatcggccccagcaagctgtgcgtggcctgcctggtggtgagatag

SEQ ID NO: 71979 - DNA, 2307 bp, Artificial Sequence
  Description of Artificial Sequence: Synthetic coding sequence
atgaacggcgacagcagagccgccgtggtgaccagccccccccccaccaccgccccccacaaggagagatacttcgacagagtggacgagaacaaccccgagtacctgagagagagaaacatggcccccgacctgagacaggacttcaacatgatggagcagaagaagagagtgagcatgatcctgcagagccccgccttctgcgaggagctggagagcatgatccaggagcagttcaagaagggcaagaaccccaccggcctgctggccctgcagcagatcgccgacttcatgaccaccaacgtgcccaacgtgtaccccgccgccccccagggcggcatggccgccctgaacatgagcctgggcatggtgacccccgtgaacgacctgagaggcagcgacagcatcgcctacgacaagggcgagaagctgctgagatgcaagctggccgccttctacagactggccgacctgttcggctggagccagctgatctacaaccacatcaccaccagagtgaacagcgagcaggagcacttcctgatcgtgcccttcggcctgctgtacagcgaggtgaccgccagcagcctggtgaagatcaacctgcagggcgacatcgtggacagaggcagcaccaacctgggcgtgaaccaggccggcttcaccctgcacagcgccatctacgccgccagacccgacgtgaagtgcgtggtgcacatccacacccccgccggcgccgccgtgagcgccatgaagtgcggcctgctgcccatcagccccgaggccctgagcctgggcgaggtggcctaccacgactaccacggcatcctggtggacgaggaggagaaggtgctgatccagaagaacctgggccccaagagcaaggtgctgatcctgagaaaccacggcctggtgagcgtgggcgagagcgtggaggaggccttctactacatccacaacctggtggtggcctgcgagatccaggtgagaaccctggccagcgccggcggccccgacaacctggtgctgctgaaccccgagaagtacaaggccaagagcagaagccccggcagccccgtgggcgagggcaccggcagcccccccaagtggcagatcggcgagcaggagttcgaggccctgatgagaatgctggacaacctgggctacagaaccggctacccctacagataccccgccctgagagagaagagcaagaagtacagcgacgtggaggtgcccgccagcgtgaccggctacagcttcgccagcgacggcgacagcggcacctgcagccccctgagacacagcttccagaagcagcagagagagaagaccagatggctgaacagcggcagaggcgacgaggccagcgaggagggccagaacggcagcagccccaagagcaagaccaaggtgtggaccaacatcacccacgaccacgtgaagcccctgctgcagagcctgagcagcggcgtgtgcgtgcccagctgcatcaccaactgcctgtggaccaaggaggacggccacagaaccagcaccagcgccgtgcccaacctgttcgtgcccctgaacaccaaccccaaggaggtgcaggagatgagaaacaagatcagagagcagaacctgcaggacatcaagaccgccggcccccagagccaggtgctgtgcggcgtggtgatggacagaagcctggtgcagggcgagctggtgaccgccagcaaggccatcatcgagaaggagtaccagccccacgtgatcgtgagcaccaccggccccaaccccttcaccaccctgaccgacagagagctggaggagtacagaagagaggtggagagaaagcagaagggcagcgaggagaacctggacgaggccagagagcagaaggagaagagcccccccgaccagcccgccgtgccccaccccccccccagcacccccatcaagctggaggaggacctggtgcccgagcccaccaccggcgacgacagcgacgccgccaccttcaagcccaccctgcccgacctgagccccgacgagcccagcgaggccctgggcttccccatgctggagaaggaggaggaggcccacagaccccccagccccaccgaggcccccaccgaggccagccccgagcccgcccccgaccccgcccccgtggccgaggaggccgcccccagcgccgtggaggagggcgccgccgccgaccccggcagcgacggcagccccggcaagagccccagcaagaagaagaagaagttcagaacccccagcttcctgaagaagagcaagaagaagagcgacagctag

SEQ ID NO: 71980 - DNA, 1989 bp, Artificial Sequence
  Description of Artificial Sequence: Synthetic coding sequence
atgaacggcgacagcagagccgccgtggtgaccagccccccccccaccaccgccccccacaaggagagatacttcgacagagtggacgagaacaaccccgagtacctgagagagagaaacatggcccccgacctgagacaggacttcaacatgatggagcagaagaagagagtgagcatgatcctgcagagccccgccttctgcgaggagctggagagcatgatccaggagcagttcaagaagggcaagaaccccaccggcctgctggccctgcagcagatcgccgacttcatgaccaccaacgtgcccaacgtgtaccccgccgccccccagggcggcatggccgccctgaacatgagcctgggcatggtgacccccgtgaacgacctgagaggcagcgacagcatcgcctacgacaagggcgagaagctgctgagatgcaagctggccgccttctacagactggccgacctgttcggctggagccagctgatctacaaccacatcaccaccagagtgaacagcgagcaggagcacttcctgatcgtgcccttcggcctgctgtacagcgaggtgaccgccagcagcctggtgaagatcaacctgcagggcgacatcgtggacagaggcagcaccaacctgggcgtgaaccaggccggcttcaccctgcacagcgccatctacgccgccagacccgacgtgaagtgcgtggtgcacatccacacccccgccggcgccgccgtgagcgccatgaagtgcggcctgctgcccatcagccccgaggccctgagcctgggcgaggtggcctaccacgactaccacggcatcctggtggacgaggaggagaaggtgctgatccagaagaacctgggccccaagagcaaggtgctgatcctgagaaaccacggcctggtgagcgtgggcgagagcgtggaggaggccttctactacatccacaacctggtggtggcctgcgagatccaggtgagaaccctggccagcgccggcggccccgacaacctggtgctgctgaaccccgagaagtacaaggccaagagcagaagccccggcagccccgtgggcgagggcaccggcagcccccccaagtggcagatcggcgagcaggagttcgaggccctgatgagaatgctggacaacctgggctacagaaccggctacccctacagataccccgccctgagagagaagagcaagaagtacagcgacgtggaggtgcccgccagcgtgaccggctacagcttcgccagcgacggcgacagcggcacctgcagccccctgagacacagcttccagaagcagcagagagagaagaccagatggctgaacagcggcagaggcgacgaggccagcgaggagggccagaacggcagcagccccaagagcaagaccaagtggaccaaggaggacggccacagaaccagcaccagcgccgtgcccaacctgttcgtgcccctgaacaccaaccccaaggaggtgcaggagatgagaaacaagatcagagagcagaacctgcaggacatcaagaccgccggcccccagagccaggtgctgtgcggcgtggtgatggacagaagcctggtgcaggacgcccccctgagcgactgcaccgagaccatcgagggcctggagctgaccgagcagaccttcagccccgccaagagcctgagcttcagaaagggcgagctggtgaccgccagcaaggccatcatcgagaaggagtaccagccccacgtgatcgtgagcaccaccggccccaaccccttcaccaccctgaccgacagagagctggaggagtacagaagagaggtggagagaaagcagaagggcagcgaggagaacctggacgaggccagagagcagaaggagaagagcccccccgaccagcccgccgtgccccaccccccccccagcacccccatcaagctggaggagggcgacggctgcgccagagagtacctgctgccctag

SEQ ID NO: 71981 - DNA, 1989 bp, Artificial Sequence
  Description of Artificial Sequence: Synthetic coding sequence
atgaacggcgacagcagagccgccgtggtgaccagccccccccccaccaccgccccccacaaggagagatacttcgacagagtggacgagaacaaccccgagtacctgagagagagaaacatggcccccgacctgagacaggacttcaacatgatggagcagaagaagagagtgagcatgatcctgcagagccccgccttctgcgaggagctggagagcatgatccaggagcagttcaagaagggcaagaaccccaccggcctgctggccctgcagcagatcgccgacttcatgaccaccaacgtgcccaacgtgtaccccgccgccccccagggcggcatggccgccctgaacatgagcctgggcatggtgacccccgtgaacgacctgagaggcagcgacagcatcgcctacgacaagggcgagaagctgctgagatgcaagctggccgccttctacagactggccgacctgttcggctggagccagctgatctacaaccacatcaccaccagagtgaacagcgagcaggagcacttcctgatcgtgcccttcggcctgctgtacagcgaggtgaccgccagcagcctggtgaagatcaacctgcagggcgacatcgtggacagaggcagcaccaacctgggcgtgaaccaggccggcttcaccctgcacagcgccatctacgccgccagacccgacgtgaagtgcgtggtgcacatccacacccccgccggcgccgccgtgagcgccatgaagtgcggcctgctgcccatcagccccgaggccctgagcctgggcgaggtggcctaccacgactaccacggcatcctggtggacgaggaggagaaggtgctgatccagaagaacctgggccccaagagcaaggtgctgatcctgagaaaccacggcctggtgagcgtgggcgagagcgtggaggaggccttctactacatccacaacctggtggtggcctgcgagatccaggtgagaaccctggccagcgccggcggccccgacaacctggtgctgctgaaccccgagaagtacaaggccaagagcagaagccccggcagccccgtgggcgagggcaccggcagcccccccaagtggcagatcggcgagcaggagttcgaggccctgatgagaatgctggacaacctgggctacagaaccggctacccctacagataccccgccctgagagagaagagcaagaagtacagcgacgtggaggtgcccgccagcgtgaccggctacagcttcgccagcgacggcgacagcggcacctgcagccccctgagacacagcttccagaagcagcagagagagaagaccagatggctgaacagcggcagaggcgacgaggccagcgaggagggccagaacggcagcagccccaagagcaagaccaaggtgtggaccaacatcacccacgaccacgtgaagcccctgctgcagagcctgagcagcggcgtgtgcgtgcccagctgcatcaccaactgcctgtggaccaaggaggacggccacagaaccagcaccagcgccgtgcccaacctgttcgtgcccctgaacaccaaccccaaggaggtgcaggagatgagaaacaagatcagagagcagaacctgcaggacatcaagaccgccggcccccagagccaggtgctgtgcggcgtggtgatggacagaagcctggtgcagggcgagctggtgaccgccagcaaggccatcatcgagaaggagtaccagccccacgtgatcgtgagcaccaccggccccaaccccttcaccaccctgaccgacagagagctggaggagtacagaagagaggtggagagaaagcagaagggcagcgaggagaacctggacgaggccagagagcagaaggagaagagcccccccgaccagcccgccgtgccccaccccccccccagcacccccatcaagctggaggagggcgacggctgcgccagagagtacctgctgccctag

SEQ ID NO: 71982 - DNA, 1203 bp, Artificial Sequence
  Description of Artificial Sequence: Synthetic coding sequence
atgaacggcgacagcagagccgccgtggtgaccagccccccccccaccaccgccccccacaaggagagatacttcgacagagtggacgagaacaaccccgagtacctgagagagagaaacatggcccccgacctgagacaggacttcaacatgatggagcagaagaagagagtgagcatgatcctgcagagccccgccttctgcgaggagctggagagcatgatccaggagcagttcaagaagggcaagaaccccaccggcctgctggccctgcagcagatcgccgacttcatgaccaccaacgtgcccaacgtgtaccccgccgccccccagggcggcatggccgccctgaacatgagcctgggcatggtgacccccgtgaacgacctgagaggcagcgacagcatcgcctacgacaagggcgagaagctgctgagatgcaagctggccgccttctacagactggccgacctgttcggctggagccagctgatctacaaccacatcaccaccagagtgaacagcgagcaggagcacttcctgatcgtgcccttcggcctgctgtacagcgaggtgaccgccagcagcctggtgaagatcaacctgcagggcgacatcgtggacagaggcagcaccaacctgggcgtgaaccaggccggcttcaccctgcacagcgccatctacgccgccagacccgacgtgaagtgcgtggtgcacatccacacccccgccggcgccgccgtgagcgccatgaagtgcggcctgctgcccatcagccccgaggccctgagcctgggcgaggtggcctaccacgactaccacggcatcctggtggacgaggaggagaaggtgctgatccagaagaacctgggccccaagagcaaggtgctgatcctgagaaaccacggcctggtgagcgtgggcgagagcgtggaggaggccttctactacatccacaacctggtggtggcctgcgagatccaggtgagaaccctggccagcgccggcggccccgacaacctggtgctgctgaaccccgagaagtacaaggccaagagcagaagccccggcagccccgtgggcgagggcaccggcagcccccccaagtggcagatcggcgagcaggagttcgaggccctgatgagaatgctggacaacctgggctacagaaccagcagcagcggcagaagacaggacggctag

SEQ ID NO: 71983 - DNA, 1989 bp, Artificial Sequence; identical to SEQ ID NO: 71981
  Description of Artificial Sequence: Synthetic coding sequence

SEQ ID NO: 71984 - DNA, 2214 bp, Artificial Sequence
  Description of Artificial Sequence: Synthetic coding sequence
atgaacggcgacagcagagccgccgtggtgaccagccccccccccaccaccgccccccacaaggagagatacttcgacagagtggacgagaacaaccccgagtacctgagagagagaaacatggcccccgacctgagacaggacttcaacatgatggagcagaagaagagagtgagcatgatcctgcagagccccgccttctgcgaggagctggagagcatgatccaggagcagttcaagaagggcaagaaccccaccggcctgctggccctgcagcagatcgccgacttcatgaccaccaacgtgcccaacgtgtaccccgccgccccccagggcggcatggccgccctgaacatgagcctgggcatggtgacccccgtgaacgacctgagaggcagcgacagcatcgcctacgacaagggcgagaagctgctgagatgcaagctggccgccttctacagactggccgacctgttcggctggagccagctgatctacaaccacatcaccaccagagtgaacagcgagcaggagcacttcctgatcgtgcccttcggcctgctgtacagcgaggtgaccgccagcagcctggtgaagatcaacctgcagggcgacatcgtggacagaggcagcaccaacctgggcgtgaaccaggccggcttcaccctgcacagcgccatctacgccgccagacccgacgtgaagtgcgtggtgcacatccacacccccgccggcgccgccgtgagcgccatgaagtgcggcctgctgcccatcagccccgaggccctgagcctgggcgaggtggcctaccacgactaccacggcatcctggtggacgaggaggagaaggtgctgatccagaagaacctgggccccaagagcaaggtgctgatcctgagaaaccacggcctggtgagcgtgggcgagagcgtggaggaggccttctactacatccacaacctggtggtggcctgcgagatccaggtgagaaccctggccagcgccggcggccccgacaacctggtgctgctgaaccccgagaagtacaaggccaagagcagaagccccggcagccccgtgggcgagggcaccggcagcccccccaagtggcagatcggcgagcaggagttcgaggccctgatgagaatgctggacaacctgggctacagaaccggctacccctacagataccccgccctgagagagaagagcaagaagtacagcgacgtggaggtgcccgccagcgtgaccggctacagcttcgccagcgacggcgacagcggcacctgcagccccctgagacacagcttccagaagcagcagagagagaagaccagatggctgaacagcggcagaggcgacgaggccagcgaggagggccagaacggcagcagccccaagagcaagaccaagtggaccaaggaggacggccacagaaccagcaccagcgccgtgcccaacctgttcgtgcccctgaacaccaaccccaaggaggtgcaggagatgagaaacaagatcagagagcagaacctgcaggacatcaagaccgccggcccccagagccaggtgctgtgcggcgtggtgatggacagaagcctggtgcagggcgagctggtgaccgccagcaaggccatcatcgagaaggagtaccagccccacgtgatcgtgagcaccaccggccccaaccccttcaccaccctgaccgacagagagctggaggagtacagaagagaggtggagagaaagcagaagggcagcgaggagaacctggacgaggccagagagcagaaggagaagagcccccccgaccagcccgccgtgccccaccccccccccagcacccccatcaagctggaggaggacctggtgcccgagcccaccaccggcgacgacagcgacgccgccaccttcaagcccaccctgcccgacctgagccccgacgagcccagcgaggccctgggcttccccatgctggagaaggaggaggaggcccacagaccccccagccccaccgaggcccccaccgaggccagccccgagcccgcccccgaccccgcccccgtggccgaggaggccgcccccagcgccgtggaggagggcgccgccgccgaccccggcagcgacggcagccccggcaagagccccagcaagaagaagaagaagttcagaacccccagcttcctgaagaagagcaagaagaagagcgacagctag

SEQ ID NO: 71985 - DNA, 2214 bp, Artificial Sequence; identical to SEQ ID NO: 71984
  Description of Artificial Sequence: Synthetic coding sequence

SEQ ID NO: 71986 - DNA, 414 bp, Artificial Sequence
  Description of Artificial Sequence: Synthetic coding sequence
atgaacggcgacagcagagccgccgtggtgaccagccccccccccaccaccgccccccacaaggagagatacttcgacagagtggacgagaacaaccccgagtacctgagagagagaaacatggcccccgacctgagacaggacttcaacatgatggagcagaagaagagagtgagcatgatcctgcagagccccgccttctgcgaggagctggagagcatgatccaggagcagttcaagaagggcaagaaccccaccggcctgctggccctgcagcagatcgccgacttcatgaccaccaacgtgcccaacgtgtaccccgccgccccccagggcggcatggccgccctgaacatgagcctgggcatggtgacccccgtgaacgacctgagaggcagcgacagcatcgcctag

SEQ ID NO: 71987 - DNA, 1899 bp, Artificial Sequence
  Description of Artificial Sequence: Synthetic coding sequence
atgaacggcgacagcagagccgccgtggtgaccagccccccccccaccaccgccccccacaaggagagatacttcgacagagtggacgagaacaaccccgagtacctgagagagagaaacatggcccccgacctgagacaggacttcaacatgatggagcagaagaagagagtgagcatgatcctgcagagccccgccttctgcgaggagctggagagcatgatccaggagcagttcaagaagggcaagaaccccaccggcctgctggccctgcagcagatcgccgacttcatgaccaccaacgtgcccaacgtgtaccccgccgccccccagggcggcatggccgccctgaacatgagcctgggcatggtgacccccgtgaacgacctgagaggcagcgacagcatcgcctacgacaagggcgagaagctgctgagatgcaagctggccgccttctacagactggccgacctgttcggctggagccagctgatctacaaccacatcaccaccagagtgaacagcgagcaggagcacttcctgatcgtgcccttcggcctgctgtacagcgaggtgaccgccagcagcctggtgaagatcaacctgcagggcgacatcgtggacagaggcagcaccaacctgggcgtgaaccaggccggcttcaccctgcacagcgccatctacgccgccagacccgacgtgaagtgcgtggtgcacatccacacccccgccggcgccgccgtgagcgccatgaagtgcggcctgctgcccatcagccccgaggccctgagcctgggcgaggtggcctaccacgactaccacggcatcctggtggacgaggaggagaaggtgctgatccagaagaacctgggccccaagagcaaggtgctgatcctgagaaaccacggcctggtgagcgtgggcgagagcgtggaggaggccttctactacatccacaacctggtggtggcctgcgagatccaggtgagaaccctggccagcgccggcggccccgacaacctggtgctgctgaaccccgagaagtacaaggccaagagcagaagccccggcagccccgtgggcgagggcaccggcagcccccccaagtggcagatcggcgagcaggagttcgaggccctgatgagaatgctggacaacctgggctacagaaccggctacccctacagataccccgccctgagagagaagagcaagaagtacagcgacgtggaggtgcccgccagcgtgaccggctacagcttcgccagcgacggcgacagcggcacctgcagccccctgagacacagcttccagaagcagcagagagagaagaccagatggctgaacagcggcagaggcgacgaggccagcgaggagggccagaacggcagcagccccaagagcaagaccaagtggaccaaggaggacggccacagaaccagcaccagcgccgtgcccaacctgttcgtgcccctgaacaccaaccccaaggaggtgcaggagatgagaaacaagatcagagagcagaacctgcaggacatcaagaccgccggcccccagagccaggtgctgtgcggcgtggtgatggacagaagcctggtgcagggcgagctggtgaccgccagcaaggccatcatcgagaaggagtaccagccccacgtgatcgtgagcaccaccggccccaaccccttcaccaccctgaccgacagagagctggaggagtacagaagagaggtggagagaaagcagaagggcagcgaggagaacctggacgaggccagagagcagaaggagaagagcccccccgaccagcccgccgtgccccaccccccccccagcacccccatcaagctggaggaggccggcgacggctgcgccagagagtacctgctgccctag

SEQ ID NO: 71988 - DNA, 1335 bp, Artificial Sequence
  Description of Artificial Sequence: Synthetic coding sequence
tgagtgctgatcctgagaaaccacggcctggtgagcgtgggcgagagcgtggaggaggccttctactacatccacaacctggtggtggcctgcgagatccaggtgagaaccctggccagcgccggcggccccgacaacctggtgctgctgaaccccgagaagtacaaggccaagagcagaagccccggcagccccgtgggcgagggcaccggcagcccccccaagtggcagatcggcgagcaggagttcgaggccctgatgagaatgctggacaacctgggctacagaaccggctacccctacagataccccgccctgagagagaagagcaagaagtacagcgacgtggaggtgcccgccagcgtgaccggctacagcttcgccagcgacggcgacagcggcacctgcagccccctgagacacagcttccagaagcagcagagagagaagaccagatggctgaacagcggcagaggcgacgaggccagcgaggagggccagaacggcagcagccccaagagcaagaccaaggtgtggaccaacatcacccacgaccacgtgaagcccctgctgcagagcctgagcagcggcgtgtgcgtgcccagctgcatcaccaactgcctgtggaccaaggaggacggccacagaaccagcaccagcgccgtgcccaacctgttcgtgcccctgaacaccaaccccaaggaggtgcaggagatgagaaacaagatcagagagcagaacctgcaggacatcaagaccgccggcccccagagccaggtgctgtgcggcgtggtgatggacagaagcctggtgcagggcgagctggtgaccgccagcaaggccatcatcgagaaggagtaccagccccacgtgatcgtgagcaccaccggccccaaccccttcaccaccctgaccgacagagagctggaggagtacagaagagaggtggagagaaagcagaagggcagcgaggagaacctggacgaggccagagagcagaaggagaagagcccccccgaccagcccgccgtgccccaccccccccccagcacccccatcaagctggaggaggacctggtgcccgagcccaccaccggcgacgacagcgacgccgccaccttcaagcccaccctgcccgacctgagccccgacgagcccagcgaggccctgggcttccccatgctggagaaggaggaggaggcccacagaccccccagccccaccgaggcccccaccgaggccagccccgagcccgcccccgaccccgcccccgtggccgaggaggccgcccccagcgccgtggaggagggcgccgccgccgaccccggcagctag

SEQ ID NO: 71989 - DNA, 2181 bp, Artificial Sequence
  Description of Artificial Sequence: Synthetic coding sequence
atgagcgaggagaccgtgcccgaggccgccagccccccccccccccagggccagccctacttcgacagattcagcgaggacgaccccgagtacatgagactgagaaacagagccgccgacctgagacaggacttcaacctgatggagcagaagaagagagtgaccatgatcctgcagagccccagcttcagagaggagctggagggcctgatccaggagcagatgaagaagggcaacaacagcagcaacatctgggccctgagacagatcgccgacttcatggccagcaccagccacgccgtgttccccaccagcagcatgaacgtgagcatgatgacccccatcaacgacctgcacaccgccgacagcctgaacctggccaagggcgagagactgatgagatgcaagatcagcagcgtgtacagactgctggacctgtacggctgggcccagctgagcgacacctacgtgaccctgagagtgagcaaggagcaggaccacttcctgatcagccccaagggcgtgagctgcagcgaggtgaccgccagcagcctgatcaaggtgaacatcctgggcgaggtggtggagaagggcagcagctgcttccccgtggacaccaccggcttctgcctgcacagcgccatctacgccgccagacccgacgtgagatgcatcatccacctgcacacccccgccaccgccgccgtgagcgccatgaagtggggcctgctgcccgtgagccacaacgccctgctggtgggcgacatggcctactacgacttcaacggcgagatggagcaggaggccgacagaatcaacctgcagaagtgcctgggccccacctgcaagatcctggtgctgagaaaccacggcgtggtggccctgggcgacaccgtggaggaggccttctacaagatcttccacctgcaggccgcctgcgagatccaggtgagcgccctgagcagcgccggcggcgtggagaacctgatcctgctggagcaggagaagcacagaccccacgaggtgggcagcgtgcagtgggccggcagcaccttcggccccatgcagaagagcagactgggcgagcacgagttcgaggccctgatgagaatgctggacaacctgggctacagaaccggctacacctacagacaccccttcgtgcaggagaagaccaagcacaagagcgaggtggagatccccgccaccgtgaccgccttcgtgttcgaggaggacggcgcccccgtgcccgccctgagacagcacgcccagaagcagcagaaggagaagaccagatggctgaacacccccaacacctacctgagagtgaacgtggccgacgaggtgcagagaagcatgggcagccccagacccaagaccacctggatgaaggccgacgaggtggagaagagcagcagcggcatgcccatcagaatcgagaaccccaaccagttcgtgcccctgtacaccgacccccaggaggtgctggagatgagaaacaagatcagagagcagaacagacaggacgtgaagagcgccggcccccagagccagctgctggccagcgtgatcgccgagaagagcagaagccccagcaccgagagccagctgatgagcaagggcgacgaggacaccaaggacgacagcgaggagaccgtgcccaaccccttcagccagctgaccgaccaggagctggaggagtacaagaaggaggtggagagaaagaagctggagctggacggcgagaaggagaccgcccccgaggagcccggcagccccgccaagagcgcccccgccagccccgtgcagagccccgccaaggaggccgagaccaagagccccctggtgagccccagcaagagcctggaggagggcaccaagaagaccgagaccagcaaggccgccaccaccgagcccgagaccacccagcccgagggcgtggtggtgaacggcagagaggaggagcagaccgccgaggagatcctgagcaagggcctgagccagatgaccaccagcgccgacaccgacgtggacaccagcaaggacaagaccgagagcgtgaccagcggccccatgagccccgagggcagccccagcaagagccccagcaagaagaagaagaagttcagaacccccagcttcctgaagaagagcaagaagaaggagaaggtggagagctag

SEQ ID NO: 71990 - DNA, 297 bp, Artificial Sequence
  Description of Artificial Sequence: Synthetic coding sequence
atgagcgaggagaccgtgcccgaggccgccagccccccccccccccagggccagccctacttcgacagattcagcgaggacgaccccgagtacatgagactgagaaacagagccgccgacctgagacaggacttcaacctgatggagcagaagaagagagtgaccatgatcctgcagagccccagcttcagagaggagctggagggcctgatccaggagcagatgaagaaggagtacaagaaggaggtggagagaaagaagctggagctggacgcccccggctggttcagcagctag

SEQ ID NO: 71991 - DNA, 1764 bp, Artificial Sequence
  Description of Artificial Sequence: Synthetic coding sequence
atgagcgaggagaccgtgcccgaggccgccagccccccccccccccagggccagccctacttcgacagattcagcgaggacgaccccgagtacatgagactgagaaacagagccgccgacctgagacaggacttcaacctgatggagcagaagaagagagtgaccatgatcctgcagagccccagcttcagagaggagctggagggcctgatccaggagcagatgaagaagggcaacaacagcagcaacatctgggccctgagacagatcgccgacttcatggccagcaccagccacgccgtgttccccaccagcagcatgaacgtgagcatgatgacccccatcaacgacctgcacaccgccgacagcctgaacctggccaagggcgagagactgatgagatgcaagatcagcagcgtgtacagactgctggacctgtacggctgggcccagctgagcgacacctacgtgaccctgagagtgagcaaggagcaggaccacttcctgatcagccccaagggcgtgagctgcagcgaggtgaccgccagcagcctgatcaaggtgaacatcctgggcgaggtggtggagaagggcagcagctgcttccccgtggacaccaccggcttctgcctgcacagcgccatctacgccgccagacccgacgtgagatgcatcatccacctgcacacccccgccaccgccgccgtgagcgccatgaagtggggcctgctgcccgtgagccacaacgccctgctggtgggcgacatggcctactacgacttcaacggcgagatggagcaggaggccgacagaatcaacctgcagaagtgcctgggccccacctgcaagatcctggtgctgagaaaccacggcgtggtggccctgggcgacaccgtggaggaggccttctacaagatcttccacctgcaggccgcctgcgagatccaggtgagcgccctgagcagcgccggcggcgtggagaacctgatcctgctggagcaggagaagcacagaccccacgaggtgggcagcgtgcagtgggccggcagcaccttcggccccatgcagaagagcagactgggcgagcacgagttcgaggccctgatgagaatgctggacaacctgggctacagaaccggctacacctacagacaccccttcgtgcaggagaagaccaagcacaagagcgaggtggagatccccgccaccgtgaccgccttcgtgttcgaggaggacggcgcccccgtgcccgccctgagacagcacgcccagaagcagcagaaggagaagaccagatggctgaacacccccaacacctacctgagagtgaacgtggccgacgaggtgcagagaagcatgggcagccccagacccaagaccacctggatgaaggccgacgaggtggagaagagcagcagcggcatgcccatcagaatcgagaaccccaaccagttcgtgcccctgtacaccgacccccaggaggtgctggagatgagaaacaagatcagagagcagaacagacaggacgtgaagagcgccggcccccagagccagctgctggccagcgtgatcgccgagaagagcagaagccccagcaccgagagccagctgatgagcaagggcgacgaggacaccaaggacgacagcgaggagaccgtgcccaaccccttcagccagctgaccgaccaggagctggaggagtacaagaaggaggtggagagaaagaagctggagctggacgcccccggctggttcagcagctag

SEQ ID NO: 71992 - DNA, 2181 bp, Artificial Sequence; identical to SEQ ID NO: 71989
  Description of Artificial Sequence: Synthetic coding sequence

SEQ ID NO: 71993 - DNA, 2181 bp, Artificial Sequence; identical to SEQ ID NO: 71989
  Description of Artificial Sequence: Synthetic coding sequence

SEQ ID NO: 71994 - DNA, 1680 bp, Artificial Sequence
  Description of Artificial Sequence: Synthetic coding sequence
atgagcgaggagaccgtgcccgaggccgccagccccccccccccccagggccagccctacttcgacagattcagcgaggacgaccccgagtacatgagactgagaaacagagccgccgacctgagacaggacttcaacctgatggagcagaagaagagagtgaccatgatcctgcagagccccagcttcagagaggagctggagggcctgatccaggagcagatgaagaagggcaacaacagcagcaacatctgggccctgagacagatcgccgacttcatggccagcaccagccacgccgtgttccccaccagcagcatgaacgtgagcatgatgacccccatcaacgacctgcacaccgccgacagcctgaacctggccaagggcgagagactgatgagatgcaagatcagcagcgtgtacagactgctggacctgtacggctgggcccagctgagcgacacctacgtgaccctgagagtgagcaaggagcaggaccacttcctgatcagccccaagggcgtgagctgcagcgaggtgaccgccagcagcctgatcaaggtgaacatcctgggcgaggtggtggagaagggcagcagctgcttccccgtggacaccaccggcttctgcctgcacagcgccatctacgccgccagacccgacgtgagatgcatcatccacctgcacacccccgccaccgccgccgtgagcgccatgaagtggggcctgctgcccgtgagccacaacgccctgctggtgggcgacatggcctactacgacttcaacggcgagatggagcaggaggccgacagaatcaacctgcagaagtgcctgggccccacctgcaagatcctggtgctgagaaaccacggcgtggtggccctgggcgacaccgtggaggaggccttctacaagatcttccacctgcaggccgcctgcgagatccaggtgagcgccctgagcagcgccggcggcgtggagaacctgatcctgctggagcaggagaagcacagaccccacgaggtgggcagcgtgcagtgggccggcagcaccttcggccccatgcagaagagcagactgggcgagcacgagttcgaggccctgatgagaatgctggacaacctgggctacagaaccggctacacctacagacaccccttcgtgcaggagaagaccaagcacaagagcgaggtggagatccccgccaccgtgaccgccttcgtgttcgaggaggacggcgcccccgtgcccgccctgagacagcacgcccagaagcagcagaaggagaagaccagatggctgaacacccccaacacctacctgagagtgaacgtggccgacgaggtgcagagaagcatgggcagccccagacccaagaccacctggatgaaggccgacgaggtggagaagagcagcagcggcatgcccatcagaatcgagaaccccaaccagttcgtgcccctgtacaccgacccccaggaggtgctggagatgagaaacaagatcagagagcagaacagacaggacgtgaagagcgccggcccccagagccagctgctggccagcgtgatcgccgagaagagcagaagccccgtggagcagagactgcccctgaccggcggcgagacctgcctgcccagcggcagcagcgtgcccggcgccggcctgcaggacccctag

SEQ ID NO: 71995 - DNA, 681 bp, Artificial Sequence
  Description of Artificial Sequence: Synthetic coding sequence
atgagcgaggagaccgtgcccgaggccgccagccccccccccccccagggccagccctacttcgacagattcagcgaggacgaccccgagtacatgagactgagaaacagagccgccgacctgagacaggacttcaacctgatggagcagaagaagagagtgaccatgatcctgcagagccccagcttcagagaggagctggagggcctgatccaggagcagatgaagaagggcaacaacagcagcaacatctgggccctgagacagatcgccgacttcatggccagcaccagccacgccgtgttccccaccagcagcatgaacgtgagcatgatgacccccatcaacgacctgcacaccgccgacagcctgaacctggccaagggcgagagactgatgagatgcaagatcagcagcgtgtacagactgctggacctgtacggctgggcccagctgagcgacacctacgtgaccctgagagtgagcaaggagcaggaccacttcctgatcagccccaagggcgtgagctgcagcgaggtgaccgccagcagcctgatcaaggtgaacatcctgggcgaggtggtggagaagggcagcagctgcttccccgtggacaccaccggcttctgcctgcacagcgccatctacgccgccagacccgacgtgagatgcatcatctag

SEQ ID NO: 71996 - DNA, 432 bp, Artificial Sequence
  Description of Artificial Sequence: Synthetic coding sequence
atgagcgaggagaccgtgcccgaggccgccagccccccccccccccagggccagccctacttcgacagattcagcgaggacgaccccgagtacatgagactgagaaacagagccgccgacctgagacaggacttcaacctgatggagcagaagaagagagtgaccatgatcctgcagagccccagcttcagagaggagctggagggcctgatccaggagcagatgaagaagggcaacaacagcagcaacatctgggccctgagacagatcgccgacttcatggccagcaccagccacgccgtgttccccaccagcagcatgaacgtgagcatgatgacccccatcaacgacctgcacaccgccgacagcctgaacctggccaagggcgagagactgatgagatgcaagatcagcagcgtgtacagactgtag

SEQ ID NO: 71997 - DNA, 1728 bp, Artificial Sequence
  Description of Artificial Sequence: Synthetic coding sequence
atgcccagaagaagagtgcccggcgccaactgcaagcccaccggcaagatgagcgaggagaccgtgcccgaggccgccagccccccccccccccagggccagccctacttcgacagattcagcgaggacgaccccgagtacatgagactgagaaacagagccgccgacctgagacaggacttcaacctgatggagcagaagaagagagtgaccatgatcctgcagagccccagcttcagagaggagctggagggcctgatccaggagcagatgaagaagggcaacaacagcagcaacatctgggccctgagacagatcgccgacttcatggccagcaccagccacgccgtgttccccaccagcagcatgaacgtgagcatgatgacccccatcaacgacctgcacaccgccgacagcctgaacctggccaagggcgagagactgatgagatgcaagatcagcagcgtgtacagactgctggacctgtacggctgggcccagctgagcgacacctacgtgaccctgagagtgagcaaggagcaggaccacttcctgatcagccccaagggcgtgagctgcagcgaggtgaccgccagcagcctgatcaaggtgaacatcctgggcgaggtggtggagaagggcagcagctgcttccccgtggacaccaccggcttctgcctgcacagcgccatctacgccgccagacccgacgtgagatgcatcatccacctgcacacccccgccaccgccgccgtgagcgccatgaagtggggcctgctgcccgtgagccacaacgccctgctggtgggcgacatggcctactacgacttcaacggcgagatggagcaggaggccgacagaatcaacctgcagaagtgcctgggccccacctgcaagatcctggtgctgagaaaccacggcgtggtggccctgggcgacaccgtggaggaggccttctacaagatcttccacctgcaggccgcctgcgagatccaggtgagcgccctgagcagcgccggcggcgtggagaacctgatcctgctggagcaggagaagcacagaccccacgaggtgggcagcgtgcagtgggccggcagcaccttcggccccatgcagaagagcagactgggcgagcacgagttcgaggccctgatgagaatgctggacaacctgggctacagaaccggctacacctacagacaccccttcgtgcaggagaagaccaagcacaagagcgaggtggagatccccgccaccgtgaccgccttcgtgttcgaggaggacggcgcccccgtgcccgccctgagacagcacgcccagaagcagcagaaggagaagaccagatggctgaacacccccaacacctacctgagagtgaacgtggccgacgaggtgcagagaagcatgggcagccccagacccaagaccacctggatgaaggccgacgaggtggagaagagcagcagcggcatgcccatcagaatcgagaaccccaaccagttcgtgcccctgtacaccgacccccaggaggtgctggagatgagaaacaagatcagagagcagaacagacaggacgtgaagagcgccggcccccagagccagctgctggccagcgtgatcgccgagaagagcagaagccccgtggagcagagactgcccctgaccggcggcgagacctgcctgcccagcggcagcagcgtgcccggcgccggcctgcaggacccctag

SEQ ID NO: 71998 - DNA, 54 bp, Artificial Sequence
  Description of Artificial Sequence: Synthetic coding sequence
atgagcgaggagaccgtgcccgaggccgccagccccccccccccccagggctag

SEQ ID NO: 71999 - DNA, 846 bp, Artificial Sequence
  Description of Artificial Sequence: Synthetic coding sequence
atgagcgaggagaccgtgcccgaggccgccagccccccccccccccagggccagccctacttcgacagattcagcgaggacgaccccgagtacatgagactgagaaacagagccgccgacctgagacaggacttcaacctgatggagcagaagaagagagtgaccatgatcctgcagagccccagcttcagagaggagctggagggcctgatccaggagcagatgaagaagggcaacaacagcagcaacatctgggccctgagacagatcgccgacttcatggccagcaccagccacgccgtgttccccaccagcagcatgaacgtgagcatgatgacccccatcaacgacctgcacaccgccgacagcctgaacctggccaagggcgagagactgatgagatgcaagatcagcagcgtgtacagactgctggacctgtacggctgggcccagctgagcgacacctacgtgaccctgagagtgagcaaggagcaggaccacttcctgatcagccccaagggcgtgagctgcagcgaggtgaccgccagcagcctggtgagcgaggtgctggagatgagaaacaagatcagagagcagaacagacaggacgtgaagagcgccggcccccagagccagctgctggccagcgtgatcgccgagaagagcagaagccccagcaccgagagccagctgatgagcaagggcgacgaggacaccaaggacgacagcgaggagaccgtgcccaaccccttcagccagctgaccgaccaggagctggaggagtacaagaaggaggtggagagaaagaagctggagctggacgcccccggctggttcagcagctag

SEQ ID NO: 72000 - DNA, 1932 bp, Artificial Sequence
  Description of Artificial Sequence: Synthetic coding sequence
atgagcgaggagaccgtgcccgaggccgccagccccccccccccccagggccagccctacttcgacagattcagcgaggacgaccccgagtacatgagactgagaaacagagccgccgacctgagacaggacttcaacctgatggagcagaagaagagagtgaccatgatcctgcagagccccagcttcagagaggagctggagggcctgatccaggagcagatgaagaagggcaacaacagcagcaacatctgggccctgagacagatcgccgacttcatggccagcaccagccacgccgtgttccccaccagcagcatgaacgtgagcatgatgacccccatcaacgacctgcacaccgccgacagcctgaacctggccaagggcgagagactgatgagatgcaagatcagcagcgtgtacagactgctggacctgtacggctgggcccagctgagcgacacctacgtgaccctgagagtgagcaaggagcaggaccacttcctgatcagccccaagggcgtgagctgcagcgaggtgaccgccagcagcctgatcaaggtgaacatcctgggcgaggtggtggagaagggcagcagctgcttccccgtggacaccaccggcttctgcctgcacagcgccatctacgccgccagacccgacgtgagatgcatcatccacctgcacacccccgccaccgccgccgtgagcgccatgaagtggggcctgctgcccgtgagccacaacgccctgctggtgggcgacatggcctactacgacttcaacggcgagatggagcaggaggccgacagaatcaacctgcagaagtgcctgggccccacctgcaagatcctggtgctgagaaaccacggcgtggtggccctgggcgacaccgtggaggaggccttctacaagatcttccacctgcaggccgcctgcgagatccaggtgagcgccctgagcagcgccggcggcgtggagaacctgatcctgctggagcaggagaagcacagaccccacgaggtgggcagcgtgcagtgggccggcagcaccttcggccccatgcagaagagcagactgggcgagcacgagttcgaggccctgatgagaatgctggacaacctgggctacagaaccggctacacctacagacaccccttcgtgcaggagaagaccaagcacaagagcgaggtggagatccccgccaccgtgaccgccttcgtgttcgaggaggacggcgcccccgtgcccgccctgagacagcacgcccagaagcagcagaaggagaagaccagatggctgaacacccccaacacctacctgagagtgaacgtggccgacgaggtgcagagaagcatgggcagccccagacccaagaccacctggatgaaggccgacgaggtggagaagagcagcagcggcatgcccatcagaatcgagaaccccaaccagttcgtgcccctgtacaccgacccccaggaggtgctggagatgagaaacaagatcagagagcagaacagacaggacgtgaagagcgccggcccccagagccagctgctggccagcgtgatcgccgagaagagcagaagccccagcaccgagagccagctgatgagcaagggcgacgaggacaccaaggacgacagcgaggagaccgtgcccaaccccttcagccagctgaccgaccaggagctggaggagtacaagaaggaggtggagagaaagaagctggagctggacgagaccggccaggagagagagcccggcagcggccccgccgtgtgcgagttcttcagcgtggccctgcacatctggagcaacatcctggagagaaagaagctgccccagaagagcctggcccacctgcagagcctgcacctgctgctgcagtgcagagcccagagaagaagacagagacagagagccctgtag

SEQ ID NO: 72001 - DNA, 2025 bp, Artificial Sequence
  Description of Artificial Sequence: Synthetic coding sequence
atgagcagcgacgccagccagggcgtgatcaccaccccccccccccccagcatgccccacaaggagagatacttcgacagaatcaacgagaacgaccccgagtacatcagagagagaaacatgagccccgacctgagacaggacttcaacatgatggagcagagaaagagagtgacccagatcctgcagagccccgccttcagagaggacctggagtgcctgatccaggagcagatgaagaagggccacaaccccaccggcctgctggccctgcagcagatcgccgactacatcatggccaacagcttcagcggcttcagcagcccccccctgagcctgggcatggtgacccccatcaacgacctgcccggcgccgacaccagcagctacgtgaagggcgagaagctgaccagatgcaagctggccagcctgtacagactggtggacctgttcggctgggcccacctggccaacacctacatcagcgtgagaatcagcaaggagcaggaccacatcatcatcatccccagaggcctgagcttcagcgaggccaccgccagcaacctggtgaaggtgaacatcatcggcgaggtggtggaccagggcagcaccaacctgaagatcgaccacaccggcttcagcccccacgccgccatctacagcaccagacccgacgtgaagtgcgtgatccacatccacaccctggccaccgccgccgtgagcagcatgaagtgcggcatcctgcccatcagccaggagagcctgctgctgggcgacgtggcctactacgactaccagggcagcctggaggagcaggaggagagaatccagctgcagaaggtgctgggccccagctgcaaggtgctggtgctgagaaaccacggcgtggtggccctgggcgagaccctggaggaggccttccactacatcttcaacgtgcagctggcctgcgagatccaggtgcaggccctggccggcgccggcggcgtggacaacctgcacgtgctggacttccagaagtacaaggccttcacctacaccgtggccgccagcggcggcggcggcgtgaacatgggcagccaccagaagtggaaggtgggcgagatcgagttcgagggcctgatgagaaccctggacaacctgggctacagaaccggctacgcctacagacaccccctgatcagagagaagcccagacacaagagcgacgtggagatccccgccaccgtgaccgccttcagcttcgaggacgacaccgtgcccctgagccccctgaagtacatggcccagagacagcagagagagaagaccagatggctgaacagccccaacacctacatgaaggtgaacgtgcccgaggagagcagaaacggcgagaccagccccagaaccaagatcacctggatgaaggccgaggacagcagcaaggtgagcggcggcacccccatcaagatcgaggaccccaaccagttcgtgcccctgaacaccaaccccaacgaggtgctggagaagagaaacaagatcagagagcagaacagatacgacctgaagaccgccggcccccagagccagctgctggccggcatcgtggtggacaagccccccagcaccatgcagttcgaggacgacgaccacggcccccccgccccccccaaccccttcagccacctgaccgagggcgagctggaggagtacaagagaaccatcgagagaaagcagcagggcctggaggagaaccacgagctgttcagcaagagcttcatcagcatggaggtgcccgtgatggtggtgaacggcaaggacgacatgcacgacgtggaggacgagctggccaagagagtgagcagactgagcaccagcaccaccatcgagaacatcgagatcaccatcaagagccccgagaagatcgaggaggtgctgagccccgagggcagccccagcaagagccccagcaagaagaagaagaagttcagaacccccagcttcctgaagaagaacaagaagaaggagaaggtggaggcctag

SEQ ID NO: 72002 - DNA, 2121 bp, Artificial Sequence
  Description of Artificial Sequence: Synthetic coding sequence
atgagcagcgacgccagccagggcgtgatcaccaccccccccccccccagcatgccccacaaggagagatacttcgacagaatcaacgagaacgaccccgagtacatcagagagagaaacatgagccccgacctgagacaggacttcaacatgatggagcagagaaagagagtgacccagatcctgcagagccccgccttcagagaggacctggagtgcctgatccaggagcagatgaagaagggccacaaccccaccggcctgctggccctgcagcagatcgccgactacatcatggccaacagcttcagcggcttcagcagcccccccctgagcctgggcatggtgacccccatcaacgacctgcccggcgccgacaccagcagctacgtgaagggcgagaagctgaccagatgcaagctggccagcctgtacagactggtggacctgttcggctgggcccacctggccaacacctacatcagcgtgagaatcagcaaggagcaggaccacatcatcatcatccccagaggcctgagcttcagcgaggccaccgccagcaacctggtgaaggtgaacatcatcggcgaggtggtggaccagggcagcaccaacctgaagatcgaccacaccggcttcagcccccacgccgccatctacagcaccagacccgacgtgaagtgcgtgatccacatccacaccctggccaccgccgccgtgagcagcatgaagtgcggcatcctgcccatcagccaggagagcctgctgctgggcgacgtggcctactacgactaccagggcagcctggaggagcaggaggagagaatccagctgcagaaggtgctgggccccagctgcaaggtgctggtgctgagaaaccacggcgtggtggccctgggcgagaccctggaggaggccttccactacatcttcaacgtgcagctggcctgcgagatccaggtgcaggccctggccggcgccggcggcgtggacaacctgcacgtgctggacttccagaagtacaaggccttcacctacaccgtggccgccagcggcggcggcggcgtgaacatgggcagccaccagaagtggaaggtgggcgagatcgagttcgagggcctgatgagaaccctggacaacctgggctacagaaccggctacgcctacagacaccccctgatcagagagaagcccagacacaagagcgacgtggagatccccgccaccgtgaccgccttcagcttcgaggacgacaccgtgcccctgagccccctgaagtacatggcccagagacagcagagagagaagaccagatggctgaacagccccaacacctacatgaaggtgaacgtgcccgaggagagcagaaacggcgagaccagccccagaaccaagatcacctggatgaaggccgaggacagcagcaaggtgagcggcggcacccccatcaagatcgaggaccccaaccagttcgtgcccctgaacaccaaccccaacgaggtgctggagaagagaaacaagatcagagagcagaacagatacgacctgaagaccgccggcccccagagccagctgctggccggcatcgtggtggacaagccccccagcaccatgcagttcgaggacgacgaccacggcccccccgccccccccaaccccttcagccacctgaccgagggcgagctggaggagtacaagagaaccatcgagagaaagcagcagggcctggaggacgccgagcaggagctgctgagcgacgacgccagcagcgtgagccagatccagagccagacccagagcccccagaacgtgcccgagaagctggaggagaaccacgagctgttcagcaagagcttcatcagcatggaggtgcccgtgatggtggtgaacggcaaggacgacatgcacgacgtggaggacgagctggccaagagagtgagcagactgagcaccagcaccaccatcgagaacatcgagatcaccatcaagagccccgagaagatcgaggaggtgctgagccccgagggcagccccagcaagagccccagcaagaagaagaagaagttcagaacccccagcttcctgaagaagaacaagaagaaggagaaggtggaggcctag

SEQ ID NO: 72003 - DNA, 2025 bp, Artificial Sequence; identical to SEQ ID NO: 72001
  Description of Artificial Sequence: Synthetic coding sequence

SEQ ID NO: 72004 - DNA, 543 bp, Artificial Sequence
  Description of Artificial Sequence: Synthetic coding sequence
atggccgacagcgagctgcagctggtggagcagagaatcagaagcttccccgacttccccacccccggcgtggtgttcagagacatcagccccgtgctgaaggaccccgccagcttcagagccgccatcggcctgctggccagacacctgaaggccacccacggcggcagaatcgactacatcgccggcctggacagcagaggcttcctgttcggccccagcctggcccaggagctgggcctgggctgcgtgctgatcagaaagagaggcaagctgcccggccccaccctgtgggccagctacagcctggagtacggcaaggccgagctggagatccagaaggacgccctggagcccggccagagagtggtggtggtggacgacctgctggccaccggcggcaccatgaacgccgcctgcgagctgctgggcagactgcaggccgaggtgctggagtgcgtgagcctggtggagctgaccagcctgaagggcagagagaagctggcccccgtgcccttcttcagcctgctgcagtacgagtag

SEQ ID NO: 72005 - DNA, 405 bp, Artificial Sequence
  Description of Artificial Sequence: Synthetic coding sequence
atggccgacagcgagctgcagctggtggagcagagaatcagaagcttccccgacttccccacccccggcgtggtgttcagagacatcagccccgtgctgaaggaccccgccagcttcagagccgccatcggcctgctggccagacacctgaaggccacccacggcggcagaatcgactacatcgccggcctggacagcagaggcttcctgttcggccccagcctggcccaggagctgggcctgggctgcgtgctgatcagaaagagaggcaagctgcccggccccaccctgtgggccagctacagcctggagtacggcaaggccgagctggagatccagaaggacgccctggagcccggccagagagtggtggtggtggacgacctgctggccaccggcgtgtag

SEQ ID NO: 72006 - DNA, 555 bp, Artificial Sequence
  Description of Artificial Sequence: Synthetic coding sequence
atggacggcctgagacagagagtggagcacttcctggagcagagaaacctggtgaccgaggtgctgggcgccctggaggccaagaccggcgtggagaagagatacctggccgccggcgccgtgaccctgctgagcctgtacctgctgttcggctacggcgccagcctgctgtgcaacctgatcggcttcgtgtaccccgcctacgccagcatcaaggccatcgagagccccagcaaggacgacgacaccgtgtggctgacctactgggtggtgtacgccctgttcggcctggccgagttcttcagcgacctgctgctgagctggttccccttctactacgtgggcaagtgcgccttcctgctgttctgcatggcccccagaccctggaacggcgccctgatgctgtaccagagagtggtgagacccctgttcctgagacaccacggcgccgtggacagaatcatgaacgacctgagcggcagagccctggacgccgccgccggcatcaccagaaacgtgaagcccagccagaccccccagcccaaggacaagtag

SEQ ID NO: 72007 - DNA, 6090 bp, Artificial Sequence
  Description of Artificial Sequence: Synthetic coding sequence
atggccagcagcgtggccccctacgagcagctggtgagacaggtggaggccctgaaggccgagaacagccacctgagacaggagctgagagacaacagcagccacctgagcaagctggagaccgagaccagcggcatgaaggaggtgctgaagcacctgcagggcaagctggagcaggaggccagagtgctggtgagcagcggccagaccgaggtgctggagcagctgaaggccctgcagatggacatcaccagcctgtacaacctgaagttccagccccccaccctgggccccgagcccgccgccagaacccccgagggcagccccgtgcacggcagcggccccagcaaggacagcttcggcgagctgagcagagccaccatcagactgctggaggagctggacagagagagatgcttcctgctgaacgagatcgagaaggaggagaaggagaagctgtggtactacagccagctgcagggcctgagcaagagactggacgagctgccccacgtggactacgagatgcacaagatgaccagagaccccctgaacctggccctgagaagatacgccggcatgaccctgaccaacctgaccttcggcgacgtggccaacaaggccaccctgtgcgccagaagaggctgcatggaggccatcgtggcccagctggccagcgacagcgaggagctgcaccaggtggtgagcagcatcctgagaaacctgagctggagagccgacatcaacagcaagaaggtgctgagagaggccggcagcgtgaccgccctggtgcagtgcgtgctgagagccaccaaggagagcaccctgaagagcgtgctgagcgccctgtggaacctgagcgcccacagcaccgagaacaaggccgccatctgccaggtggacggcgccctgggcttcctggtgagcaccctgacctacaagtgccagagcaacagcctggccatcatcgagagcggcggcggcatcctgagaaacgtgagcagcctggtggccaccagagaggactacagacaggtgctgagagaccacaactgcctgcagaccctgctgcagcacctgaccagccacagcctgaccatcgtgagcaacgcctgcggcaccctgtggaacctgagcgccagaagcgccagagaccaggagctgctgtgggacctgggcgccgtgggcatgctgagaaacctggtgcacagcaagcacaagatgatcgccatgggcagcgccgccgccctgagaaacctgctggcccacagacccgccaagcaccaggccgccgccaccgccgtgagccccggcagctgcgtgcccagcctgtacgtgagaaagcagagagccctggaggccgagctggacgccagacacctggcccaggccctggagcacctggagaagcagggcccccccgccgccgaggccgccaccaagaagcccctgccccccctgagacacctggacggcctggcccaggactacgccagcgacagcggctgcttcgacgacgacgacgcccccagcagcctggccgccgccgccgccaccggcgagcccgccagccccgccgccctgagcctgttcctgggcagccccttcctgcagggccaggccctggccagaaccccccccaccagaagaggcggcaaggaggccgagaaggacaccagcggcgaggccgccgtggccgccaaggccaaggccaagctggccctggccgtggccagaatcgaccagctggtggaggacatcagcgccctgcacaccagcagcgacgacagcttcagcctgagcagcggcgaccccggccaggaggcccccagagagggcagagcccagagctgcagcccctgcagaggccccgagggcggcagaagagaggccggcagcagagcccaccccctgctgagactgaaggccgcccacgccagcctgagcaacgacagcctgaacagcggcagcgccagcgacggctactgccccagagagcacatgctgccctgccccctggccgccctggccagcagaagagaggaccccagatgcggccagcccagacccagcagactggacctggacctgcccggctgccaggccgagccccccgccagagaggccaccagcgccgacgccagagtgagaaccatcaagctgagccccacctaccagcacgtgcccctgctggagggcgccagcagagccggcgccgagcccctggccggccccggcatcagccccggcgccagaaagcaggcctggctgcccgccgaccacctgagcaaggtgcccgagaagctggccgccgcccccctgagcgtggccagcaaggccctgcagaagctggccgcccaggagggccccctgagcctgagcagatgcagcagcctgagcagcctgagcagcgccggcagacccggccccagcgagggcggcgacctggacgacagcgacagcagcctggagggcctggaggaggccggccccagcgaggccgagctggacagcacctggagagcccccggcgccaccagcctgcccgtggccatccccgcccccagaagaaacagaggcagaggcctgggcgtggaggacgccacccccagcagcagcagcgagaactacgtgcaggagacccccctggtgctgagcagatgcagcagcgtgagcagcctgggcagcttcgagagccccagcatcgccagcagcatccccagcgagccctgcagcggccagggcagcggcaccatcagccccagcgagctgcccgacagccccggccagaccatgccccccagcagaagcaagaccccccccctggcccccgccccccagggcccccccgaggccacccagttcagcctgcagtgggagagctacgtgaagagattcctggacatcgccgactgcagagagagatgcagactgcccagcgagctggacgccggcagcgtgagattcaccgtggagaagcccgacgagaacttcagctgcgccagcagcctgagcgccctggccctgcacgagcactacgtgcagcaggacgtggagctgagactgctgcccagcgcctgccccgagagaggcggcggcgccggcggcgccggcctgcacttcgccggccacagaagaagagaggagggccccgcccccaccggcagcagacccagaggcgccgccgaccaggagctggagctgctgagagagtgcctgggcgccgccgtgcccgccagactgagaaaggtggccagcgccctggtgcccggcagaagagccctgcccgtgcccgtgtacatgctggtgcccgcccccgcccccgcccaggaggacgacagctgcaccgacagcgccgagggcacccccgtgaacttcagcagcgccgccagcctgagcgacgagaccctgcagggcccccccagagaccagcccggcggccccgccggcagacagagacccaccggcagacccaccagcgccagacaggccatgggccacagacacaaggccggcggcgccggcagaagcgccgagcagagcagaggcgccggcaagaacagagccggcctggagctgcccctgggcagaccccccagcgcccccgccgacaaggacggcagcaagcccggcagaaccagaggcgacggcgccctgcagagcctgtgcctgaccacccccaccgaggaggccgtgtactgcttctacggcaacgacagcgacgaggagccccccgccgccgcccccacccccacccacagaagaaccagcgccatccccagagccttcaccagagagagaccccagggcagaaaggaggcccccgcccccagcaaggccgcccccgccgcccccccccccgccagaacccagcccagcctgatcgccgacgagacccccccctgctacagcctgagcagcagcgccagcagcctgagcgagcccgagcccagcgagccccccgccgtgcaccccagaggcagagagcccgccgtgaccaaggaccccggccccggcggcggcagagacagcagccccagccccagagccgccgaggagctgctgcagagatgcatcagcagcgccctgcccagaagaagaccccccgtgagcggcctgagaagaagaaagcccagagccaccagactggacgagagacccgccgagggcagcagagagagaggcgaggaggccgccggcagcgacagagccagcgacctggacagcgtggagtggagagccatccaggagggcgccaacagcatcgtgacctggctgcaccaggccgccgccgccaccagagaggccagcagcgagagcgacagcatcctgagcttcgtgagcggcctgagcgtgggcagcaccctgcagccccccaagcacagaaagggcagacaggccgagggcgagatgggcagcgccagaagacccgagaagagaggcgccgccagcgtgaagaccagcggcagccccagaagccccgccggccccgagaagcccagaggcacccagaagaccacccccggcgtgcccgccgtgctgagaggcagaaccgtgatctacgtgcccagccccgcccccagagcccagcccaagggcacccccggccccagagccacccccagaaaggtggcccccccctgcctggcccagcccgccgcccccgccaaggtgcccagccccggccagcagagaagcagaagcctgcacagacccgccaagaccagcgagctggccaccctgagccagccccccagaagcgccaccccccccgccagactggccaagacccccagcagcagcagcagccagaccagccccgccagccagcccctgcccagaaagagaccccccgtgacccaggccgccggcgccctgcccggccccggcgccagccccgtgcccaagacccccgccagaaccctgctggccaagcagcacaagacccagagaagccccgtgagaatccccttcatgcagagacccgccagaagaggccccccccccctggccagagccgtgcccgagcccggccccagaggcagagccggcaccgaggccggccccggcgccagaggcggcagactgggcctggtgagagtggccagcgccctgagcagcggcagcgagagcagcgacagaagcggcttcagaagacagctgaccttcatcaaggagagccccggcctgagaagaagaagaagcgagctgagcagcgccgagagcgccgccagcgccccccagggcgccagccccagaagaggcagacccgccctgcccgccgtgttcctgtgcagcagcagatgcgaggagctgagagccgcccccagacagggccccgcccccgccagacagagaccccccgccgccagacccagccccggcgagagacccgccagaagaaccaccagcgagagccccagcagactgcccgtgagagcccccgccgccagacccgagaccgtgaagagatacgccagcctgccccacatcagcgtggccagaagacccgacggcgccgtgcccgccgcccccgccagcgccgacgccgccagaagaagcagcgacggcgagcccagacccctgcccagagtggccgcccccggcaccacctggagaagaatcagagacgaggacgtgccccacatcctgagaagcaccctgcccgccaccgccctgcccctgagaggcagcacccccgaggacgcccccgccggccccccccccagaaagaccagcgacgccgtggtgcagaccgaggaggtggccgcccccaagaccaacagcagcaccagccccagcctggagaccagagagccccccggcgcccccgccggcggccagctgagcctgctgggcagcgacgtggacggccccagcctggccaaggcccccatcagcgcccccttcgtgcacgagggcctgggcgtggccgtgggcggcttccccgccagcagacacggcagccccagcagaagcgccagagtgccccccttcaactacgtgcccagccccatggtggtggccgccaccaccgacagcgccgccgagaaggcccccgccaccgccagcgccaccctgctggagtag

SEQ ID NO: 72008 - DNA, 6912 bp, Artificial Sequence
  Description of Artificial Sequence: Synthetic coding sequence
atggccagcagcgtggccccctacgagcagctggtgagacaggtggaggccctgaaggccgagaacagccacctgagacaggagctgagagacaacagcagccacctgagcaagctggagaccgagaccagcggcatgaaggaggtgctgaagcacctgcagggcaagctggagcaggaggccagagtgctggtgagcagcggccagaccgaggtgctggagcagctgaaggccctgcagatggacatcaccagcctgtacaacctgaagttccagccccccaccctgggccccgagcccgccgccagaacccccgagggcagccccgtgcacggcagcggccccagcaaggacagcttcggcgagctgagcagagccaccatcagactgctggaggagctggacagagagagatgcttcctgctgaacgagatcgagaaggaggagaaggagaagctgtggtactacagccagctgcagggcctgagcaagagactggacgagctgccccacgtggagacccagttcagcatgcagatggacctgatcagacagcagctggagttcgaggcccagcacatcagaagcctgatggaggagagattcggcaccagcgacgagatggtgcagagagcccagatcagagccagcagactggagcagatcgacaaggagctgctggaggcccaggacagagtgcagcagaccgagccccaggccctgctggccgtgaagagcgtgcccgtggacgaggaccccgagaccgaggtgcccacccaccccgaggacggcaccccccagcccggcaacagcaaggtggaggtggtgttctggctgctgagcatgctggccaccagagaccaggaggacaccgccagaaccctgctggccatgagcagcagccccgagagctgcgtggccatgagaagaagcggctgcctgcccctgctgctgcagatcctgcacggcaccgaggccgccgccggcggcagagccggcgcccccggcgcccccggcgccaaggacgccagaatgagagccaacgccgccctgcacaacatcgtgttcagccagcccgaccagggcctggccagaaaggagatgagagtgctgcacgtgctggagcagatcagagcctactgcgagacctgctgggactggctgcaggccagagacggcggccccgagggcggcggcgccggcagcgcccccatccccatcgagccccagatctgccaggccacctgcgccgtgatgaagctgagcttcgacgaggagtacagaagagccatgaacgagctgggcggcctgcaggccgtggccgagctgctgcaggtggactacgagatgcacaagatgaccagagaccccctgaacctggccctgagaagatacgccggcatgaccctgaccaacctgaccttcggcgacgtggccaacaaggccaccctgtgcgccagaagaggctgcatggaggccatcgtggcccagctggccagcgacagcgaggagctgcaccaggtggtgagcagcatcctgagaaacctgagctggagagccgacatcaacagcaagaaggtgctgagagaggccggcagcgtgaccgccctggtgcagtgcgtgctgagagccaccaaggagagcaccctgaagagcgtgctgagcgccctgtggaacctgagcgcccacagcaccgagaacaaggccgccatctgccaggtggacggcgccctgggcttcctggtgagcaccctgacctacaagtgccagagcaacagcctggccatcatcgagagcggcggcggcatcctgagaaacgtgagcagcctggtggccaccagagaggactacagacaggtgctgagagaccacaactgcctgcagaccctgctgcagcacctgaccagccacagcctgaccatcgtgagcaacgcctgcggcaccctgtggaacctgagcgccagaagcgccagagaccaggagctgctgtgggacctgggcgccgtgggcatgctgagaaacctggtgcacagcaagcacaagatgatcgccatgggcagcgccgccgccctgagaaacctgctggcccacagacccgccaagcaccaggccgccgccaccgccgtgagccccggcagctgcgtgcccagcctgtacgtgagaaagcagagagccctggaggccgagctggacgccagacacctggcccaggccctggagcacctggagaagcagggcccccccgccgccgaggccgccaccaagaagcccctgccccccctgagacacctggacggcctggcccaggactacgccagcgacagcggctgcttcgacgacgacgacgcccccagcagcctggccgccgccgccgccaccggcgagcccgccagccccgccgccctgagcctgttcctgggcagccccttcctgcagggccaggccctggccagaaccccccccaccagaagaggcggcaaggaggccgagaaggacaccagcggcgaggccgccgtggccgccaaggccaaggccaagctggccctggccgtggccagaatcgaccagctggtggaggacatcagcgccctgcacaccagcagcgacgacagcttcagcctgagcagcggcgaccccggccaggaggcccccagagagggcagagcccagagctgcagcccctgcagaggccccgagggcggcagaagagaggccggcagcagagcccaccccctgctgagactgaaggccgcccacgccagcctgagcaacgacagcctgaacagcggcagcgccagcgacggctactgccccagagagcacatgctgccctgccccctggccgccctggccagcagaagagaggaccccagatgcggccagcccagacccagcagactggacctggacctgcccggctgccaggccgagccccccgccagagaggccaccagcgccgacgccagagtgagaaccatcaagctgagccccacctaccagcacgtgcccctgctggagggcgccagcagagccggcgccgagcccctggccggccccggcatcagccccggcgccagaaagcaggcctggctgcccgccgaccacctgagcaaggtgcccgagaagctggccgccgcccccctgagcgtggccagcaaggccctgcagaagctggccgcccaggagggccccctgagcctgagcagatgcagcagcctgagcagcctgagcagcgccggcagacccggccccagcgagggcggcgacctggacgacagcgacagcagcctggagggcctggaggaggccggccccagcgaggccgagctggacagcacctggagagcccccggcgccaccagcctgcccgtggccatccccgcccccagaagaaacagaggcagaggcctgggcgtggaggacgccacccccagcagcagcagcgagaactacgtgcaggagacccccctggtgctgagcagatgcagcagcgtgagcagcctgggcagcttcgagagccccagcatcgccagcagcatccccagcgagccctgcagcggccagggcagcggcaccatcagccccagcgagctgcccgacagccccggccagaccatgccccccagcagaagcaagaccccccccctggcccccgccccccagggcccccccgaggccacccagttcagcctgcagtgggagagctacgtgaagagattcctggacatcgccgactgcagagagagatgcagactgcccagcgagctggacgccggcagcgtgagattcaccgtggagaagcccgacgagaacttcagctgcgccagcagcctgagcgccctggccctgcacgagcactacgtgcagcaggacgtggagctgagactgctgcccagcgcctgccccgagagaggcggcggcgccggcggcgccggcctgcacttcgccggccacagaagaagagaggagggccccgcccccaccggcagcagacccagaggcgccgccgaccaggagctggagctgctgagagagtgcctgggcgccgccgtgcccgccagactgagaaaggtggccagcgccctggtgcccggcagaagagccctgcccgtgcccgtgtacatgctggtgcccgcccccgcccccgcccaggaggacgacagctgcaccgacagcgccgagggcacccccgtgaacttcagcagcgccgccagcctgagcgacgagaccctgcagggcccccccagagaccagcccggcggccccgccggcagacagagacccaccggcagacccaccagcgccagacaggccatgggccacagacacaaggccggcggcgccggcagaagcgccgagcagagcagaggcgccggcaagaacagagccggcctggagctgcccctgggcagaccccccagcgcccccgccgacaaggacggcagcaagcccggcagaaccagaggcgacggcgccctgcagagcctgtgcctgaccacccccaccgaggaggccgtgtactgcttctacggcaacgacagcgacgaggagccccccgccgccgcccccacccccacccacagaagaaccagcgccatccccagagccttcaccagagagagaccccagggcagaaaggaggcccccgcccccagcaaggccgcccccgccgcccccccccccgccagaacccagcccagcctgatcgccgacgagacccccccctgctacagcctgagcagcagcgccagcagcctgagcgagcccgagcccagcgagccccccgccgtgcaccccagaggcagagagcccgccgtgaccaaggaccccggccccggcggcggcagagacagcagccccagccccagagccgccgaggagctgctgcagagatgcatcagcagcgccctgcccagaagaagaccccccgtgagcggcctgagaagaagaaagcccagagccaccagactggacgagagacccgccgagggcagcagagagagaggcgaggaggccgccggcagcgacagagccagcgacctggacagcgtggagtggagagccatccaggagggcgccaacagcatcgtgacctggctgcaccaggccgccgccgccaccagagaggccagcagcgagagcgacagcatcctgagcttcgtgagcggcctgagcgtgggcagcaccctgcagccccccaagcacagaaagggcagacaggccgagggcgagatgggcagcgccagaagacccgagaagagaggcgccgccagcgtgaagaccagcggcagccccagaagccccgccggccccgagaagcccagaggcacccagaagaccacccccggcgtgcccgccgtgctgagaggcagaaccgtgatctacgtgcccagccccgcccccagagcccagcccaagggcacccccggccccagagccacccccagaaaggtggcccccccctgcctggcccagcccgccgcccccgccaaggtgcccagccccggccagcagagaagcagaagcctgcacagacccgccaagaccagcgagctggccaccctgagccagccccccagaagcgccaccccccccgccagactggccaagacccccagcagcagcagcagccagaccagccccgccagccagcccctgcccagaaagagaccccccgtgacccaggccgccggcgccctgcccggccccggcgccagccccgtgcccaagacccccgccagaaccctgctggccaagcagcacaagacccagagaagccccgtgagaatccccttcatgcagagacccgccagaagaggccccccccccctggccagagccgtgcccgagcccggccccagaggcagagccggcaccgaggccggccccggcgccagaggcggcagactgggcctggtgagagtggccagcgccctgagcagcggcagcgagagcagcgacagaagcggcttcagaagacagctgaccttcatcaaggagagccccggcctgagaagaagaagaagcgagctgagcagcgccgagagcgccgccagcgccccccagggcgccagccccagaagaggcagacccgccctgcccgccgtgttcctgtgcagcagcagatgcgaggagctgagagccgcccccagacagggccccgcccccgccagacagagaccccccgccgccagacccagccccggcgagagacccgccagaagaaccaccagcgagagccccagcagactgcccgtgagagcccccgccgccagacccgagaccgtgaagagatacgccagcctgccccacatcagcgtggccagaagacccgacggcgccgtgcccgccgcccccgccagcgccgacgccgccagaagaagcagcgacggcgagcccagacccctgcccagagtggccgcccccggcaccacctggagaagaatcagagacgaggacgtgccccacatcctgagaagcaccctgcccgccaccgccctgcccctgagaggcagcacccccgaggacgcccccgccggccccccccccagaaagaccagcgacgccgtggtgcagaccgaggaggtggccgcccccaagaccaacagcagcaccagccccagcctggagaccagagagccccccggcgcccccgccggcggccagctgagcctgctgggcagcgacgtggacggccccagcctggccaaggcccccatcagcgcccccttcgtgcacgagggcctgggcgtggccgtgggcggcttccccgccagcagacacggcagccccagcagaagcgccagagtgccccccttcaactacgtgcccagccccatggtggtggccgccaccaccgacagcgccgccgagaaggcccccgccaccgccagcgccaccctgctggagtag

SEQ ID NO: 72009 - DNA, 1545 bp, Artificial Sequence
  Description of Artificial Sequence: Synthetic coding sequence
atgagctggcccagaagactgctgctgagatacctgttccccgccctgctgctgcacggcctgggcgagggcagcgccctgctgcaccccgacagcagaagccaccccagaagcctggagaagagcgcctggagagccttcaaggagagccagtgccaccacatgctgaagcacctgcacaacggcgccagaatcaccgtgcagatgccccccaccatcgagggccactgggtgagcaccggctgcgaggtgagaagcggccccgagttcatcaccagaagctacagattctaccacaacaacaccttcaaggcctaccagttctactacggcagcaacagatgcaccaaccccacctacaccctgatcatcagaggcaagatcagactgagacaggccagctggatcatcagaggcggcaccgaggccgactaccagctgcacaacgtgcaggtgatctgccacaccgaggccgtggccgagaagctgggccagcaggtgaacagaacctgccccggcttcctggccgacggcggcccctgggtgcaggacgtggcctacgacctgtggagagaggagaacggctgcgagtgcaccaaggccgtgaacttcgccatgcacgagctgcagctgatcagagtggagaagcagtacctgcaccacaacctggaccacctggtggaggagctgttcctgggcgacatccacaccgacgccacccagagaatgttctacagacccagcagctaccagccccccctgcagaacgccaagaaccacgaccacgcctgcatcgcctgcagaatcatctacagaagcgacgagcaccacccccccatcctgccccccaaggccgacctgaccatcggcctgcacggcgagtgggtgagccagagatgcgaggtgagacccgaggtgctgttcctgaccagacacttcatcttccacgacaacaacaacacctgggagggccactactaccactacagcgaccccgtgtgcaagcaccccaccttcagcatctacgccagaggcagatacagcagaggcgtgctgagcagcagagtgatgggcggcaccgagttcgtgttcaaggtgaaccacatgaaggtgacccccatggacgccgccaccgccagcctgctgaacgtgttcaacggcaacgagtgcggcgccgagggcagctggcaggtgggcatccagcaggacgtgacccacaccaacggctgcgtggccctgggcatcaagctgccccacaccgagtacgagatcttcaagatggagcaggacgccagaggcagatacctgctgttcaacggccagagacccagcgacggcagcagccccgacagacccgagaagagagccaccagctaccagatgcccctggtgcagtgcgccagcagcagccccagagccgaggacctggccgaggacagcggcagcagcctgtacggcagagcccccggcagacacacctggagcctgctgctggccgccctggcctgcctggtgcccctgctgcactggaacatcagaagatag

SEQ ID NO: 72010 - DNA, 1698 bp, Artificial Sequence
  Description of Artificial Sequence: Synthetic coding sequence
atgaagagaagatgcagctgcggcggcggcggcggccactgcagcagcgagagaagaagaaccagacccgaggccgagggcagagccagagcccagctgcccggccaccagatcggcgccagaagagccggcggccccagagccggcctggagatgagctggcccagaagactgctgctgagatacctgttccccgccctgctgctgcacggcctgggcgagggcagcgccctgctgcaccccgacagcagaagccaccccagaagcctggagaagagcgcctggagagccttcaaggagagccagtgccaccacatgctgaagcacctgcacaacggcgccagaatcaccgtgcagatgccccccaccatcgagggccactgggtgagcaccggctgcgaggtgagaagcggccccgagttcatcaccagaagctacagattctaccacaacaacaccttcaaggcctaccagttctactacggcagcaacagatgcaccaaccccacctacaccctgatcatcagaggcaagatcagactgagacaggccagctggatcatcagaggcggcaccgaggccgactaccagctgcacaacgtgcaggtgatctgccacaccgaggccgtggccgagaagctgggccagcaggtgaacagaacctgccccggcttcctggccgacggcggcccctgggtgcaggacgtggcctacgacctgtggagagaggagaacggctgcgagtgcaccaaggccgtgaacttcgccatgcacgagctgcagctgatcagagtggagaagcagtacctgcaccacaacctggaccacctggtggaggagctgttcctgggcgacatccacaccgacgccacccagagaatgttctacagacccagcagctaccagccccccctgcagaacgccaagaaccacgaccacgcctgcatcgcctgcagaatcatctacagaagcgacgagcaccacccccccatcctgccccccaaggccgacctgaccatcggcctgcacggcgagtgggtgagccagagatgcgaggtgagacccgaggtgctgttcctgaccagacacttcatcttccacgacaacaacaacacctgggagggccactactaccactacagcgaccccgtgtgcaagcaccccaccttcagcatctacgccagaggcagatacagcagaggcgtgctgagcagcagagtgatgggcggcaccgagttcgtgttcaaggtgaaccacatgaaggtgacccccatggacgccgccaccgccagcctgctgaacgtgttcaacggcaacgagtgcggcgccgagggcagctggcaggtgggcatccagcaggacgtgacccacaccaacggctgcgtggccctgggcatcaagctgccccacaccgagtacgagatcttcaagatggagcaggacgccagaggcagatacctgctgttcaacggccagagacccagcgacggcagcagccccgacagacccgagaagagagccaccagctaccagatgcccctggtgcagtgcgccagcagcagccccagagccgaggacctggccgaggacagcggcagcagcctgtacggcagagcccccggcagacacacctggagcctgctgctggccgccctggcctgcctggtgcccctgctgcactggaacatcagaagatag

SEQ ID NO: 72011 - DNA, 981 bp, Artificial Sequence
  Description of Artificial Sequence: Synthetic coding sequence
atgccccccagcatcagcgccttccaggccgcctacatcggcatcgaggtgctgatcgccctggtgagcgtgcccggcaacgtgctggtgatctgggccgtgaaggtgaaccaggccctgagagacgccaccttctgcttcatcgtgagcctggccgtggccgacgtggccgtgggcgccctggtgatccccctggccatcctgatcaacatcggcccccagacctacttccacacctgcctgatggtggcctgccccgtgctgatcctgacccagagcagcatcctggccctgctggccatcgccgtggacagatacctgagagtgaagatccccctgagatacaagatggtggtgacccccagaagagccgccgtggccatcgccggctgctggatcctgagcttcgtggtgggcctgacccccatgttcggctggaacaacctgagcgccgtggagagagcctgggccgccaacggcagcatgggcgagcccgtgatcaagtgcgagttcgagaaggtgatcagcatggagtacatggtgtacttcaacttcttcgtgtgggtgctgccccccctgctgctgatggtgctgatctacctggaggtgttctacctgatcagaaagcagctgaacaagaaggtgagcgccagcagcggcgacccccagaagtactacggcaaggagctgaagatcgccaagagcctggccctgatcctgttcctgttcgccctgagctggctgcccctgcacatcctgaactgcatcaccctgttctgccccagctgccacaagcccagcatcctgacctacatcgccatcttcctgacccacggcaacagcgccatgaaccccatcgtgtacgccttcagaatccagaagttcagagtgaccttcctgaagatctggaacgaccacttcagatgccagcccgccccccccatcgacgaggacctgcccgaggagagacccgacgactag

SEQ ID NO: 72012 - DNA, 981 bp, Artificial Sequence; identical to SEQ ID NO: 72011
  Description of Artificial Sequence: Synthetic coding sequence

SEQ ID NO: 72013 - DNA, 378 bp, Artificial Sequence
  Description of Artificial Sequence: Synthetic coding sequence
atgccccccagcatcagcgccttccaggccgcctacatcggcatcgaggtgctgatcgccctggtgagcgtgcccggcaacgtgctggtgatctgggccgtgaaggtgaaccaggccctgagagacgccaccttctgcttcatcgtgagcctggccgtggccgacgtggccgtgggcgccctggtgatccccctggccatcctgatcaacatcggcccccagacctacttccacacctgcctgatggtggcctgccccgtgctgatcctgacccagagcagcatcctggccctgctggccatcgccgtggacagatacctgagagtgaagatccccctgagaagaatcagccagtgcatggccagcaccaagagctag

SEQ ID NO: 72014 - DNA, 981 bp, Artificial Sequence; identical to SEQ ID NO: 72011
  Description of Artificial Sequence: Synthetic coding sequence

SEQ ID NO: 72015 - DNA, 1239 bp, Artificial Sequence
  Description of Artificial Sequence: Synthetic coding sequence
atgcccatcatgggcagcagcgtgtacatcaccgtggagctggccatcgccgtgctggccatcctgggcaacgtgctggtgtgctgggccgtgtggctgaacagcaacctgcagaacgtgaccaactacttcgtggtgagcctggccgccgccgacatcgccgtgggcgtgctggccatccccttcgccatcaccatcagcaccggcttctgcgccgcctgccacggctgcctgttcatcgcctgcttcgtgctggtgctgacccagagcagcatcttcagcctgctggccatcgccatcgacagatacatcgccatcagaatccccctgagatacaacggcctggtgaccggcaccagagccaagggcatcatcgccatctgctgggtgctgagcttcgccatcggcctgacccccatgctgggctggaacaactgcggccagcccaaggagggcaagaaccacagccagggctgcggcgagggccaggtggcctgcctgttcgaggacgtggtgcccatgaactacatggtgtacttcaacttcttcgcctgcgtgctggtgcccctgctgctgatgctgggcgtgtacctgagaatcttcctggccgccagaagacagctgaagcagatggagagccagcccctgcccggcgagagagccagaagcaccctgcagaaggaggtgcacgccgccaagagcctggccatcatcgtgggcctgttcgccctgtgctggctgcccctgcacatcatcaactgcttcaccttcttctgccccgactgcagccacgcccccctgtggctgatgtacctggccatcgtgctgagccacaccaacagcgtggtgaaccccttcatctacgcctacagaatcagagagttcagacagaccttcagaaagatcatcagaagccacgtgctgagacagcaggagcccttcaaggccgccggcaccagcgccagagtgctggccgcccacggcagcgacggcgagcaggtgagcctgagactgaacggccacccccccggcgtgtgggccaacggcagcgccccccaccccgagagaagacccaacggctacgccctgggcctggtgagcggcggcagcgcccaggagagccagggcaacaccggcctgcccgacgtggagctgctgagccacgagctgaagggcgtgtgccccgagccccccggcctggacgaccccctggcccaggacggcgccggcgtgagctag

SEQ ID NO: 72016 - DNA, 1239 bp, Artificial Sequence; identical to SEQ ID NO: 72015
  Description of Artificial Sequence: Synthetic coding sequence

SEQ ID NO: 72017 - DNA, 267 bp, Artificial Sequence
  Description of Artificial Sequence: Synthetic coding sequence
atgcccatcatgggcagcagcgtgtacatcaccgtggagctggccatcgccgtgctggccatcctgggcaacgtgctggtgtgctgggccgtgtggctgaacagcaacctgcagaacgtgaccaactacttcgtggtgagcctggccgccgccgacatcgccgtgggcgtgctggccatccccttcgccatcaccatcagcaccggcttctgcgccgcctgccacggctgcctgttcatcgcctgcttcgtgctggtgctgacctag

SEQ ID NO: 72018 - DNA, 195 bp, Artificial Sequence
  Description of Artificial Sequence: Synthetic coding sequence
atgcccatcatgggcagcagcgtgtacatcaccgtggagctggccatcgccgtgctggccatcctgggcaacgtgctggtgtgctgggccgtgtggctgaacagcaacctgcagaacgtgaccaactacttcgtggtgagcctggccgccgccgacatcgccgtgggcgtgctggccatccccttcgccatctag

SEQ ID NO: 72019 - DNA, 231 bp, Artificial Sequence
  Description of Artificial Sequence: Synthetic coding sequence
atgcccatcatgggcagcagcgtgtacatcaccgtggagctggccatcgccgtgctggccatcctgggcaacgtgctggtgtgctgggccgtgtggctgaacagcaacctgcagaacgtgaccaactacttcgtggtgagcctggccgccgccgacatcgccgtgggcgtgctggccatccccttcgccatcaccatcagcaccggcttctgcgccgcctgccacggctag

SEQ ID NO: 72020 - DNA, 1098 bp, Artificial Sequence
  Description of Artificial Sequence: Synthetic coding sequence
atgcccatcatgggcagcagcgtgtacatcaccgtggagctggccatcgccgtgctggccatcctgggcaacgtgctggtgtgctgggccgtgtggctgaacagcaacctgcagaacgtgaccaactacttcgtggtgagcctggccgccgccgacatcgccgtgggcgtgctggccatccccttcgccatcaccatcagcaccggcttctgcgccgcctgccacggctgcctgttcatcgcctgcttcgtgctggtgctgacccagagcagcatcttcagcctgctggccatcgccatcgacagatacatcgccatcagaatccccctgagatacaacggcctggtgaccggcaccagagccaagggcatcatcgccatctgctgggtgctgagcttcgccatcggcctgacccccatgctgggctggaacaactgcggccagcccaaggagggcaagaaccacagccagggctgcggcgagggccaggtggcctgcctgttcgaggacgtggtgcccatgaactacatggtgtacttcaacttcttcgcctgcgtgctggtgcccctgctgctgatgctgggcgtgtacctgagaatcttcctggccgccagaagacagctgaagcagatggagagccagcccctgcccggcgagagagccagaagcaccctgcagaaggaggtgcacgccgccaagagcctggccatcatcgtgggcctgttcgccctgtgctggctgcccctgcacatcatcaactgcttcaccttcttctgccccgactgcagccacgcccccctgtggctgatgtacctggccatcgtgctgagccacaccaacagcgtggtgaaccccttcatctacgcctacagaatcagagagttcagacagaccttcagaaagatcatcagaagccacgtgctgagacagcaggagcccttcaaggccgccggcaccagcgccagagtgctggccgcccacggcagcgacggcgagcaggtgagcctgagactgaacggccacccccccggcgtgtgggccaacggcagcgccccccaccccgagagaagacccaacggctacgccctgggcctgtag

SEQ ID NO: 72021 - DNA, 1239 bp, Artificial Sequence; identical to SEQ ID NO: 72015
  Description of Artificial Sequence: Synthetic coding sequence

SEQ ID NO: 72022 - DNA, 999 bp, Artificial Sequence
  Description of Artificial Sequence: Synthetic coding sequence
atgctgctggagacccaggacgccctgtacgtggccctggagctggtgatcgccgccctgagcgtggccggcaacgtgctggtgtgcgccgccgtgggcaccgccaacaccctgcagacccccaccaactacttcctggtgagcctggccgccgccgacgtggccgtgggcctgttcgccatccccttcgccatcaccatcagcctgggcttctgcaccgacttctacggctgcctgttcctggcctgcttcgtgctggtgctgacccagagcagcatcttcagcctgctggccgtggccgtggacagatacctggccatctgcgtgcccctgagatacaagagcctggtgaccggcaccagagccagaggcgtgatcgccgtgctgtgggtgctggccttcggcatcggcctgacccccttcctgggctggaacagcaaggacagcgccaccaacaactgcaccgagccctgggacggcaccaccaacgagagctgctgcctggtgaagtgcctgttcgagaacgtggtgcccatgagctacatggtgtacttcaacttcttcggctgcgtgctgccccccctgctgatcatgctggtgatctacatcaagatcttcctggtggcctgcagacagctgcagagaaccgagctgatggaccacagcagaaccaccctgcagagagagatccacgccgccaagagcctggccatgatcgtgggcatcttcgccctgtgctggctgcccgtgcacgccgtgaactgcgtgaccctgttccagcccgcccagggcaagaacaagcccaagtgggccatgaacatggccatcctgctgagccacgccaacagcgtggtgaaccccatcgtgtacgcctacagaaacagagacttcagatacaccttccacaagatcatcagcagatacctgctgtgccaggccgacgtgaagagcggcaacggccaggccggcgtgcagcccgccctgggcgtgggcctgtag

SEQ ID NO: 72023 - DNA, 957 bp, Artificial Sequence
  Description of Artificial Sequence: Synthetic coding sequence
atgcccaacaacagcaccgccctgagcctggccaacgtgacctacatcaccatggagatcttcatcggcctgtgcgccatcgtgggcaacgtgctggtgatctgcgtggtgaagctgaaccccagcctgcagaccaccaccttctacttcatcgtgagcctggccctggccgacatcgccgtgggcgtgctggtgatgcccctggccatcgtggtgagcctgggcatcaccatccacttctacagctgcctgttcatgacctgcctgctgctgatcttcacccacgccagcatcatgagcctgctggccatcgccgtggacagatacctgagagtgaagctgaccgtgagatacaagagagtgaccacccacagaagaatctggctggccctgggcctgtgctggctggtgagcttcctggtgggcctgacccccatgttcggctggaacatgaagctgaccagcgagtaccacagaaacgtgaccttcctgagctgccagttcgtgagcgtgatgagaatggactacatggtgtacttcagcttcctgacctggatcttcatccccctggtggtgatgtgcgccatctacctggacatcttctacatcatcagaaacaagctgagcctgaacctgagcaacagcaaggagaccggcgccttctacggcagagagttcaagaccgccaagagcctgttcctggtgctgttcctgttcgccctgagctggctgcccctgagcatcatcaactgcatcatctacttcaacggcgaggtgccccagctggtgctgtacatgggcatcctgctgagccacgccaacagcatgatgaaccccatcgtgtacgcctacaagatcaagaagttcaaggagacctacctgctgatcctgaaggcctgcgtggtgtgccaccccagcgacagcctggacaccagcatcgagaagaacagcgagtag

SEQ ID NO: 72024 - DNA, 537 bp, Artificial Sequence
  Description of Artificial Sequence: Synthetic coding sequence
atggagggcagccccgccggccccatcgagcagaaggaggccagatgggagagcagctgggaggagcagcccgactggaccctgggctgcctgagccccgagagccacaccaaccacgtggccctgagagacaccggcaaccagctgatcgtgaccatgagctgcctgaccaaggaggacaccggctggtactggtgcggcatccagagagacttcgccagagacgacatggacttcaccgagctgatcgtgaccgacgacaagggcaccctggccaacgacttctggagcggcaaggacctgagcggcaacaagaccagaagctgcaaggcccccaaggtggtgagaaaggccgacagaagcagaaccagcatcctgatcatctgcatcctgatcaccggcctgggcatcatcagcgtgatcagccacctgaccaagagaagaagaagccagagaaacagaagagtgggcaacaccctgaagcccttcagcagagtgctgacccccaaggagatggcccccaccgagcagatgtag

SEQ ID NO: 72025 - DNA, 1044 bp, Artificial Sequence
  Description of Artificial Sequence: Synthetic coding sequence
atgcccaacaacagcaccgccctgagcctggccaacgtgacctacatcaccatggagatcttcatcggcctgtgcgccatcgtgggcaacgtgctggtgatctgcgtggtgaagctgaaccccagcctgcagaccaccaccttctacttcatcgtgagcctggccctggccgacatcgccgtgggcgtgctggtgatgcccctggccatcgtggtgagcctgggcatcaccatccacttctacagctgcctgttcatgacctgcctgctgctgatcttcacccacgccagcatcatgagcctgctggccatcgccgtggacagatacctgagagtgaagctgaccgtgagattcagaatccccggcctgcccggctgcatcctgagcttccagctgaaggtgtgcttcctgcccgtgatgtggctgttcatcctgctgagcctggccctgatcagcgacgccatggtgatggacgagaaggtgaagagaagcttcgtgctggacaccgccagcgccatctgcaactacaacgcccactacaagaaccaccccaagtactggtgcagaggctacttcagagactactgcaacatcatcgccttcagccccaacagcaccaaccacgtggccctgagagacaccggcaaccagctgatcgtgaccatgagctgcctgaccaaggaggacaccggctggtactggtgcggcatccagagagacttcgccagagacgacatggacttcaccgagctgatcgtgaccgacgacaagggcaccctggccaacgacttctggagcggcaaggacctgagcggcaacaagaccagaagctgcaaggcccccaaggtggtgagaaaggccgacagaagcagaaccagcatcctgatcatctgcatcctgatcaccggcctgggcatcatcagcgtgatcagccacctgaccaagagaagaagaagccagagaaacagaagagtgggcaacaccctgaagcccttcagcagagtgctgacccccaaggagatggcccccaccgagcagatgtag

SEQ ID NO: 72026 - DNA, 801 bp, Artificial Sequence
  Description of Artificial Sequence: Synthetic coding sequence
atggagggcagccccgccggccccatcgagcagaaggaggccagatgggagagcagctgggaggagcagcccgactggaccctgggctgcctgagccccgagagccagttcagaatccccggcctgcccggctgcatcctgagcttccagctgaaggtgtgcttcctgcccgtgatgtggctgttcatcctgctgagcctggccctgatcagcgacgccatggtgatggacgagaaggtgaagagaagcttcgtgctggacaccgccagcgccatctgcaactacaacgcccactacaagaaccaccccaagtactggtgcagaggctacttcagagactactgcaacatcatcgccttcagccccaacagcaccaaccacgtggccctgagagacaccggcaaccagctgatcgtgaccatgagctgcctgaccaaggaggacaccggctggtactggtgcggcatccagagagacttcgccagagacgacatggacttcaccgagctgatcgtgaccgacgacaagggcaccctggccaacgacttctggagcggcaaggacctgagcggcaacaagaccagaagctgcaaggcccccaaggtggtgagaaaggccgacagaagcagaaccagcatcctgatcatctgcatcctgatcaccggcctgggcatcatcagcgtgatcagccacctgaccaagagaagaagaagccagagaaacagaagagtgggcaacaccctgaagcccttcagcagagtgctgacccccaaggagatggcccccaccgagcagatgtag

SEQ ID NO: 72027 - DNA, 624 bp, Artificial Sequence
  Description of Artificial Sequence: Synthetic coding sequence
tgaccccaggccctgcagggcccccccagcagcaacgacgccatggtgatggacgagaaggtgaagagaagcttcgtgctggacaccgccagcgccatctgcaactacaacgcccactacaagaaccaccccaagtactggtgcagaggctacttcagagactactgcaacatcatcgccttcagccccaacagcaccaaccacgtggccctgagagacaccggcaaccagctgatcgtgaccatgagctgcctgaccaaggaggacaccggctggtactggtgcggcatccagagagacttcgccagagacgacatggacttcaccgagctgatcgtgaccgacgacaagggcaccctggccaacgacttctggagcggcaaggacctgagcggcaacaagaccagaagctgcaaggcccccaaggtggtgagaaaggccgacagaagcagaaccagcatcctgatcatctgcatcctgatcaccggcctgggcatcatcagcgtgatcagccacctgaccaagagaagaagaagccagagaaacagaagagtgggcaacaccctgaagcccttcagcagagtgctgacccccaaggagatggcccccaccgagcagatgtag

SEQ ID NO: 72028 - DNA, 348 bp, Artificial Sequence
  Description of Artificial Sequence: Synthetic coding sequence
tgacccagcagccacgtggccctgcacagcaccctgctgggcagccacttcagcaccaaccacgtggccctgagagacaccggcaaccagctgatcgtgaccatgagctgcctgaccaaggaggacaccggctggtactggtgcggcatccagagagacttcgccagagacgacatggacttcaccgagctgatcgtgaccgacgacaagggcaccctggccaacgacttctggagcggcaaggacctgagcggcaacaagaccagaagctgcaaggcccccaaggtggtgagaaaggccgacagaagcagaaccagcatcctgatcatctgcatcctgatcacctag

SEQ ID NO: 72029 - DNA, 519 bp, Artificial Sequence
  Description of Artificial Sequence: Synthetic coding sequence
ggccccatcgagcagaaggaggccagatgggagagcagctgggaggagcagcccgactggaccctgggctgcctgagccccgagagccacaccaaccacgtggccctgagagacaccggcaaccagctgatcgtgaccatgagctgcctgaccaaggaggacaccggctggtactggtgcggcatccagagagacttcgccagagacgacatggacttcaccgagctgatcgtgaccgacgacaagggcaccctggccaacgacttctggagcggcaaggacctgagcggcaacaagaccagaagctgcaaggcccccaaggtggtgagaaaggccgacagaagcagaaccagcatcctgatcatctgcatcctgatcaccggcctgggcatcatcagcgtgatcagccacctgaccaagagaagaagaagccagagaaacagaagagtgggcaacaccctgaagcccttcagcagagtgctgacccccaaggagatggcccccaccgagcagatgtag

SEQ ID NO: 72030 - DNA, 1092 bp, Artificial Sequence
  Description of Artificial Sequence: Synthetic coding sequence
atggcccagacccccgccttcgacaagcccaaggtggagctgcacgtgcacctggacggcagcatcaagcccgagaccatcctgtactacggcagaagaagaggcatcgccctgcccgccaacaccgccgagggcctgctgaacgtgatcggcatggacaagcccctgaccctgcccgacttcctggccaagttcgactactacatgcccgccatcgccggctgcagagaggccatcaagagaatcgcctacgagttcgtggagatgaaggccaaggagggcgtggtgtacgtggaggtgagatacagcccccacctgctggccaacagcaaggtggagcccatcccctggaaccaggccgagggcgacctgacccccgacgaggtggtggccctggtgggccagggcctgcaggagggcgagagagacttcggcgtgaaggccagaagcatcctgtgctgcatgagacaccagcccaactggagccccaaggtggtggagctgtgcaagaagtaccagcagcagaccgtggtggccatcgacctggccggcgacgagaccatccccggcagcagcctgctgcccggccacgtgcaggcctaccaggaggccgtgaagagcggcatccacagaaccgtgcacgccggcgaggtgggcagcgccgaggtggtgaaggaggccgtggacatcctgaagaccgagagactgggccacggctaccacaccctggaggaccaggccctgtacaacagactgagacaggagaacatgcacttcgagatctgcccctggagcagctacctgaccggcgcctggaagcccgacaccgagcacgccgtgatcagactgaagaacgaccaggccaactacagcctgaacaccgacgaccccctgatcttcaagagcaccctggacaccgactaccagatgaccaagagagacatgggcttcaccgaggaggagttcaagagactgaacatcaacgccgccaagagcagcttcctgcccgaggacgagaagagagagctgctggacctgctgtacaaggcctacggcatgccccccagcgccagcgccggccagaacctgtag

SEQ ID NO: 72031 - DNA, 1731 bp, Artificial Sequence
  Description of Artificial Sequence: Synthetic coding sequence
atggccagcaacaaccactggttccagagcagccaggtgcccagcttcgcccagatgctgaagaagaacctgcccgtgcagcccgccaccaagaccatcaccacccccaccggctggagcagcgagagctacggcctgagcaagatggccagcaaggtgacccaggtgaccggcaacttccccgagcccctgctgagcaagaacctgagcagcatcagcaaccccgtgctgccccccaagaagatccccaaggagttcatcatgaagtacaagagaggcgagatcaaccccgtgagcgccctgcaccagttcgcccagatgcagagagtgcagctggacctgaaggagaccgtgaccaccggcaacgtgatgggcccctacttcgccttctgcgccgtggtggacggcatccagtacaagaccggcctgggccagaacaagaaggagagcagaagcaacgccgccaagctggccctggacgagctgctgcagctggacgagcccgagcccagaatcctggagaccagcggccccccccccttccccgccgagcccgtggtgctgagcgagctggcctacgtgagcaaggtgcactacgagggcagacacatccagtacgccaagatcagccagatcgtgaaggagagattcaaccagctgatcagcaacagaagcgagtacctgaagtacagcagcagcctggccgccttcatcatcgagagagccggccagcacgaggtggtggccatcggcaccggcgagtacaactacagccaggacatcaagcccgacggcagagtgctgcacgacacccacgccgtggtgaccgccagaagaagcctgctgagatacttctacagacagctgctgctgttctacagcaagaaccccgccatgatggagaagagcatcttctgcaccgagcccaccagcaacctgctgaccctgaagcagaacatcaacatctgcctgtacatgaaccagctgcccaagggcagcgcccagatcaagagccagctgagactgaacccccacagcatcagcgccttcgaggccaacgaggagctgtgcctgcacgtggccgtggagggcaagatctacctgaccgtgtactgccccaaggacggcgtgaacagaatcagcagcatgagcagcagcgacaagctgaccagatgggaggtgctgggcgtgcagggcgccctgctgagccacttcatccagcccgtgtacatcagcagcatcctgatcggcgacggcaactgcagcgacaccagaggcctggagatcgccatcaagcagagagtggacgacgccctgaccagcaagctgcccatgttctacctggtgaacagaccccacatcagcctggtgcccagcgcctaccccctgcagatgaacctggagtacaagttcctgagcctgaactgggcccagggcgacgtgagcctggagatcgtggacggcctgagcggcaagatcaccgagagcagccccttcaagagcggcatgagcatggccagcagactgtgcaaggccgccatgctgagcagattcaacctgctggccaaggaggccaagaaggagctgctggaggccggcacctaccacgccgccaagtgcatgagcgccagctaccaggaggccaagtgcaagctgaagagctacctgcagcagcacggctacggcagctggatcgtgaagagcccctgcatcgagcagttcaacatgtag

SEQ ID NO: 72032 - DNA, 1698 bp, Artificial Sequence
  Description of Artificial Sequence: Synthetic coding sequence
atggccagcaacaaccactggttccagagcagccaggtgcccagcttcgcccagatgctgaagaagaacctgcccgtgcagcccgccaccaagaccatcaccacccccaccggctggagcagcgagagctacggcctgagcaagatggccagcaaggtgacccaggtgaccggcaacttccccgagcccctgctgagcaagaacctgagcagcatcagcaaccccgtgctgccccccaagaagatccccaaggagttcatcatgaagtacaagagaggcgagatcaaccccgtgagcgccctgcaccagttcgcccagatgcagagagtgcagctggacctgaaggagaccgtgaccaccggcaacgtgatgggcccctacttcgccttctgcgccgtggtggacggcatccagtacaagaccggcctgggccagaacaagaaggagagcagaagcaacgccgccaagctggccctggacgagctgctgcagctggacgagcccgagcccagaatcctggagaccagcggccccccccccttccccgccgagcccgtggtgctgagcgagctggcctacgtgagcaaggtgcactacgagggcagacacatccagtacgccaagatcagccagatcgtgaaggagagattcaaccagctgatcagcaacagaagcgagtacctgaagtacagcagcagcctggccgccttcatcatcgagagagccggccagcacgaggtggtggccatcggcaccggcgagtacaactacagccaggacatcaagcccgacggcagagtgctgcacgacacccacgccgtggtgaccgccagaagaagcctgctgagcaagaaccccgccatgatggagaagagcatcttctgcaccgagcccaccagcaacctgctgaccctgaagcagaacatcaacatctgcctgtacatgaaccagctgcccaagggcagcgcccagatcaagagccagctgagactgaacccccacagcatcagcgccttcgaggccaacgaggagctgtgcctgcacgtggccgtggagggcaagatctacctgaccgtgtactgccccaaggacggcgtgaacagaatcagcagcatgagcagcagcgacaagctgaccagatgggaggtgctgggcgtgcagggcgccctgctgagccacttcatccagcccgtgtacatcagcagcatcctgatcggcgacggcaactgcagcgacaccagaggcctggagatcgccatcaagcagagagtggacgacgccctgaccagcaagctgcccatgttctacctggtgaacagaccccacatcagcctggtgcccagcgcctaccccctgcagatgaacctggagtacaagttcctgagcctgaactgggcccagggcgacgtgagcctggagatcgtggacggcctgagcggcaagatcaccgagagcagccccttcaagagcggcatgagcatggccagcagactgtgcaaggccgccatgctgagcagattcaacctgctggccaaggaggccaagaaggagctgctggaggccggcacctaccacgccgccaagtgcatgagcgccagctaccaggaggccaagtgcaagctgaagagctacctgcagcagcacggctacggcagctggatcgtgaagagcccctgcatcgagcagttcaacatgtag

SEQ ID NO: 72033 - DNA, 726 bp, Artificial Sequence
  Description of Artificial Sequence: Synthetic coding sequence
atggccagcaacaaccactggttccagagcagccaggtgcccagcttcgcccagatgctgaagaagaacctgcccgtgcagcccgccaccaagaccatcaccacccccaccggctggagcagcgagagctacggcctgagcaagatggccagcaaggtgacccaggtgaccggcaacttccccgagcccctgctgagcaagaacctgagcagcatcagcaaccccgtgctgccccccaagaagatccccaaggagttcatcatgaagtacaagagaggcgagatcaaccccgtgagcgccctgcaccagttcgcccagatgcagagagtgcagctggacctgaaggagaccgtgaccaccggcaacgtgatgggcccctacttcgccttctgcgccgtggtggacggcatccagtacaagaccggcctgggccagaacaagaaggagagcagaagcaacgccgccaagctggccctggacgagctgctgcagctggacgagcccgagcccagaatcctggagaccagcggccccccccccttccccgccgagcccgtggtgctgagcgagctggcctacgtgagcaaggtgcactacgagggcagacacatccagtacgccaagatcagccagatcgtgaaggagagattcaaccagctgatcagcaacagaagcgagtacctgaagtacagcagcagcctggccgccttcatcatcgagagatag

SEQ ID NO: 72034 - DNA, 471 bp, Artificial Sequence
  Description of Artificial Sequence: Synthetic coding sequence
atggccagcaacaaccactggttccagagcagccaggtgcccagcttcgcccagatgctgaagaagaacctgcccgtgcagcccgccaccaagaccatcaccacccccaccggctggagcagcgagagctacggcctgagcaagatggccagcaaggtgacccaggtgaccggcaacttccccgagcccctgctgagcaagaacctgagcagcatcagcaaccccgtgctgccccccaagaagatccccaaggagttcatcatgaagtacaagagaggcgagatcaaccccgtgagcgccctgcaccagttcgcccagatgcagagagtgcagctggacctgaaggagaccgtgaccaccggcaacgtgatgggcccctacttcgccttctgcgccgtggtggacggcatccagtacaagaccggcctgggccagaacaagaaggagagcagaagcaacgccgccaagtag

SEQ ID NO: 72035 - DNA, 1677 bp, Artificial Sequence
  Description of Artificial Sequence: Synthetic coding sequence
atgctgaagaagaacctgcccgtgcagcccgccaccaagaccatcaccacccccaccggctggagcagcgagagctacggcctgagcaagatggccagcaaggtgacccaggtgaccggcaacttccccgagcccctgctgagcaagaacctgagcagcatcagcaaccccgtgctgccccccaagaagatccccaaggagttcatcatgaagtacaagagaggcgagatcaaccccgtgagcgccctgcaccagttcgcccagatgcagagagtgcagctggacctgaaggagaccgtgaccaccggcaacgtgatgggcccctacttcgccttctgcgccgtggtggacggcatccagtacaagaccggcctgggccagaacaagaaggagagcagaagcaacgccgccaagctggccctggacgagctgctgcagctggacgagcccgagcccagaatcctggagaccagcggccccccccccttccccgccgagcccgtggtgctgagcgagctggcctacgtgagcaaggtgcactacgagggcagacacatccagtacgccaagatcagccagatcgtgaaggagagattcaaccagctgatcagcaacagaagcgagtacctgaagtacagcagcagcctggccgccttcatcatcgagagagccggccagcacgaggtggtggccatcggcaccggcgagtacaactacagccaggacatcaagcccgacggcagagtgctgcacgacacccacgccgtggtgaccgccagaagaagcctgctgagatacttctacagacagctgctgctgttctacagcaagaaccccgccatgatggagaagagcatcttctgcaccgagcccaccagcaacctgctgaccctgaagcagaacatcaacatctgcctgtacatgaaccagctgcccaagggcagcgcccagatcaagagccagctgagactgaacccccacagcatcagcgccttcgaggccaacgaggagctgtgcctgcacgtggccgtggagggcaagatctacctgaccgtgtactgccccaaggacggcgtgaacagaatcagcagcatgagcagcagcgacaagctgaccagatgggaggtgctgggcgtgcagggcgccctgctgagccacttcatccagcccgtgtacatcagcagcatcctgatcggcgacggcaactgcagcgacaccagaggcctggagatcgccatcaagcagagagtggacgacgccctgaccagcaagctgcccatgttctacctggtgaacagaccccacatcagcctggtgcccagcgcctaccccctgcagatgaacctggagtacaagttcctgagcctgaactgggcccagggcgacgtgagcctggagatcgtggacggcctgagcggcaagatcaccgagagcagccccttcaagagcggcatgagcatggccagcagactgtgcaaggccgccatgctgagcagattcaacctgctggccaaggaggccaagaaggagctgctggaggccggcacctaccacgccgccaagtgcatgagcgccagctaccaggaggccaagtgcaagctgaagagctacctgcagcagcacggctacggcagctggatcgtgaagagcccctgcatcgagcagttcaacatgtag

SEQ ID NO: 72036 - DNA, 3810 bp, Artificial Sequence
  Description of Artificial Sequence: Synthetic coding sequence
atgatgagccccatctgcgaccagaccatcgacagcagactgaaggtggagaaggccacctggtggggcagagtgggcggcggcagcagaccccactggcagagccccggcgtgagaccctgccccgaggaggtgcaggaccccggctacagcctgagcggctactacacccaccccttccagggctacgagcacagacagctgagataccagcagcccggccccggcagcagccccagcagcttcctgctgaagcagatcgagttcctgaagggccagctgcccgaggcccccgtgatcggcaagcagacccccagcctgccccccagcctgcccggcctgagacccagattccccgtgctgctggccagcagcaccagaggcagacaggtggacatcagaggcgtgcccagaggcgtgcacctgagaagccagggcctgcagagaggcttccagcaccccagccccagaggcagaagcctgccccagagaggcgtggactgcctgagcagccacttccaggagctgagcatctaccaggaccaggagcagagaatcctgaagttcctggaggagctgggcgagggcaaggccaccaccgcccacgacctgagcggcaagctgggcacccccaagaaggagatcaacagagtgctgtacagcctggccaagaagggcaagctgcagaaggaggccggcaccccccccctgtggaagatcgccgtgagcacccaggcctggaaccagcacagcggcgtggtgagacccgacggccacagccagggcgcccccaacagcgaccccagcctggagcccgaggacagaaacagcaccagcgtgagcgaggacctgctggagcccttcatcgccgtgagcgcccaggcctggaaccagcacagcggcgtggtgagacccgacagccacagccagggcagccccaacagcgaccccggcctggagcccgaggacagcaacagcaccagcgccctggaggaccccctggagttcctggacatggccgagatcaaggagaagatctgcgactacctgttcaacgtgagcgacagcagcgccctgaacctggccaagaacatcggcctgaccaaggccagagacatcaacgccgtgctgatcgacatggagagacagggcgacgtgtacagacagggcaccaccccccccatctggcacctgaccgacaagaagagagagagaatgcagatcaagagaaacaccaacagcgtgcccgagaccgcccccgccgccatccccgagaccaagagaaacgccgagttcctgacctgcaacatccccaccagcaacgccagcaacaacatggtgaccaccgagaaggtggagaacggccaggagcccgtgatcaagctggagaacagacaggaggccagacccgagcccgccagactgaagccccccgtgcactacaacggccccagcaaggccggctacgtggacttcgagaacggccagtgggccaccgacgacatccccgacgacctgaacagcatcagagccgcccccggcgagttcagagccatcatggagatgcccagcttctacagccacggcctgcccagatgcagcccctacaagaagctgaccgagtgccagctgaagaaccccatcagcggcctgctggagtacgcccagttcgccagccagacctgcgagttcaacatgatcgagcagagcggccccccccacgagcccagattcaagttccaggtggtgatcaacggcagagagttcccccccgccgaggccggcagcaagaaggtggccaagcaggacgccgccatgaaggccatgaccatcctgctggaggaggccaaggccaaggacagcggcaagagcgaggagagcagccactacagcaccgagaaggagagcgagaagaccgccgagagccagacccccacccccagcgccaccagcttcttcagcggcaagagccccgtgaccaccctgctggagtgcatgcacaagctgggcaacagctgcgagttcagactgctgagcaaggagggccccgcccacgagcccaagttccagtactgcgtggccgtgggcgcccagaccttccccagcgtgagcgcccccagcaagaaggtggccaagcagatggccgccgaggaggccatgaaggccctgcacggcgaggccaccaacagcatggccagcgacaaccagcccgagggcatgatcagcgagagcctggacaacctggagagcatgatgcccaacaaggtgagaaagatcggcgagctggtgagatacctgaacaccaaccccgtgggcggcctgctggagtacgccagaagccacggcttcgccgccgagttcaagctggtggaccagagcggccccccccacgagcccaagttcgtgtaccaggccaaggtgggcggcagatggttccccgccgtgtgcgcccacagcaagaagcagggcaagcaggaggccgccgacgccgccctgagagtgctgatcggcgagaacgagaaggccgagagaatgggcttcaccgaggtgacccccgtgaccggcgccagcctgagaagaaccatgctgctgctgagcagaagccccgaggcccagcccaagaccctgcccctgaccggcagcaccttccacgaccagatcgccatgctgagccacagatgcttcaacaccctgaccaacagcttccagcccagcctgctgggcagaaagatcctggccgccatcatcatgaagaaggacagcgaggacatgggcgtggtggtgagcctgggcaccggcaacagatgcgtgaagggcgacagcctgagcctgaagggcgagaccgtgaacgactgccacgccgagatcatcagcagaagaggcttcatcagattcctgtacagcgagctgatgaagtacaacagccagaccgccaaggacagcatcttcgagcccgccaagggcggcgagaagctgcagatcaagaagaccgtgagcttccacctgtacatcagcaccgccccctgcggcgacggcgccctgttcgacaagagctgcagcgacagagccatggagagcaccgagagcagacactaccccgtgttcgagaaccccaagcagggcaagctgagaaccaaggtggagaacggcgagggcaccatccccgtggagagcagcgacatcgtgcccacctgggacggcatcagactgggcgagagactgagaaccatgagctgcagcgacaagatcctgagatggaacgtgctgggcctgcagggcgccctgctgacccacttcctgcagcccatctacctgaagagcgtgaccctgggctacctgttcagccagggccacctgaccagagccatctgctgcagagtgaccagagacggcagcgccttcgaggacggcctgagacaccccttcatcgtgaaccaccccaaggtgggcagagtgagcatctacgacagcaagagacagagcggcaagaccaaggagaccagcgtgaactggtgcctggccgacggctacgacctggagatcctggacggcaccagaggcaccgtggacggccccagaaacgagctgagcagagtgagcaagaagaacatcttcctgctgttcaagaagctgtgcagcttcagatacagaagagacctgctgagactgagctacggcgaggccaagaaggccgccagagactacgagaccgccaagaactacttcaagaagggcctgaaggacatgggctacggcaactggatcagcaagccccaggaggagaagaacttctacctgtgccccgtgtag

SEQ ID NO: 72037 - DNA, 159 bp, Artificial Sequence
  Description of Artificial Sequence: Synthetic coding sequence
atggccaacgagcacaccctgatccaccccgccagcatcgaggaccccctggaggccagacccatgagcgacgaggaccccgaggacgaggacgccctgcccgccagatggaagaaggagatgggcagaaagagaaagagaaccatcgccaccctgtag

SEQ ID NO: 72038 - DNA, 2106 bp, Artificial Sequence
  Description of Artificial Sequence: Synthetic coding sequence
atggacatcgaggacgaggagaacatgagcagcagcagcaccgacgtgaaggagaacagaaacctggacaacgtgagccccaaggacggcagcacccccggccccggcgagggcagccagctgagcaacggcggcggcggcggccccggcagaaagagacccctggaggagggcagcaacggccacagcaagtacagactgaagaagagaagaaagacccccggccccgtgctgcccaagaacgccctgatgcagctgaacgagatcaagcccggcctgcagtacaccctgctgagccagaccggccccgtgcacgcccccctgttcgtgatgagcgtggaggtgaacggccaggtgttcgagggcagcggccccaccaagaagaaggccaagctgcacgccgccgagaaggccctgagaagcttcgtgcagttccccaacgccagcgaggcccacctggccatgggcagaaccctgagcgtgaacaccgacttcaccagcgaccaggccgacttccccgacaccctgttcaacggcttcgagacccccgacaaggccgagccccccttctacgtgggcagcaacggcgacgacagcttcagcagcagcggcgacctgagcctgagcgccagccccgtgcccgccagcctggcccagccccccctgcccgtgctgccccccttccccccccccagcggcaagaaccccgtgatgatcctgaacgagctgagacccggcctgaagtacgacttcctgagcgagagcggcgagagccacgccaagagcttcgtgatgagcgtggtggtggacggccagttcttcgagggcagcggcagaaacaagaagctggccaaggccagagccgcccagagcgccctggccgccatcttcaacctgcacctggaccagacccccagcagacagcccatccccagcgagggcctgcagctgcacctgccccaggtgctggccgacgccgtgagcagactggtgctgggcaagttcggcgacctgaccgacaacttcagcagcccccacgccagaagaaaggtgctggccggcgtggtgatgaccaccggcaccgacgtgaaggacgccaaggtgatcagcgtgagcaccggcaccaagtgcatcaacggcgagtacatgagcgacagaggcctggccctgaacgactgccacgccgagatcatcagcagaagaagcctgctgagattcctgtacacccagctggagctgtacctgaacaacaaggacgaccagaagagaagcatcttccagaagagcgagagaggcggcttcagactgaaggagaacgtgcagttccacctgtacatcagcaccagcccctgcggcgacgccagaatcttcagcccccacgagcccatcctggaggagcccgccgacagacaccccaacagaaaggccagaggccagctgagaaccaagatcgagagcggcgagggcaccatccccgtgagaagcaacgccagcatccagacctgggacggcgtgctgcagggcgagagactgctgaccatgagctgcagcgacaagatcgccagatggaacgtggtgggcatccagggcagcctgctgagcatcttcgtggagcccatctacttcagcagcatcatcctgggcagcctgtaccacggcgaccacctgagcagagccatgtaccagagaatcagcaacatcgaggacctgccccccctgtacaccctgaacaagcccctgctgagcggcatcagcaacgccgaggccagacagcccggcaaggcccccaacttcagcgtgaactggaccgtgggcgacagcgccatcgaggtgatcaacgccaccaccggcaaggacgagctgggcagagccagcagactgtgcaagcacgccctgtactgcagatggatgagagtgcacggcaaggtgcccagccacctgctgagaagcaagatcaccaagcccaacgtgtaccacgagagcaagctggccgccaaggagtaccaggccgccaaggccagactgttcaccgccttcatcaaggccggcctgggcgcctgggtggagaagcccaccgagcaggaccagttcagcctgaccccctag

SEQ ID NO: 72039 - DNA, 2226 bp, Artificial Sequence
  Description of Artificial Sequence: Synthetic coding sequence
atggacatcgaggacgaggagaacatgagcagcagcagcaccgacgtgaaggagaacagaaacctggacaacgtgagccccaaggacggcagcacccccggccccggcgagggcagccagctgagcaacggcggcggcggcggccccggcagaaagagacccctggaggagggcagcaacggccacagcaagtacagactgaagaagagaagaaagacccccggccccgtgctgcccaagaacgccctgatgcagctgaacgagatcaagcccggcctgcagtacaccctgctgagccagaccggccccgtgcacgcccccctgttcgtgatgagcgtggaggtgaacggccaggtgttcgagggcagcggccccaccaagaagaaggccaagctgcacgccgccgagaaggccctgagaagcttcgtgcagttccccaacgccagcgaggcccacctggccatgggcagaaccctgagcgtgaacaccgacttcaccagcgaccaggccgacttccccgacaccctgttcaacggcttcgagacccccgacaaggccgagccccccttctacgtgggcagcaacggcgacgacagcttcagcagcagcggcgacctgagcctgagcgccagccccgtgcccgccagcctggcccagccccccctgcccgtgctgccccccttccccccccccagcggcaagaaccccgtgatgatcctgaacgagctgagacccggcctgaagtacgacttcctgagcgagagcggcgagagccacgccaagagcttcgtgatgagcgtggtggtggacggccagttcttcgagggcagcggcagaaacaagaagctggccaaggccagagccgcccagagcgccctggccgccatcttcaacctgcacctggaccagacccccagcagacagcccatccccagcgagggcctgcagctgcacctgccccaggtgctggccgacgccgtgagcagactggtgctgggcaagttcggcgacctgaccgacaacttcagcagcccccacgccagaagaaaggtgctggccggcgtggtgatgaccaccggcaccgacgtgaaggacgccaaggtgatcagcgtgagcaccggcaccaagtgcatcaacggcgagtacatgagcgacagaggcctggccctgaacgactgccacgccgagatcatcagcagaagaagcctgctgagattcctgtacacccagctggagctgtacctgaacaacaaggacgaccagaagagaagcatcttccagaagagcgagagaggcggcttcagactgaaggagaacgtgcagttccacctgtacatcagcaccagcccctgcggcgacgccagaatcttcagcccccacgagcccatcctggagggcagcagaagctacacccaggccggcgtgcagtggtgcaaccacggcagcctgcagcccagaccccccggcctgctgagcgaccccagcaccagcaccttccagggcgccggcaccaccgagcccgccgacagacaccccaacagaaaggccagaggccagctgagaaccaagatcgagagcggcgagggcaccatccccgtgagaagcaacgccagcatccagacctgggacggcgtgctgcagggcgagagactgctgaccatgagctgcagcgacaagatcgccagatggaacgtggtgggcatccagggcagcctgctgagcatcttcgtggagcccatctacttcagcagcatcatcctgggcagcctgtaccacggcgaccacctgagcagagccatgtaccagagaatcagcaacatcgaggacctgccccccctgtacaccctgaacaagcccctgctgagcggcatcagcaacgccgaggccagacagcccggcaaggcccccaacttcagcgtgaactggaccgtgggcgacagcgccatcgaggtgatcaacgccaccaccggcaaggacgagctgggcagagccagcagactgtgcaagcacgccctgtactgcagatggatgagagtgcacggcaaggtgcccagccacctgctgagaagcaagatcaccaagcccaacgtgtaccacgagagcaagctggccgccaaggagtaccaggccgccaaggccagactgttcaccgccttcatcaaggccggcctgggcgcctgggtggagaagcccaccgagcaggaccagttcagcctgaccccctag

SEQ ID NO: 72040 - DNA, 2145 bp, Artificial Sequence
  Description of Artificial Sequence: Synthetic coding sequence
atggacatcgaggacgaggagaacatgagcagcagcagcaccgacgtgaaggagaacagaaacctggacaacgtgagccccaaggacggcagcacccccggccccggcgagggcagccagctgagcaacggcggcggcggcggccccggcagaaagagacccctggaggagggcagcaacggccacagcaagtacagactgaagaagagaagaaagacccccggccccgtgctgcccaagaacgccctgatgcagctgaacgagatcaagcccggcctgcagtacaccctgctgagccagaccggccccgtgcacgcccccctgttcgtgatgagcgtggaggtgaacggccaggtgttcgagggcagcggccccaccaagaagaaggccaagctgcacgccgccgagaaggccctgagaagcttcgtgcagttccccaacgccagcgaggcccacctggccatgggcagaaccctgagcgtgaacaccgacttcaccagcgaccaggccgacttccccgacaccctgttcaacggcttcgagacccccgacaaggccgagccccccttctacgtgggcagcaacggcgacgacagcttcagcagcagcggcgacctgagcctgagcgccagccccgtgcccgccagcctggcccagccccccctgcccgtgctgccccccttccccccccccagcggcaagaaccccgtgatgatcctgaacgagctgagacccggcctgaagtacgacttcctgagcgagagcggcgagagccacgccaagagcttcgtgatgagcgtggtggtggacggccagttcttcgagggcagcggcagaaacaagaagctggccaaggccagagccgcccagagcgccctggccgccatcttcaacctgcacctggaccagacccccagcagacagcccatccccagcgagggcctgcagctgcacctgccccaggtgctggccgacgccgtgagcagactggtgctgggcaagttcggcgacctgaccgacaacttcagcagcccccacgccagaagaaaggtgctggccggcgtggtgatgaccaccggcaccgacgtgaaggacgccaaggtgatcagcgtgagcaccggcaccaagtgcatcaacggcgagtacatgagcgacagaggcctggccctgaacgactgccacgccgagatcatcagcagaagaagcctgctgagattcctgtacacccagctggagctgtacctgaacaacaaggacgaccagaagagaagcatcttccagaagagcgagagaggcggcttcagactgaaggagaacgtgcagttccacctgtacatcagcaccagcccctgcggcgacgccagaatcttcagcccccacgagcccatcctggagggcagcagaagctacacccaggccggcgtgcagtggtgcaaccacggcagcctgcagcccagaccccccggcctgctgagcgaccccagcaccagcaccttccagggcgccggcaccaccgagcccgccgacagacaccccaacagaaaggccagaggccagctgagaaccaagatcgagagcggcgagggcaccatccccgtgagaagcaacgccagcatccagacctgggacggcgtgctgcagggcgagagactgctgaccatgagctgcagcgacaagatcgccagatggaacgtggtgggcatccagggcagcctgctgagcatcttcgtggagcccatctacttcagcagcatcatcctgggcagcctgtaccacggcgaccacctgagcagagccatgtaccagagaatcagcaacatcgaggacctgccccccctgtacaccctgaacaagcccctgctgagcggcatcagcaacgccgaggccagacagcccggcaaggcccccaacttcagcgtgaactggaccgtgggcgacagcgccatcgaggtgatcaacgccaccaccggcaaggacgagctgggcagagccagcagactgtgcaagcacgccctgtactgcagatggatgagagtgcacggcaaggtgcccagccacctgctgagaagcaagatcaccaagcccaacgtgtaccacgagagcaagctggccgccaaggagtaccaggccgccaaggtgcactag

SEQ ID NO: 72041 - DNA, 39 bp, Artificial Sequence
  Description of Artificial Sequence: Synthetic coding sequence
atggacatcgaggacgaggagaacatgagcttcagctag

SEQ ID NO: 72042 - DNA, 426 bp, Artificial Sequence
  Description of Artificial Sequence: Synthetic coding sequence
atggacatcgaggacgaggagaacatgagcagcagcagcaccgacgtgaaggagaacagaaacctggacaacgtgagccccaaggacggcagcacccccggccccggcgagggcagccagctgagcaacggcggcggcggcggccccggcagaaagagacccctggaggagggcagcaacggccacagcaagtacagactgaagaagagaagaaagacccccggccccgtgctgcccaagaacgccctgatgcagctgaacgagatcaagcccggcctgcagtacaccctgctgagccagaccggccccgtgcacgcccccctgttcgtgatgagcgtggaggtgaacggccaggtgttcgagggcagcggccccaccaagaagaaggccaagctgcacgccgccgagaaggccctgagaagctag

SEQ ID NO: 72043 - DNA, 2226 bp, Artificial Sequence; identical to SEQ ID NO: 72039
  Description of Artificial Sequence: Synthetic coding sequence

SEQ ID NO: 72044 - DNA, 2226 bp, Artificial Sequence; identical to SEQ ID NO: 72039
  Description of Artificial Sequence: Synthetic coding sequence

SEQ ID NO: 72045 - DNA, 2097 bp, Artificial Sequence
  Description of Artificial Sequence: Synthetic coding sequence
atggacatcgaggacgaggagaacatgagcagcagcagcaccgacgtgaaggagaacagaaacctggacaacgtgagccccaaggacggcagcacccccggccccggcgagggcagccagctgagcaacggcggcggcggcggccccggcagaaagagacccctggaggagggcagcaacggccacagcaagtacagactgaagaagagaagaaagacccccggccccgtgctgcccaagaacgccctgatgcagctgaacgagatcaagcccggcctgcagtacaccctgctgagccagaccggccccgtgcacgcccccctgttcgtgatgagcgtggaggtgaacggccaggtgttcgagggcagcggccccaccaagaagaaggccaagctgcacgccgccgagaaggccctgagaagcttcgtgcagttccccaacgccagcgaggcccacctggccatgggcagaaccctgagcgtgaacaccgacttcaccagcgaccaggccgacttccccgacaccctgttcaacggcttcgagacccccgacaaggccgagccccccttctacgtgggcagcaacggcgacgacagcttcagcagcagcggcgacctgagcctgagcgccagccccgtgcccgccagcctggcccagccccccctgcccgtgctgccccccttccccccccccagcggcaagaaccccgtgatgatcctgaacgagctgagacccggcctgaagtacgacttcctgagcgagagcggcgagagccacgccaagagcttcgtgatgagcgtggtggtggacggccagttcttcgagggcagcggcagaaacaagaagctggccaaggccagagccgcccagagcgccctggccgccatcttcaacctgcacctggaccagacccccagcagacagcccatccccagcgagggcctgcagctgcacctgccccaggtgctggccgacgccgtgagcagactggtgctgggcaagttcggcgacctgaccgacaacttcagcagcccccacgccagaagaaaggtgctggccggcgtggtgatgaccaccggcaccgacgtgaaggacgccaaggtgatcagcgtgagcaccggcaccaagtgcatcaacggcgagtacatgagcgacagaggcctggccctgaacgactgccacgccgagatcatcagcagaagaagcctgctgagattcctgtacacccagctggagctgtacctgaacaacaaggacgaccagaagagaagcatcttccagaagagcgagagaggcggcttcagactgaaggagaacgtgcagttccacctgtacatcagcaccagcccctgcggcgacgccagaatcttcagcccccacgagcccatcctggagggcagcagaagctacacccaggccggcgtgcagtggtgcaaccacggcagcctgcagcccagaccccccggcctgctgagcgaccccagcaccagcaccttccagggcgccggcaccaccgagcccgccgacagacaccccaacagaaaggccagaggccagctgagaaccaagatcgagagcggcgagggcaccatccccgtgagaagcaacgccagcatccagacctgggacggcgtgctgcagggcgagagactgctgaccatgagctgcagcgacaagatcgccagatggaacgtggtgggcatccagggcagcctgctgagcatcttcgtggagcccatctacttcagcagcatcatcctgggcagcctgtaccacggcgaccacctgagcagagccatgtaccagagaatcagcaacatcgaggacctgccccccctgtacaccctgaacaagcccctgctgagcggcatcagcaacgccgaggccagacagcccggcaaggcccccaacttcagcgtgaactggaccgtgggcgacagcgccatcgaggtgatcaacgccaccaccggcaaggacgagctgggcagagccagcagactgtgcaagcacgccctgtactgcagatgggcctgcgccagacagggcagcctgcccctgaccaccctgcaggactaccaggcccagagagtgccctag

SEQ ID NO: 72046 - DNA, 426 bp, Artificial Sequence
  Description of Artificial Sequence: Synthetic coding sequence
atgagccacagaatggagggcgtgggccagctgcccgccagctacagacacaacagacccctgctgagcggcgtgagcgacgccgaggccagacagcccggcaagagcccccccttcagcatgaactgggtggtgggcagcgccgacctggagatcatcaacgccaccaccggcagaagaagctgcggcggccccagcagactgtgcaagcacgtgctgagcgccagatgggccagactgtacggcagactgagcaccagaacccccagccccggcgacacccccagcatgtactgcgaggccaagctgggcgcccacacctaccagagcgtgaagcagcagctgttcaaggccttccagaaggccggcctgggcacctgggtgagaaagccccccgagcagcagcagttcctgctgaccctgtag

SEQ ID NO: 72047 - DNA, 747 bp, Artificial Sequence
  Description of Artificial Sequence: Synthetic coding sequence
atgggcctgtggagccccgtgcccggcaacagcgtgcccagagcccccgtgatggccggcctgggcctgggccacagccagggcgccccccagggcccccacgacggcaagaccgacagaagcagcggccccggcagaagaagaaccgagagaaccagactgcccggcctgctgggcggcgcccccctgaccgccggcagcccccacagatggaacgtgctgggcctgcagggcgccctgctgagccacttcgtggagcccgtgtacctgcagagcatcgtggtgggcagcctgcaccacaccggccacctggccagagtgatgagccacagaatggagggcgtgggccagctgcccgccagctacagacacaacagacccctgctgagcggcgtgagcgacgccgaggccagacagcccggcaagagcccccccttcagcatgaactgggtggtgggcagcgccgacctggagatcatcaacgccaccaccggcagaagaagctgcggcggccccagcagactgtgcaagcacgtgctgagcgccagatgggccagactgtacggcagactgagcaccagaacccccagccccggcgacacccccagcatgtactgcgaggccaagctgggcgcccacacctaccagagcgtgaagcagcagctgttcaaggccttccagaaggccggcctgggcacctgggtgagaaagccccccgagcagcagcagttcctgctgaccctgtag

SEQ ID NO: 72048 - DNA, 2220 bp, Artificial Sequence
  Description of Artificial Sequence: Synthetic coding sequence
atggccagcgtgctgggcagcggcagaggcagcggcggcctgagcagccagctgaagtgcaagagcaagagaagaagaagaagaagaagcaagagaaaggacaaggtgagcatcctgagcaccttcctggcccccttcaagcacctgagccccggcatcaccaacaccgaggacgacgacaccctgagcaccagcagcgccgaggtgaaggagaacagaaacgtgggcaacctggccgccagacccccccccagcggcgacagagccagaggcggcgcccccggcgccaagagaaagagacccctggaggagggcaacggcggccacctgtgcaagctgcagctggtgtggaagaagctgagctggagcgtggcccccaagaacgccctggtgcagctgcacgagctgagacccggcctgcagtacagaaccgtgagccagaccggccccgtgcacgcccccgtgttcgccgtggccgtggaggtgaacggcctgaccttcgagggcaccggccccaccaagaagaaggccaagatgagagccgccgagctggccctgagaagcttcgtgcagttccccaacgcctgccaggcccacctggccatgggcggcggccccggccccggcaccgacttcaccagcgaccaggccgacttccccgacaccctgttccaggagttcgagccccccgcccccagacccggcctggccggcggcagacccggcgacgccgccctgctgagcgccgcctacggcagaagaagactgctgtgcagagccctggacctggtgggccccacccccgccacccccgccgcccccggcgagagaaaccccgtggtgctgctgaacagactgagagccggcctgagatacgtgtgcctggccgagcccgccgagagaagagccagaagcttcgtgatggccgtgagcgtggacggcagaaccttcgagggcagcggcagaagcaagaagctggccagaggccaggccgcccaggccgccctgcaggagctgttcgacatccagatgcccggccacgcccccggcagagccagaagaacccccatgccccaggagttcgccgacagcatcagccagctggtgacccagaagttcagagaggtgaccaccgacctgacccccatgcacgccagacacaaggccctggccggcatcgtgatgaccaagggcctggacgccagacaggcccaggtggtggccctgagcagcggcaccaagtgcatcagcggcgagcacctgagcgaccagggcctggtggtgaacgactgccacgccgaggtggtggccagaagagccttcctgcacttcctgtacacccagctggagctgcacctgagcaagagaagagaggacagcgagagaagcatcttcgtgagactgaaggagggcggctacagactgagagagaacatcctgttccacctgtacgtgagcaccagcccctgcggcgacgccagactgcacagcccctacgagatcaccaccgacctgcacagcagcaagcacctggtgagaaagttcagaggccacctgagaaccaagatcgagagcggcgagggcaccgtgcccgtgagaggccccagcgccgtgcagacctgggacggcgtgctgctgggcgagcagctgatcaccatgagctgcaccgacaagatcgccagatggaacgtgctgggcctgcagggcgccctgctgagccacttcgtggagcccgtgtacctgcagagcatcgtggtgggcagcctgcaccacaccggccacctggccagagtgatgagccacagaatggagggcgtgggccagctgcccgccagctacagacacaacagacccctgctgagcggcgtgagcgacgccgaggccagacagcccggcaagagcccccccttcagcatgaactgggtggtgggcagcgccgacctggagatcatcaacgccaccaccggcagaagaagctgcggcggccccagcagactgtgcaagcacgtgctgagcgccagatgggccagactgtacggcagactgagcaccagaacccccagccccggcgacacccccagcatgtactgcgaggccaagctgggcgcccacacctaccagagcgtgaagcagcagctgttcaaggccttccagaaggccggcctgggcacctgggtgagaaagccccccgagcagcagcagttcctgctgaccctgtag

SEQ ID NO: 72049 - DNA, 1509 bp, Artificial Sequence
  Description of Artificial Sequence: Synthetic coding sequence
atgtggaccgccgacgagatcgcccagctgtgctacgagcactacggcatcagactgcccaagaagggcaagcccgagcccaaccacgagtggaccctgctggccgccgtggtgaagatccagagccccgccgacaaggcctgcgacacccccgacaagcccgtgcaggtgaccaaggaggtggtgagcatgggcaccggcaccaagtgcatcggccagagcaagatgagaaagaacggcgacatcctgaacgacagccacgccgaggtgatcgccagaagaagcttccagagatacctgctgcaccagctgcagctggccgccaccctgaaggaggacagcatcttcgtgcccggcacccagaagggcgtgtggaagctgagaagagacctgatcttcgtgttcttcagcagccacaccccctgcggcgacgccagcatcatccccatgctggagttcgaggaccagccctgctgccccgtgttcagaaactgggcccacaacagcagcgtggaggccagcagcaacctggaggcccccggcaacgagagaaagtgcgaggaccccgacagccccgtgaccaagaagatgagactggagcccggcaccgccgccagagaggtgaccaacggcgccgcccaccaccagagcttcggcaagcagaagagcggccccatcagccccggcatccacagctgcgacctgaccgtggagggcctggccaccgtgaccagaatcgcccccggcagcgccaaggtgatcgacgtgtacagaaccggcgccaagtgcgtgcccggcgaggccggcgacagcggcaagcccggcgccgccttccaccaggtgggcctgctgagagtgaagcccggcagaggcgacagaaccagaagcatgagctgcagcgacaagatggccagatggaacgtgctgggctgccagggcgccctgctgatgcacctgctggaggagcccatctacctgagcgccgtggtgatcggcaagtgcccctacagccaggaggccatgcagagagccctgatcggcagatgccagaacgtgagcgccctgcccaagggcttcggcgtgcaggagctgaagatcctgcagagcgacctgctgttcgagcagagcagaagcgccgtgcaggccaagagagccgacagccccggcagactggtgccctgcggcgccgccatcagctggagcgccgtgcccgagcagcccctggacgtgaccgccaacggcttcccccagggcaccaccaagaagaccatcggcagcctgcaggccagaagccagatcagcaaggtggagctgttcagaagcttccagaagctgctgagcagaatcgccagagacaagtggccccacagcctgagagtgcagaagctggacacctaccaggagtacaaggaggccgccagcagctaccaggaggcctggagcaccctgagaaagcaggtgttcggcagctggatcagaaacccccccgactaccaccagttcaagtag

SEQ ID NO: 72050 - DNA, 1422 bp, Artificial Sequence
  Description of Artificial Sequence: Synthetic coding sequence
atgtggaccctgctggccgccgtggtgaagatccagagccccgccgacaaggcctgcgacacccccgacaagcccgtgcaggtgaccaaggaggtggtgagcatgggcaccggcaccaagtgcatcggccagagcaagatgagaaagaacggcgacatcctgaacgacagccacgccgaggtgatcgccagaagaagcttccagagatacctgctgcaccagctgcagctggccgccaccctgaaggaggacagcatcttcgtgcccggcacccagaagggcgtgtggaagctgagaagagacctgatcttcgtgttcttcagcagccacaccccctgcggcgacgccagcatcatccccatgctggagttcgaggaccagccctgctgccccgtgttcagaaactgggcccacaacagcagcgtggaggccagcagcaacctggaggcccccggcaacgagagaaagtgcgaggaccccgacagccccgtgaccaagaagatgagactggagcccggcaccgccgccagagaggtgaccaacggcgccgcccaccaccagagcttcggcaagcagaagagcggccccatcagccccggcatccacagctgcgacctgaccgtggagggcctggccaccgtgaccagaatcgcccccggcagcgccaaggtgatcgacgtgtacagaaccggcgccaagtgcgtgcccggcgaggccggcgacagcggcaagcccggcgccgccttccaccaggtgggcctgctgagagtgaagcccggcagaggcgacagaaccagaagcatgagctgcagcgacaagatggccagatggaacgtgctgggctgccagggcgccctgctgatgcacctgctggaggagcccatctacctgagcgccgtggtgatcggcaagtgcccctacagccaggaggccatgcagagagccctgatcggcagatgccagaacgtgagcgccctgcccaagggcttcggcgtgcaggagctgaagatcctgcagagcgacctgctgttcgagcagagcagaagcgccgtgcaggccaagagagccgacagccccggcagactggtgccctgcggcgccgccatcagctggagcgccgtgcccgagcagcccctggacgtgaccgccaacggcttcccccagggcaccaccaagaagaccatcggcagcctgcaggccagaagccagatcagcaaggtggagctgttcagaagcttccagaagctgctgagcagaatcgccagagacaagtggccccacagcctgagagtgcagaagctggacacctaccaggagtacaaggaggccgccagcagctaccaggaggcctggagcaccctgagaaagcaggtgttcggcagctggatcagaaacccccccgactaccaccagttcaagtag

SEQ ID NO: 72051 - DNA, 1089 bp, Artificial Sequence
  Description of Artificial Sequence: Synthetic coding sequence
atggccgccgccgaggaggagcccaagcccaagaagctgaaggtggaggccccccaggccctgagagagaacatcctgttcggcatgggcaaccccctgctggacatcagcgccgtggtggacaaggacttcctggacaagtacagcctgaagcccaacgaccagatcctggccgaggacaagcacaaggagctgttcgacgagctggtgaagaagttcaaggtggagtaccacgccggcggcagcacccagaacagcatcaaggtggcccagtggatgatccagcagccccacaaggccgccaccttcttcggctgcatcggcatcgacaagttcggcgagatcctgaagagaaaggccgccgaggcccacgtggacgcccactactacgagcagaacgagcagcccaccggcacctgcgccgcctgcatcaccggcgacaacagaagcctgatcgccaacctggccgccgccaactgctacaagaaggagaagcacctggacctggagaagaactggatgctggtggagaaggccagagtgtgctacatcgccggcttcttcctgaccgtgagccccgagagcgtgctgaaggtggcccaccacgccagcgagaacaacagaatcttcaccctgaacctgagcgcccccttcatcagccagttctacaaggagagcctgatgaaggtgatgccctacgtggacatcctgttcggcaacgagaccgaggccgccaccttcgccagagagcagggcttcgagaccaaggacatcaaggagatcgccaagaagacccaggccctgcccaagatgaacagcaagagacagagaatcgtgatcttcacccagggcagagacgacaccatcatggccaccgagagcgaggtgaccgccttcgccgtgctggaccaggaccagaaggagatcatcgacaccaacggcgccggcgacgccttcgtgggcggcttcctgagccagctggtgagcgacaagcccctgaccgagtgcatcagagccggccactacgccgccagcatcatcatcagaagaaccggctgcaccttccccgagaagcccgacttccactag

SEQ ID NO: 72052 - DNA, 1038 bp, Artificial Sequence
  Description of Artificial Sequence: Synthetic coding sequence
atgaccagcgtgagagagaacatcctgttcggcatgggcaaccccctgctggacatcagcgccgtggtggacaaggacttcctggacaagtacagcctgaagcccaacgaccagatcctggccgaggacaagcacaaggagctgttcgacgagctggtgaagaagttcaaggtggagtaccacgccggcggcagcacccagaacagcatcaaggtggcccagtggatgatccagcagccccacaaggccgccaccttcttcggctgcatcggcatcgacaagttcggcgagatcctgaagagaaaggccgccgaggcccacgtggacgcccactactacgagcagaacgagcagcccaccggcacctgcgccgcctgcatcaccggcgacaacagaagcctgatcgccaacctggccgccgccaactgctacaagaaggagaagcacctggacctggagaagaactggatgctggtggagaaggccagagtgtgctacatcgccggcttcttcctgaccgtgagccccgagagcgtgctgaaggtggcccaccacgccagcgagaacaacagaatcttcaccctgaacctgagcgcccccttcatcagccagttctacaaggagagcctgatgaaggtgatgccctacgtggacatcctgttcggcaacgagaccgaggccgccaccttcgccagagagcagggcttcgagaccaaggacatcaaggagatcgccaagaagacccaggccctgcccaagatgaacagcaagagacagagaatcgtgatcttcacccagggcagagacgacaccatcatggccaccgagagcgaggtgaccgccttcgccgtgctggaccaggaccagaaggagatcatcgacaccaacggcgccggcgacgccttcgtgggcggcttcctgagccagctggtgagcgacaagcccctgaccgagtgcatcagagccggccactacgccgccagcatcatcatcagaagaaccggctgcaccttccccgagaagcccgacttccactag

SEQ ID NO: 72053 - DNA, 918 bp, Artificial Sequence
  Description of Artificial Sequence: Synthetic coding sequence
atggccgccgccgaggaggagcccaagcccaagaagctgaaggtggaggccccccaggccctgagagagaacatcctgttcggcatgggcaaccccctgctggacatcagcgccgtggtggacaaggacttcctggacaagtacagcctgaagcccaacgaccagatcctggccgaggacaagcacaaggagctgttcgacgagctggtgaagaagttcaaggtggagtaccacgccggcggcagcacccagaacagcatcaaggtggcccagtggatgatccagcagccccacaaggccgccaccttcttcggctgcatcggcatcgacaagttcggcgagatcctgaagagaaaggccgccgaggcccacgtggacgcccactactacgagcagaacgagcagcccaccggcacctgcgccgcctgcatcaccggcgacaacagaagcctgatcgccaacctggccgccgccaactgctacaagaaggagaagcacctggacctggagaagaactggatgctggtggagaaggccagagtgtgctacatcgccgaggccgccaccttcgccagagagcagggcttcgagaccaaggacatcaaggagatcgccaagaagacccaggccctgcccaagatgaacagcaagagacagagaatcgtgatcttcacccagggcagagacgacaccatcatggccaccgagagcgaggtgaccgccttcgccgtgctggaccaggaccagaaggagatcatcgacaccaacggcgccggcgacgccttcgtgggcggcttcctgagccagctggtgagcgacaagcccctgaccgagtgcatcagagccggccactacgccgccagcatcatcatcagaagaaccggctgcaccttccccgagaagcccgacttccactag

SEQ ID NO: 72054 - DNA, 984 bp, Artificial Sequence
  Description of Artificial Sequence: Synthetic coding sequence
atgaccagcgtgagagagaacatcctgttcggcatgggcaaccccctgctggacatcagcgccgtggtggacaaggacttcctggacaagttcgacgagctggtgaagaagttcaaggtggagtaccacgccggcggcagcacccagaacagcatcaaggtggcccagtggatgatccagcagccccacaaggccgccaccttcttcggctgcatcggcatcgacaagttcggcgagatcctgaagagaaaggccgccgaggcccacgtggacgcccactactacgagcagaacgagcagcccaccggcacctgcgccgcctgcatcaccggcgacaacagaagcctgatcgccaacctggccgccgccaactgctacaagaaggagaagcacctggacctggagaagaactggatgctggtggagaaggccagagtgtgctacatcgccggcttcttcctgaccgtgagccccgagagcgtgctgaaggtggcccaccacgccagcgagaacaacagaatcttcaccctgaacctgagcgcccccttcatcagccagttctacaaggagagcctgatgaaggtgatgccctacgtggacatcctgttcggcaacgagaccgaggccgccaccttcgccagagagcagggcttcgagaccaaggacatcaaggagatcgccaagaagacccaggccctgcccaagatgaacagcaagagacagagaatcgtgatcttcacccagggcagagacgacaccatcatggccaccgagagcgaggtgaccgccttcgccgtgctggaccaggaccagaaggagatcatcgacaccaacggcgccggcgacgccttcgtgggcggcttcctgagccagctggtgagcgacaagcccctgaccgagtgcatcagagccggccactacgccgccagcatcatcatcagaagaaccggctgcaccttccccgagaagcccgacttccactag

SEQ ID NO: 72055 - DNA, 2244 bp, Artificial Sequence
  Description of Artificial Sequence: Synthetic coding sequence
atgcccctgttcaagctgcccgccgaggagaagcagatcgacgacgccatgagaaacttcgccgagaaggtgttcgccagcgaggtgaaggacgagggcggcagacaggagatcagccccttcgacgtggacgagatctgccccatcagccaccacgagatgcaggcccacatcttccacctggagaccctgagcaccagcaccgaggccagaagaaagaagagattccagggcagaaagaccgtgaacctgagcatccccctgagcgagaccagcagcaccaagctgagccacatcgacgagtacatcagcagcagccccacctaccagaccgtgcccgacttccagagagtgcagatcaccggcgactacgccagcggcgtgaccgtggaggacttcgagatcgtgtgcaagggcctgtacagagccctgtgcatcagagagaagtacatgcagaagagcttccagagattccccaagacccccagcaagtacctgagaaacatcgacggcgaggcctgggtggccaacgagagcttctaccccgtgttcaccccccccgtgaagaagggcgaggaccccttcagaaccgacaacctgcccgagaacctgggctaccacctgaagatgaaggacggcgtggtgtacgtgtaccccaacgaggccgccgtgagcaaggacgagcccaagcccctgccctaccccaacctggacaccttcctggacgacatgaacttcctgctggccctgatcgcccagggccccgtgaagacctacacccacagaagactgaagttcctgagcagcaagttccaggtgcaccagatgctgaacgagatggacgagctgaaggagctgaagaacaacccccacagagacttctacaactgcagaaaggtggacacccacatccacgccgccgcctgcatgaaccagaagcacctgctgagattcatcaagaagagctaccagatcgacgccgacagagtggtgtacagcaccaaggagaagaacctgaccctgaaggagctgttcgccaagctgaagatgcacccctacgacctgaccgtggacagcctggacgtgcacgccggcagacagaccttccagagattcgacaagttcaacgacaagtacaaccccgtgggcgccagcgagctgagagacctgtacctgaagaccgacaactacatcaacggcgagtacttcgccaccatcatcaaggaggtgggcgccgacctggtggaggccaagtaccagcacgccgagcccagactgagcatctacggcagaagccccgacgagtggagcaagctgagcagctggttcgtgtgcaacagaatccactgccccaacatgacctggatgatccaggtgcccagaatctacgacgtgttcagaagcaagaacttcctgccccacttcggcaagatgctggagaacatcttcatgcccgtgttcgaggccaccatcaacccccaggccgaccccgagctgagcgtgttcctgaagcacatcaccggcttcgacagcgtggacgacgagagcaagcacagcggccacatgttcagcagcaagagccccaagccccaggagtggaccctggagaagaaccccagctacacctactacgcctactacatgtacgccaacatcatggtgctgaacagcctgagaaaggagagaggcatgaacaccttcctgttcagaccccactgcggcgaggccggcgccctgacccacctgatgaccgccttcatgatcgccgacgacatcagccacggcctgaacctgaagaagagccccgtgctgcagtacctgttcttcctggcccagatccccatcgccatgagccccctgagcaacaacagcctgttcctggagtacgccaagaaccccttcctggacttcctgcagaagggcctgatgatcagcctgagcaccgacgaccccatgcagttccacttcaccaaggagcccctgatggaggagtacgccatcgccgcccaggtgttcaagctgagcacctgcgacatgtgcgaggtggccagaaacagcgtgctgcagtgcggcatcagccacgaggagaaggtgaagttcctgggcgacaactacctggaggagggccccgccggcaacgacatcagaagaaccaacgtggcccagatcagaatggcctacagatacgagacctggtgctacgagctgaacctgatcgccgagggcctgaagagcaccgagtag

SEQ ID NO: 72056 - DNA, 2343 bp, Artificial Sequence
  Description of Artificial Sequence: Synthetic coding sequence
atgaacgtgagaatcttctacagcgtgagccagagcccccacagcctgctgagcctgctgttctactgcgccatcctggagagcagaatcagcgccaccatgcccctgttcaagctgcccgccgaggagaagcagatcgacgacgccatgagaaacttcgccgagaaggtgttcgccagcgaggtgaaggacgagggcggcagacaggagatcagccccttcgacgtggacgagatctgccccatcagccaccacgagatgcaggcccacatcttccacctggagaccctgagcaccagcaccgaggccagaagaaagaagagattccagggcagaaagaccgtgaacctgagcatccccctgagcgagaccagcagcaccaagctgagccacatcgacgagtacatcagcagcagccccacctaccagaccgtgcccgacttccagagagtgcagatcaccggcgactacgccagcggcgtgaccgtggaggacttcgagatcgtgtgcaagggcctgtacagagccctgtgcatcagagagaagtacatgcagaagagcttccagagattccccaagacccccagcaagtacctgagaaacatcgacggcgaggcctgggtggccaacgagagcttctaccccgtgttcaccccccccgtgaagaagggcgaggaccccttcagaaccgacaacctgcccgagaacctgggctaccacctgaagatgaaggacggcgtggtgtacgtgtaccccaacgaggccgccgtgagcaaggacgagcccaagcccctgccctaccccaacctggacaccttcctggacgacatgaacttcctgctggccctgatcgcccagggccccgtgaagacctacacccacagaagactgaagttcctgagcagcaagttccaggtgcaccagatgctgaacgagatggacgagctgaaggagctgaagaacaacccccacagagacttctacaactgcagaaaggtggacacccacatccacgccgccgcctgcatgaaccagaagcacctgctgagattcatcaagaagagctaccagatcgacgccgacagagtggtgtacagcaccaaggagaagaacctgaccctgaaggagctgttcgccaagctgaagatgcacccctacgacctgaccgtggacagcctggacgtgcacgccggcagacagaccttccagagattcgacaagttcaacgacaagtacaaccccgtgggcgccagcgagctgagagacctgtacctgaagaccgacaactacatcaacggcgagtacttcgccaccatcatcaaggaggtgggcgccgacctggtggaggccaagtaccagcacgccgagcccagactgagcatctacggcagaagccccgacgagtggagcaagctgagcagctggttcgtgtgcaacagaatccactgccccaacatgacctggatgatccaggtgcccagaatctacgacgtgttcagaagcaagaacttcctgccccacttcggcaagatgctggagaacatcttcatgcccgtgttcgaggccaccatcaacccccaggccgaccccgagctgagcgtgttcctgaagcacatcaccggcttcgacagcgtggacgacgagagcaagcacagcggccacatgttcagcagcaagagccccaagccccaggagtggaccctggagaagaaccccagctacacctactacgcctactacatgtacgccaacatcatggtgctgaacagcctgagaaaggagagaggcatgaacaccttcctgttcagaccccactgcggcgaggccggcgccctgacccacctgatgaccgccttcatgatcgccgacgacatcagccacggcctgaacctgaagaagagccccgtgctgcagtacctgttcttcctggcccagatccccatcgccatgagccccctgagcaacaacagcctgttcctggagtacgccaagaaccccttcctggacttcctgcagaagggcctgatgatcagcctgagcaccgacgaccccatgcagttccacttcaccaaggagcccctgatggaggagtacgccatcgccgcccaggtgttcaagctgagcacctgcgacatgtgcgaggtggccagaaacagcgtgctgcagtgcggcatcagccacgaggagaaggtgaagttcctgggcgacaactacctggaggagggccccgccggcaacgacatcagaagaaccaacgtggcccagatcagaatggcctacagatacgagacctggtgctacgagctgaacctgatcgccgagggcctgaagagcaccgagtag

SEQ ID NO: 72057 - DNA, 2331 bp, Artificial Sequence
  Description of Artificial Sequence: Synthetic coding sequence
atgaacgtgagaatcttctacagcgtgagccagagcccccacagcctgctgagcctgctgttctactgcgccatcctggagagcagaatcagcgccaccatgcccctgttcaagctgcccgagatcgacgacgccatgagaaacttcgccgagaaggtgttcgccagcgaggtgaaggacgagggcggcagacaggagatcagccccttcgacgtggacgagatctgccccatcagccaccacgagatgcaggcccacatcttccacctggagaccctgagcaccagcaccgaggccagaagaaagaagagattccagggcagaaagaccgtgaacctgagcatccccctgagcgagaccagcagcaccaagctgagccacatcgacgagtacatcagcagcagccccacctaccagaccgtgcccgacttccagagagtgcagatcaccggcgactacgccagcggcgtgaccgtggaggacttcgagatcgtgtgcaagggcctgtacagagccctgtgcatcagagagaagtacatgcagaagagcttccagagattccccaagacccccagcaagtacctgagaaacatcgacggcgaggcctgggtggccaacgagagcttctaccccgtgttcaccccccccgtgaagaagggcgaggaccccttcagaaccgacaacctgcccgagaacctgggctaccacctgaagatgaaggacggcgtggtgtacgtgtaccccaacgaggccgccgtgagcaaggacgagcccaagcccctgccctaccccaacctggacaccttcctggacgacatgaacttcctgctggccctgatcgcccagggccccgtgaagacctacacccacagaagactgaagttcctgagcagcaagttccaggtgcaccagatgctgaacgagatggacgagctgaaggagctgaagaacaacccccacagagacttctacaactgcagaaaggtggacacccacatccacgccgccgcctgcatgaaccagaagcacctgctgagattcatcaagaagagctaccagatcgacgccgacagagtggtgtacagcaccaaggagaagaacctgaccctgaaggagctgttcgccaagctgaagatgcacccctacgacctgaccgtggacagcctggacgtgcacgccggcagacagaccttccagagattcgacaagttcaacgacaagtacaaccccgtgggcgccagcgagctgagagacctgtacctgaagaccgacaactacatcaacggcgagtacttcgccaccatcatcaaggaggtgggcgccgacctggtggaggccaagtaccagcacgccgagcccagactgagcatctacggcagaagccccgacgagtggagcaagctgagcagctggttcgtgtgcaacagaatccactgccccaacatgacctggatgatccaggtgcccagaatctacgacgtgttcagaagcaagaacttcctgccccacttcggcaagatgctggagaacatcttcatgcccgtgttcgaggccaccatcaacccccaggccgaccccgagctgagcgtgttcctgaagcacatcaccggcttcgacagcgtggacgacgagagcaagcacagcggccacatgttcagcagcaagagccccaagccccaggagtggaccctggagaagaaccccagctacacctactacgcctactacatgtacgccaacatcatggtgctgaacagcctgagaaaggagagaggcatgaacaccttcctgttcagaccccactgcggcgaggccggcgccctgacccacctgatgaccgccttcatgatcgccgacgacatcagccacggcctgaacctgaagaagagccccgtgctgcagtacctgttcttcctggcccagatccccatcgccatgagccccctgagcaacaacagcctgttcctggagtacgccaagaaccccttcctggacttcctgcagaagggcctgatgatcagcctgagcaccgacgaccccatgcagttccacttcaccaaggagcccctgatggaggagtacgccatcgccgcccaggtgttcaagctgagcacctgcgacatgtgcgaggtggccagaaacagcgtgctgcagtgcggcatcagccacgaggagaaggtgaagttcctgggcgacaactacctggaggagggccccgccggcaacgacatcagaagaaccaacgtggcccagatcagaatggcctacagatacgagacctggtgctacgagctgaacctgatcgccgagggcctgaagagcaccgagtag

SEQ ID NO: 72058 - DNA, 2640 bp, Artificial Sequence
  Description of Artificial Sequence: Synthetic coding sequence
atgagaaacagaggccagggcctgttcagactgagaagcagatgcttcctgcaccagagcctgcccctgggcgccggcagaagaaagggcctggacgtggccgagcccggccccagcagatgcagaagcgacagccccgccgtggccgccgtggtgcccgccatggccagctaccccagcggcagcggcaagcccaaggccaagtaccccttcaagaagagagccagcctgcaggccagcaccgccgcccccgaggccagaggcggcctgggcgccccccccctgcagagcgccagaagcctgcccggccccgccccctgcctgaagcacttccccctggacctgagaaccagcatggacggcaagtgcaaggagatcgccgaggagctgttcaccagaagcctggccgagagcgagctgagaagcgccccctacgagttccccgaggagagccccatcgagcagctggaggagagaagacagagactggagagacagatcagccaggacgtgaagctggagcccgacatcctgctgagagccaagcaggacttcctgaagaccgacagcgacagcgacctgcagctgtacaaggagcagggcgagggccagggcgacagaagcctgagagagagagacgtgctggagagagagttccagagagtgaccatcagcggcgaggagaagtgcggcgtgcccttcaccgacctgctggacgccgccaagagcgtggtgagagccctgttcatcagagagaagtacatggccctgagcctgcagagcttctgccccaccaccagaagatacctgcagcagctggccgagaagcccctggagaccagaacctacgagcagggccccgacacccccgtgagcgccgacgcccccgtgcacccccccgccctggagcagcacccctacgagcactgcgagcccagcaccatgcccggcgacctgggcctgggcctgagaatggtgagaggcgtggtgcacgtgtacaccagaagagagcccgacgagcactgcagcgaggtggagctgccctaccccgacctgcaggagttcgtggccgacgtgaacgtgctgatggccctgatcatcaacggccccatcaagagcttctgctacagaagactgcagtacctgagcagcaagttccagatgcacgtgctgctgaacgagatgaaggagctggccgcccagaagaaggtgccccacagagacttctacaacatcagaaaggtggacacccacatccacgccagcagctgcatgaaccagaagcacctgctgagattcatcaagagagccatgaagagacacctggaggagatcgtgcacgtggagcagggcagagagcagaccctgagagaggtgttcgagagcatgaacctgaccgcctacgacctgagcgtggacaccctggacgtgcacgccgacagaaacaccttccacagattcgacaagttcaacgccaagtacaaccccatcggcgagagcgtgctgagagagatcttcatcaagaccgacaacagagtgagcggcaagtacttcgcccacatcatcaaggaggtgatgagcgacctggaggagagcaagtaccagaacgccgagctgagactgagcatctacggcagaagcagagacgagtgggacaagctggccagatgggccgtgatgcacagagtgcacagccccaacgtgagatggctggtgcaggtgcccagactgttcgacgtgtacagaaccaagggccagctggccaacttccaggagatgctggagaacatcttcctgcccctgttcgaggccaccgtgcaccccgccagccaccccgagctgcacctgttcctggagcacgtggacggcttcgacagcgtggacgacgagagcaagcccgagaaccacgtgttcaacctggagagccccctgcccgaggcctgggtggaggaggacaaccccccctacgcctactacctgtactacaccttcgccaacatggccatgctgaaccacctgagaagacagagaggcttccacaccttcgtgctgagaccccactgcggcgaggccggccccatccaccacctggtgagcgccttcatgctggccgagaacatcagccacggcctgctgctgagaaaggcccccgtgctgcagtacctgtactacctggcccagatcggcatcgccatgagccccctgagcaacaacagcctgttcctgagctaccacagaaaccccctgcccgagtacctgagcagaggcctgatggtgagcctgagcaccgacgaccccctgcagttccacttcaccaaggagcccctgatggaggagtacagcatcgccacccaggtgtggaagctgagcagctgcgacatgtgcgagctggccagaaacagcgtgctgatgagcggcttcagccacaaggtgaagagccactggctgggccccaactacaccaaggagggccccgagggcaacgacatcagaagaaccaacgtgcccgacatcagagtgggctacagatacgagaccctgtgccaggagctggccctgatcacccaggccgtgcagagcgagatgctggagaccatccccgaggaggccggcatcaccatgagccccggcccccagtag

SEQ ID NO: 72059 - DNA, 2397 bp, Artificial Sequence
  Description of Artificial Sequence: Synthetic coding sequence
atggccagcgaggccagaggcggcctgggcgccccccccctgcagagcgccagaagcctgcccggccccgccccctgcctgaagcacttccccctggacctgagaaccagcatggacggcaagtgcaaggagatcgccgaggagctgttcaccagaagcctggccgagagcgagctgagaagcgccccctacgagttccccgaggagagccccatcgagcagctggaggagagaagacagagactggagagacagatcagccaggacgtgaagctggagcccgacatcctgctgagagccaagcaggacttcctgaagaccgacagcgacagcgacctgcagctgtacaaggagcagggcgagggccagggcgacagaagcctgagagagagagacgtgctggagagagagttccagagagtgaccatcagcggcgaggagaagtgcggcgtgcccttcaccgacctgctggacgccgccaagagcgtggtgagagccctgttcatcagagagaagtacatggccctgagcctgcagagcttctgccccaccaccagaagatacctgcagcagctggccgagaagcccctggagaccagaacctacgagcagggccccgacacccccgtgagcgccgacgcccccgtgcacccccccgccctggagcagcacccctacgagcactgcgagcccagcaccatgcccggcgacctgggcctgggcctgagaatggtgagaggcgtggtgcacgtgtacaccagaagagagcccgacgagcactgcagcgaggtggagctgccctaccccgacctgcaggagttcgtggccgacgtgaacgtgctgatggccctgatcatcaacggccccatcaagagcttctgctacagaagactgcagtacctgagcagcaagttccagatgcacgtgctgctgaacgagatgaaggagctggccgcccagaagaaggtgccccacagagacttctacaacatcagaaaggtggacacccacatccacgccagcagctgcatgaaccagaagcacctgctgagattcatcaagagagccatgaagagacacctggaggagatcgtgcacgtggagcagggcagagagcagaccctgagagaggtgttcgagagcatgaacctgaccgcctacgacctgagcgtggacaccctggacgtgcacgccgacagaaacaccttccacagattcgacaagttcaacgccaagtacaaccccatcggcgagagcgtgctgagagagatcttcatcaagaccgacaacagagtgagcggcaagtacttcgcccacatcatcaaggaggtgatgagcgacctggaggagagcaagtaccagaacgccgagctgagactgagcatctacggcagaagcagagacgagtgggacaagctggccagatgggccgtgatgcacagagtgcacagccccaacgtgagatggctggtgcaggtgcccagactgttcgacgtgtacagaaccaagggccagctggccaacttccaggagatgctggagaacatcttcctgcccctgttcgaggccaccgtgcaccccgccagccaccccgagctgcacctgttcctggagcacgtggacggcttcgacagcgtggacgacgagagcaagcccgagaaccacgtgttcaacctggagagccccctgcccgaggcctgggtggaggaggacaaccccccctacgcctactacctgtactacaccttcgccaacatggccatgctgaaccacctgagaagacagagaggcttccacaccttcgtgctgagaccccactgcggcgaggccggccccatccaccacctggtgagcgccttcatgctggccgagaacatcagccacggcctgctgctgagaaaggcccccgtgctgcagtacctgtactacctggcccagatcggcatcgccatgagccccctgagcaacaacagcctgttcctgagctaccacagaaaccccctgcccgagtacctgagcagaggcctgatggtgagcctgagcaccgacgaccccctgcagttccacttcaccaaggagcccctgatggaggagtacagcatcgccacccaggtgtggaagctgagcagctgcgacatgtgcgagctggccagaaacagcgtgctgatgagcggcttcagccacaaggtgaagagccactggctgggccccaactacaccaaggagggccccgagggcaacgacatcagaagaaccaacgtgcccgacatcagagtgggctacagatacgagaccctgtgccaggagctggccctgatcacccaggccgtgcagagcgagatgctggagaccatccccgaggaggccggcatcaccatgagccccggcccccagtag

SEQ ID NO: 72060 - DNA, 2415 bp, Artificial Sequence
  Description of Artificial Sequence: Synthetic coding sequence
atgtggcagagccaggcccccgccggcgccgcccagaccccccccctgagccccccctggagccagccctggcaccccatccacctggccctggccagccccagacccaacatccccctgagaagcggccccgcctgcagaccccccctgcagctgcaggagctgttcaccagaagcctggccgagagcgagctgagaagcgccccctacgagttccccgaggagagccccatcgagcagctggaggagagaagacagagactggagagacagatcagccaggacgtgaagctggagcccgacatcctgctgagagccaagcaggacttcctgaagaccgacagcgacagcgacctgcagctgtacaaggagcagggcgagggccagggcgacagaagcctgagagagagagacgtgctggagagagagttccagagagtgaccatcagcggcgaggagaagtgcggcgtgcccttcaccgacctgctggacgccgccaagagcgtggtgagagccctgttcatcagagagaagtacatggccctgagcctgcagagcttctgccccaccaccagaagatacctgcagcagctggccgagaagcccctggagaccagaacctacgagcagggccccgacacccccgtgagcgccgacgcccccgtgcacccccccgccctggagcagcacccctacgagcactgcgagcccagcaccatgcccggcgacctgggcctgggcctgagaatggtgagaggcgtggtgcacgtgtacaccagaagagagcccgacgagcactgcagcgaggtggagctgccctaccccgacctgcaggagttcgtggccgacgtgaacgtgctgatggccctgatcatcaacggccccatcaagagcttctgctacagaagactgcagtacctgagcagcaagttccagatgcacgtgctgctgaacgagatgaaggagctggccgcccagaagaaggtgccccacagagacttctacaacatcagaaaggtggacacccacatccacgccagcagctgcatgaaccagaagcacctgctgagattcatcaagagagccatgaagagacacctggaggagatcgtgcacgtggagcagggcagagagcagaccctgagagaggtgttcgagagcatgaacctgaccgcctacgacctgagcgtggacaccctggacgtgcacgccgacagaaacaccttccacagattcgacaagttcaacgccaagtacaaccccatcggcgagagcgtgctgagagagatcttcatcaagaccgacaacagagtgagcggcaagtacttcgcccacatcatcaaggaggtgatgagcgacctggaggagagcaagtaccagaacgccgagctgagactgagcatctacggcagaagcagagacgagtgggacaagctggccagatgggccgtgatgcacagagtgcacagccccaacgtgagatggctggtgcaggtgcccagactgttcgacgtgtacagaaccaagggccagctggccaacttccaggagatgctggagaacatcttcctgcccctgttcgaggccaccgtgcaccccgccagccaccccgagctgcacctgttcctggagcacgtggacggcttcgacagcgtggacgacgagagcaagcccgagaaccacgtgttcaacctggagagccccctgcccgaggcctgggtggaggaggacaaccccccctacgcctactacctgtactacaccttcgccaacatggccatgctgaaccacctgagaagacagagaggcttccacaccttcgtgctgagaccccactgcggcgaggccggccccatccaccacctggtgagcgccttcatgctggccgagaacatcagccacggcctgctgctgagaaaggcccccgtgctgcagtacctgtactacctggcccagatcggcatcgccatgagccccctgagcaacaacagcctgttcctgagctaccacagaaaccccctgcccgagtacctgagcagaggcctgatggtgagcctgagcaccgacgaccccctgcagttccacttcaccaaggagcccctgatggaggagtacagcatcgccacccaggtgtggaagctgagcagctgcgacatgtgcgagctggccagaaacagcgtgctgatgagcggcttcagccacaaggtgaagagccactggctgggccccaactacaccaaggagggccccgagggcaacgacatcagaagaaccaacgtgcccgacatcagagtgggctacagatacgagaccctgtgccaggagctggccctgatcacccaggccgtgcagagcgagatgctggagaccatccccgaggaggccggcatcaccatgagccccggcccccagtag

SEQ ID NO: 72061 - DNA, 2283 bp, Artificial Sequence
  Description of Artificial Sequence: Synthetic coding sequence
atgctgaccttcctgcccagcccccaggagctgttcaccagaagcctggccgagagcgagctgagaagcgccccctacgagttccccgaggagagccccatcgagcagctggaggagagaagacagagactggagagacagatcagccaggacgtgaagctggagcccgacatcctgctgagagccaagcaggacttcctgaagaccgacagcgacagcgacctgcagctgtacaaggagcagggcgagggccagggcgacagaagcctgagagagagagacgtgctggagagagagttccagagagtgaccatcagcggcgaggagaagtgcggcgtgcccttcaccgacctgctggacgccgccaagagcgtggtgagagccctgttcatcagagagaagtacatggccctgagcctgcagagcttctgccccaccaccagaagatacctgcagcagctggccgagaagcccctggagaccagaacctacgagcagggccccgacacccccgtgagcgccgacgcccccgtgcacccccccgccctggagcagcacccctacgagcactgcgagcccagcaccatgcccggcgacctgggcctgggcctgagaatggtgagaggcgtggtgcacgtgtacaccagaagagagcccgacgagcactgcagcgaggtggagctgccctaccccgacctgcaggagttcgtggccgacgtgaacgtgctgatggccctgatcatcaacggccccatcaagagcttctgctacagaagactgcagtacctgagcagcaagttccagatgcacgtgctgctgaacgagatgaaggagctggccgcccagaagaaggtgccccacagagacttctacaacatcagaaaggtggacacccacatccacgccagcagctgcatgaaccagaagcacctgctgagattcatcaagagagccatgaagagacacctggaggagatcgtgcacgtggagcagggcagagagcagaccctgagagaggtgttcgagagcatgaacctgaccgcctacgacctgagcgtggacaccctggacgtgcacgccgacagaaacaccttccacagattcgacaagttcaacgccaagtacaaccccatcggcgagagcgtgctgagagagatcttcatcaagaccgacaacagagtgagcggcaagtacttcgcccacatcatcaaggaggtgatgagcgacctggaggagagcaagtaccagaacgccgagctgagactgagcatctacggcagaagcagagacgagtgggacaagctggccagatgggccgtgatgcacagagtgcacagccccaacgtgagatggctggtgcaggtgcccagactgttcgacgtgtacagaaccaagggccagctggccaacttccaggagatgctggagaacatcttcctgcccctgttcgaggccaccgtgcaccccgccagccaccccgagctgcacctgttcctggagcacgtggacggcttcgacagcgtggacgacgagagcaagcccgagaaccacgtgttcaacctggagagccccctgcccgaggcctgggtggaggaggacaaccccccctacgcctactacctgtactacaccttcgccaacatggccatgctgaaccacctgagaagacagagaggcttccacaccttcgtgctgagaccccactgcggcgaggccggccccatccaccacctggtgagcgccttcatgctggccgagaacatcagccacggcctgctgctgagaaaggcccccgtgctgcagtacctgtactacctggcccagatcggcatcgccatgagccccctgagcaacaacagcctgttcctgagctaccacagaaaccccctgcccgagtacctgagcagaggcctgatggtgagcctgagcaccgacgaccccctgcagttccacttcaccaaggagcccctgatggaggagtacagcatcgccacccaggtgtggaagctgagcagctgcgacatgtgcgagctggccagaaacagcgtgctgatgagcggcttcagccacaaggtgaagagccactggctgggccccaactacaccaaggagggccccgagggcaacgacatcagaagaaccaacgtgcccgacatcagagtgggctacagatacgagaccctgtgccaggagctggccctgatcacccaggccgtgcagagcgagatgctggagaccatccccgaggaggccggcatcaccatgagccccggcccccagtag

SEQ ID NO: 72062 - DNA, 6 bp, Artificial Sequence
  Description of Artificial Sequence: Synthetic coding sequence
atgtag

SEQ ID NO: 72063 - DNA, 2640 bp, Artificial Sequence; identical to SEQ ID NO: 72058
  Description of Artificial Sequence: Synthetic coding sequence

SEQ ID NO: 72064 - DNA, 312 bp, Artificial Sequence
  Description of Artificial Sequence: Synthetic coding sequence
atggccagcgaggccagaggcggcctgggcgccccccccctgcagagcgccagaagcctgcccggccccgccccctgcctgaagcacttccccctggacctgagaaccagcatggacggcaagtgcaaggagatcgccgaggagctgttcaccagaagcctggccgagagcgagctgagaagcgccccctacgagttccccgaggagagccccatcgagcagctggaggagagaagacagagactggagagacagatcagccaggacgtgaagctggagcccgacatcctgctgagagccaagcaggactag

SEQ ID NO: 72065 - DNA, 2304 bp, Artificial Sequence
  Description of Artificial Sequence: Synthetic coding sequence
atgcccagacagttccccaagctgaacatcagcgaggtggacgagcaggtgagactgctggccgagaaggtgttcgccaaggtgctgagagaggaggacagcaaggacgccctgagcctgttcaccgtgcccgaggactgccccatcggccagaaggaggccaaggagagagagctgcagaaggagctggccgagcagaagagcgtggagaccgccaagagaaagaagagcttcaagatgatcagaagccagagcctgagcctgcagatgcccccccagcaggactggaagggcccccccgccgccagccccgccatgagccccaccacccccgtggtgaccggcgccaccagcctgcccacccccgccccctacgccatgcccgagttccagagagtgaccatcagcggcgactactgcgccggcatcaccctggaggactacgagcaggccgccaagagcctggccaaggccctgatgatcagagagaagtacgccagactggcctaccacagattccccagaatcaccagccagtacctgggccaccccagagccgacaccgccccccccgaggagggcctgcccgacttccaccccccccccctgccccaggaggacccctactgcctggacgacgccccccccaacctggactacctggtgcacatgcagggcggcatcctgttcgtgtacgacaacaagaagatgctggagcaccaggagccccacagcctgccctaccccgacctggagacctacaccgtggacatgagccacatcctggccctgatcaccgacggccccaccaagacctactgccacagaagactgaacttcctggagagcaagttcagcctgcacgagatgctgaacgagatgagcgagttcaaggagctgaagagcaacccccacagagacttctacaacgtgagaaaggtggacacccacatccacgccgccgcctgcatgaaccagaagcacctgctgagattcatcaagcacacctaccagaccgagcccgacagaaccgtggccgagaagagaggcagaaagatcaccctgagacaggtgttcgacggcctgcacatggacccctacgacctgaccgtggacagcctggacgtgcacgccggcagacagaccttccacagattcgacaagttcaacagcaagtacaaccccgtgggcgccagcgagctgagagacctgtacctgaagaccgagaactacctgggcggcgagtacttcgccagaatggtgaaggaggtggccagagagctggaggagagcaagtaccagtacagcgagcccagactgagcatctacggcagaagccccgaggagtggcccaacctggcctactggttcatccagcacaaggtgtacagccccaacatgagatggatcatccaggtgcccagaatctacgacatcttcagaagcaagaagctgctgcccaacttcggcaagatgctggagaacatcttcctgcccctgttcaaggccaccatcaacccccaggaccacagagagctgcacctgttcctgaagtacgtgaccggcttcgacagcgtggacgacgagagcaagcacagcgaccacatgttcagcgacaagagccccaaccccgacgtgtggaccagcgagcagaaccccccctacagctactacctgtactacatgtacgccaacatcatggtgctgaacaacctgagaagagagagaggcctgagcaccttcctgttcagaccccactgcggcgaggccggcagcatcacccacctggtgagcgccttcctgaccgccgacaacatcagccacggcctgctgctgaagaagagccccgtgctgcagtacctgtactacctggcccagatccccatcgccatgagccccctgagcaacaacagcctgttcctggagtacagcaagaaccccctgagagagttcctgcacaagggcctgcacgtgagcctgagcaccgacgaccccatgcagttccactacaccaaggaggccctgatggaggagtacgccatcgccgcccaggtgtggaagctgagcacctgcgacctgtgcgagatcgccagaaacagcgtgctgcagagcggcctgagccaccaggagaagcagaagttcctgggccagaactactacaaggagggccccgagggcaacgacatcagaaagaccaacgtggcccagatcagaatggccttcagatacgagaccctgtgcaacgagctgagcttcctgagcgacgccatgaagagcgaggagatcaccgccctgaccaactag

SEQ ID NO: 72066 - DNA, 2331 bp, Artificial Sequence
  Description of Artificial Sequence: Synthetic coding sequence
atggccctgagcagcgagcccgccgagatgcccagacagttccccaagctgaacatcagcgaggtggacgagcaggtgagactgctggccgagaaggtgttcgccaaggtgctgagagaggaggacagcaaggacgccctgagcctgttcaccgtgcccgaggactgccccatcggccagaaggaggccaaggagagagagctgcagaaggagctggccgagcagaagagcgtggagaccgccaagagaaagaagagcttcaagatgatcagaagccagagcctgagcctgcagatgcccccccagcaggactggaagggcccccccgccgccagccccgccatgagccccaccacccccgtggtgaccggcgccaccagcctgcccacccccgccccctacgccatgcccgagttccagagagtgaccatcagcggcgactactgcgccggcatcaccctggaggactacgagcaggccgccaagagcctggccaaggccctgatgatcagagagaagtacgccagactggcctaccacagattccccagaatcaccagccagtacctgggccaccccagagccgacaccgccccccccgaggagggcctgcccgacttccaccccccccccctgccccaggaggacccctactgcctggacgacgccccccccaacctggactacctggtgcacatgcagggcggcatcctgttcgtgtacgacaacaagaagatgctggagcaccaggagccccacagcctgccctaccccgacctggagacctacaccgtggacatgagccacatcctggccctgatcaccgacggccccaccaagacctactgccacagaagactgaacttcctggagagcaagttcagcctgcacgagatgctgaacgagatgagcgagttcaaggagctgaagagcaacccccacagagacttctacaacgtgagaaaggtggacacccacatccacgccgccgcctgcatgaaccagaagcacctgctgagattcatcaagcacacctaccagaccgagcccgacagaaccgtggccgagaagagaggcagaaagatcaccctgagacaggtgttcgacggcctgcacatggacccctacgacctgaccgtggacagcctggacgtgcacgccggcagacagaccttccacagattcgacaagttcaacagcaagtacaaccccgtgggcgccagcgagctgagagacctgtacctgaagaccgagaactacctgggcggcgagtacttcgccagaatggtgaaggaggtggccagagagctggaggagagcaagtaccagtacagcgagcccagactgagcatctacggcagaagccccgaggagtggcccaacctggcctactggttcatccagcacaaggtgtacagccccaacatgagatggatcatccaggtgcccagaatctacgacatcttcagaagcaagaagctgctgcccaacttcggcaagatgctggagaacatcttcctgcccctgttcaaggccaccatcaacccccaggaccacagagagctgcacctgttcctgaagtacgtgaccggcttcgacagcgtggacgacgagagcaagcacagcgaccacatgttcagcgacaagagccccaaccccgacgtgtggaccagcgagcagaaccccccctacagctactacctgtactacatgtacgccaacatcatggtgctgaacaacctgagaagagagagaggcctgagcaccttcctgttcagaccccactgcggcgaggccggcagcatcacccacctggtgagcgccttcctgaccgccgacaacatcagccacggcctgctgctgaagaagagccccgtgctgcagtacctgtactacctggcccagatccccatcgccatgagccccctgagcaacaacagcctgttcctggagtacagcaagaaccccctgagagagttcctgcacaagggcctgcacgtgagcctgagcaccgacgaccccatgcagttccactacaccaaggaggccctgatggaggagtacgccatcgccgcccaggtgtggaagctgagcacctgcgacctgtgcgagatcgccagaaacagcgtgctgcagagcggcctgagccaccaggagaagcagaagttcctgggccagaactactacaaggagggccccgagggcaacgacatcagaaagaccaacgtggcccagatcagaatggccttcagatacgagaccctgtgcaacgagctgagcttcctgagcgacgccatgaagagcgaggagatcaccgccctgaccaactag

SEQ ID NO: 72067 - DNA, 1827 bp, Artificial Sequence
  Description of Artificial Sequence: Synthetic coding sequence
atgatcagagagaagtacgccagactggcctaccacagattccccagaatcaccagccagtacctgggccaccccagagccgacaccgccccccccgaggagggcctgcccgacttccaccccccccccctgccccaggaggacccctactgcctggacgacgccccccccaacctggactacctggtgcacatgcagggcggcatcctgttcgtgtacgacaacaagaagatgctggagcaccaggagccccacagcctgccctaccccgacctggagacctacaccgtggacatgagccacatcctggccctgatcaccgacggccccaccaagacctactgccacagaagactgaacttcctggagagcaagttcagcctgcacgagatgctgaacgagatgagcgagttcaaggagctgaagagcaacccccacagagacttctacaacgtgagaaaggtggacacccacatccacgccgccgcctgcatgaaccagaagcacctgctgagattcatcaagcacacctaccagaccgagcccgacagaaccgtggccgagaagagaggcagaaagatcaccctgagacaggtgttcgacggcctgcacatggacccctacgacctgaccgtggacagcctggacgtgcacgccggcagacagaccttccacagattcgacaagttcaacagcaagtacaaccccgtgggcgccagcgagctgagagacctgtacctgaagaccgagaactacctgggcggcgagtacttcgccagaatggtgaaggaggtggccagagagctggaggagagcaagtaccagtacagcgagcccagactgagcatctacggcagaagccccgaggagtggcccaacctggcctactggttcatccagcacaaggtgtacagccccaacatgagatggatcatccaggtgcccagaatctacgacatcttcagaagcaagaagctgctgcccaacttcggcaagatgctggagaacatcttcctgcccctgttcaaggccaccatcaacccccaggaccacagagagctgcacctgttcctgaagtacgtgaccggcttcgacagcgtggacgacgagagcaagcacagcgaccacatgttcagcgacaagagccccaaccccgacgtgtggaccagcgagcagaaccccccctacagctactacctgtactacatgtacgccaacatcatggtgctgaacaacctgagaagagagagaggcctgagcaccttcctgttcagaccccactgcggcgaggccggcagcatcacccacctggtgagcgccttcctgaccgccgacaacatcagccacggcctgctgctgaagaagagccccgtgctgcagtacctgtactacctggcccagatccccatcgccatgagccccctgagcaacaacagcctgttcctggagtacagcaagaaccccctgagagagttcctgcacaagggcctgcacgtgagcctgagcaccgacgaccccatgcagttccactacaccaaggaggccctgatggaggagtacgccatcgccgcccaggtgtggaagctgagcacctgcgacctgtgcgagatcgccagaaacagcgtgctgcagagcggcctgagccaccaggagaagcagaagttcctgggccagaactactacaaggagggccccgagggcaacgacatcagaaagaccaacgtggcccagatcagaatggccttcagatacgagaccctgtgcaacgagctgagcttcctgagcgacgccatgaagagcgaggagatcaccgccctgaccaactag

SEQ ID NO: 72068 - DNA, 804 bp, Artificial Sequence
  Description of Artificial Sequence: Synthetic coding sequence
atgcccagacagttccccaagctgaacatcagcgaggtggacgagcaggtgagactgctggccgagaaggtgttcgccaaggtgctgagagaggaggacagcaaggacgccctgagcctgttcaccgtgcccgaggactgccccatcggccagaaggaggccaaggagagagagctgcagaaggagctggccgagcagaagagcgtggagaccgccaagagaaagaagagcttcaagatgatcagaagccagagcctgagcctgcagatgcccccccagcaggactggaagggcccccccgccgccagccccgccatgagccccaccacccccgtggtgaccggcgccaccagcctgcccacccccgccccctacgccatgcccgagttccagagagtgaccatcagcggcgactactgcgccggcatcaccctggaggactacgagcaggccgccaagagcctggccaaggccctgatgatcagagagaagtacgccagactggcctaccacagattccccagaatcaccagccagtacctgggccaccccagagccgacaccgccccccccgaggagggcctgcccgacttccaccccccccccctgccccaggaggacccctactgcctggacgacgccccccccaacctggactacctggtgcacatgcagggcggcatcctgttcgtgtacgacaacaagaagatgctggagcaccaggagccccacagcctgccctaccccgacctggagacctacaccgtggacatgagccacatcctggccctgatcaccgactag

SEQ ID NO: 72069 - DNA, 2325 bp, Artificial Sequence
  Description of Artificial Sequence: Synthetic coding sequence
atggagcccggcagcgccgagatgcccagacagttccccaagctgaacatcagcgaggtggacgagcaggtgagactgctggccgagaaggtgttcgccaaggtgctgagagaggaggacagcaaggacgccctgagcctgttcaccgtgcccgaggactgccccatcggccagaaggaggccaaggagagagagctgcagaaggagctggccgagcagaagagcgtggagaccgccaagagaaagaagagcttcaagatgatcagaagccagagcctgagcctgcagatgcccccccagcaggactggaagggcccccccgccgccagccccgccatgagccccaccacccccgtggtgaccggcgccaccagcctgcccacccccgccccctacgccatgcccgagttccagagagtgaccatcagcggcgactactgcgccggcatcaccctggaggactacgagcaggccgccaagagcctggccaaggccctgatgatcagagagaagtacgccagactggcctaccacagattccccagaatcaccagccagtacctgggccaccccagagccgacaccgccccccccgaggagggcctgcccgacttccaccccccccccctgccccaggaggacccctactgcctggacgacgccccccccaacctggactacctggtgcacatgcagggcggcatcctgttcgtgtacgacaacaagaagatgctggagcaccaggagccccacagcctgccctaccccgacctggagacctacaccgtggacatgagccacatcctggccctgatcaccgacggccccaccaagacctactgccacagaagactgaacttcctggagagcaagttcagcctgcacgagatgctgaacgagatgagcgagttcaaggagctgaagagcaacccccacagagacttctacaacgtgagaaaggtggacacccacatccacgccgccgcctgcatgaaccagaagcacctgctgagattcatcaagcacacctaccagaccgagcccgacagaaccgtggccgagaagagaggcagaaagatcaccctgagacaggtgttcgacggcctgcacatggacccctacgacctgaccgtggacagcctggacgtgcacgccggcagacagaccttccacagattcgacaagttcaacagcaagtacaaccccgtgggcgccagcgagctgagagacctgtacctgaagaccgagaactacctgggcggcgagtacttcgccagaatggtgaaggaggtggccagagagctggaggagagcaagtaccagtacagcgagcccagactgagcatctacggcagaagccccgaggagtggcccaacctggcctactggttcatccagcacaaggtgtacagccccaacatgagatggatcatccaggtgcccagaatctacgacatcttcagaagcaagaagctgctgcccaacttcggcaagatgctggagaacatcttcctgcccctgttcaaggccaccatcaacccccaggaccacagagagctgcacctgttcctgaagtacgtgaccggcttcgacagcgtggacgacgagagcaagcacagcgaccacatgttcagcgacaagagccccaaccccgacgtgtggaccagcgagcagaaccccccctacagctactacctgtactacatgtacgccaacatcatggtgctgaacaacctgagaagagagagaggcctgagcaccttcctgttcagaccccactgcggcgaggccggcagcatcacccacctggtgagcgccttcctgaccgccgacaacatcagccacggcctgctgctgaagaagagccccgtgctgcagtacctgtactacctggcccagatccccatcgccatgagccccctgagcaacaacagcctgttcctggagtacagcaagaaccccctgagagagttcctgcacaagggcctgcacgtgagcctgagcaccgacgaccccatgcagttccactacaccaaggaggccctgatggaggagtacgccatcgccgcccaggtgtggaagctgagcacctgcgacctgtgcgagatcgccagaaacagcgtgctgcagagcggcctgagccaccaggagaagcagaagttcctgggccagaactactacaaggagggccccgagggcaacgacatcagaaagaccaacgtggcccagatcagaatggccttcagatacgagaccctgtgcaacgagctgagcttcctgagcgacgccatgaagagcgaggagatcaccgccctgaccaactag

SEQ ID NO: 72070 - DNA, 2304 bp, Artificial Sequence; identical to SEQ ID NO: 72065
  Description of Artificial Sequence: Synthetic coding sequence

SEQ ID NO: 72071 - DNA, 336 bp, Artificial Sequence
  Description of Artificial Sequence: Synthetic coding sequence
atgcccagacagttccccaagctgaacatcagcgaggtggacgagcaggtgagactgctggccgagaaggtgttcgccaaggtgctgagagaggaggacagcaaggacgccctgagcctgttcaccgtgcccgaggactgccccatcggccagaaggaggccaaggagagagagctgcagaaggagctggccgagcagaagagcgtggagaccgccaagagaaagaagagcttcaagatgatcagaagccagagcctgagcctgcagatgcccccccagcaggactggaagggcccccccgccgccagccccgccatgagccccaccaccccctag

SEQ ID NO: 72072 - DNA, 426 bp, Artificial Sequence
  Description of Artificial Sequence: Synthetic coding sequence
atggccagacccctgtgcaccctgctgctgctgatggccaccctggccggcgccctggccagcagcagcaaggaggagaacagaatcatccccggcggcatctacgacgccgacctgaacgacgagtgggtgcagagagccctgcacttcgccatcagcgagtacaacaaggccaccgaggacgagtactacagaagacccctgcaggtgctgagagccagagagcagaccttcggcggcgtgaactacttcttcgacgtggaggtgggcagaaccatctgcaccaagagccagcccaacctggacacctgcgccttccacgagcagcccgagctgcagaagaagcagctgtgcagcttcgagatctacgaggtgccctgggaggacagaatgagcctggtgaacagcagatgccaggaggcctag

SEQ ID NO: 72073 - DNA, 1215 bp, Artificial Sequence
  Description of Artificial Sequence: Synthetic coding sequence
atgcccggcctgatgagaatgagagagagatacagcgccagcaagcccctgaagggcgccagaatcgccggctgcctgcacatgaccgtggagaccgccgtgctgatcgagaccctggtgaccctgggcgccgaggtgcagtggagcagctgcaacatcttcagcacccaggaccacgccgccgccgccatcgccaaggccggcatccccgtgtacgcctggaagggcgagaccgacgaggagtacctgtggtgcatcgagcagaccctgtacttcaaggacggccccctgaacatgatcctggacgacggcggcgacctgaccaacctgatccacaccaagtacccccagctgctgcccggcatcagaggcatcagcgaggagaccaccaccggcgtgcacaacctgtacaagatgatggccaacggcatcctgaaggtgcccgccatcaacgtgaacgacagcgtgaccaagagcaagttcgacaacctgtacggctgcagagagagcctgatcgacggcatcaagagagccaccgacgtgatgatcgccggcaaggtggccgtggtggccggctacggcgacgtgggcaagggctgcgcccaggccctgagaggcttcggcgccagagtgatcatcaccgagatcgaccccatcaacgccctgcaggccgccatggagggctacgaggtgaccaccatggacgaggcctgccaggagggcaacatcttcgtgaccaccaccggctgcatcgacatcatcctgggcagacacttcgagcagatgaaggacgacgccatcgtgtgcaacatcggccacttcgacgtggagatcgacgtgaagtggctgaacgagaacgccgtggagaaggtgaacatcaagccccaggtggacagatacagactgaagaacggcagaagaatcatcctgctggccgagggcagactggtgaacctgggctgcgccatgggccaccccagcttcgtgatgagcaacagcttcaccaaccaggtgatggcccagatcgagctgtggacccaccccgacaagtaccccgtgggcgtgcacttcctgcccaagaagctggacgaggccgtggccgaggcccacctgggcaagctgaacgtgaagctgaccaagctgaccgagaagcaggcccagtacctgggcatgagctgcgacggccccttcaagcccgaccactacagatactag

SEQ ID NO: 72074 - DNA, 798 bp, Artificial Sequence
  Description of Artificial Sequence: Synthetic coding sequence
atgttcgtgagcaagagaagattcatcctgaagacctgcggcaccaccctgctgctgaaggccctggtgcccctgctgaagctggccagagactacagcggcttcgacagcatccagagcttcttctacagcagaaagaacttcatgaagcccagccaccagggctacccccacagaaacttccaggaggagatcgagttcctgaacgccatcttccccaacggcgccgcctactgcatgggcagaatgaacagcgactgctggtacctgtacaccctggacttccccgagagcagagtgatcagccagcccgaccagaccctggagatcctgatgagcgagctggaccccgccgtgatggaccagttctacatgaaggacggcgtgaccgccaaggacgtgaccagagagagcggcatcagagacctgatccccggcagcgtgatcgacgccaccatgttcaacccctgcggctacagcatgaacggcatgaagagcgacggcacctactggaccatccacatcacccccgagcccgagttcagctacgtgagcttcgagaccaacctgagccagaccagctacgacgacctgatcagaaaggtggtggaggtgttcaagcccggcaagttcgtgaccaccctgttcgtgaaccagagcagcaagtgcagaaccgtgctggccagcccccagaagatcgagggcttcaagagactggactgccagagcgccatgttcaacgactacaacttcgtgttcaccagcttcgccaagaagcagcagcagcagcagagctag

SEQ ID NO: 72075 - DNA, 918 bp, Artificial Sequence
  Description of Artificial Sequence: Synthetic coding sequence
atggaggccgcccacttcttcgagggcaccgagaagctgctggaggtgtggttcagcagacagcagcccgacgccaaccagggcagcggcgacctgagaaccatccccagcgagagcagcatgttcgtgagcaagagaagattcatcctgaagacctgcggcaccaccctgctgctgaaggccctggtgcccctgctgaagctggccagagactacagcggcttcgacagcatccagagcttcttctacagcagaaagaacttcatgaagcccagccaccagggctacccccacagaaacttccaggaggagatcgagttcctgaacgccatcttccccaacggcgccgcctactgcatgggcagaatgaacagcgactgctggtacctgtacaccctggacttccccgagagcagagtgatcagccagcccgaccagaccctggagatcctgatgagcgagctggaccccgccgtgatggaccagttctacatgaaggacggcgtgaccgccaaggacgtgaccagagagagcggcatcagagacctgatccccggcagcgtgatcgacgccaccatgttcaacccctgcggctacagcatgaacggcatgaagagcgacggcacctactggaccatccacatcacccccgagcccgagttcagctacgtgagcttcgagaccaacctgagccagaccagctacgacgacctgatcagaaaggtggtggaggtgttcaagcccggcaagttcgtgaccaccctgttcgtgaaccagagcagcaagtgcagaaccgtgctggccagcccccagaagatcgagggcttcaagagactggactgccagagcgccatgttcaacgactacaacttcgtgttcaccagcttcgccaagaagcagcagcagcagcagagctag

SEQ ID NO: 72076 - DNA, 561 bp, Artificial Sequence
  Description of Artificial Sequence: Synthetic coding sequence
atgggcagaatgaacagcgactgctggtacctgtacaccctggacttccccgagagcagagtgatcagccagcccgaccagaccctggagatcctgatgagcgagctggaccccgccgtgatggaccagttctacatgaaggacggcgtgaccgccaaggacgtgaccagagagagcggcatcagagacctgatccccggcagcgtgatcgacgccaccatgttcaacccctgcggctacagcatgaacggcatgaagagcgacggcacctactggaccatccacatcacccccgagcccgagttcagctacgtgagcttcgagaccaacctgagccagaccagctacgacgacctgatcagaaaggtggtggaggtgttcaagcccggcaagttcgtgaccaccctgttcgtgaaccagagcagcaagtgcagaaccgtgctggccagcccccagaagatcgagggcttcaagagactggactgccagagcgccatgttcaacgactacaacttcgtgttcaccagcttcgccaagaagcagcagcagcagcagagctag

SEQ ID NO: 72077 - DNA, 1005 bp, Artificial Sequence
  Description of Artificial Sequence: Synthetic coding sequence
atggaggccgcccacttcttcgagggcaccgagaagctgctggaggtgtggttcagcagacagcagcccgacgccaaccagggcagcggcgacctgagaaccatccccagaagcgagtgggacatcctgctgaaggacgtgcagtgcagcatcatcagcgtgaccaagaccgacaagcaggaggcctacgtgctgagcgagagcagcatgttcgtgagcaagagaagattcatcctgaagacctgcggcaccaccctgctgctgaaggccctggtgcccctgctgaagctggccagagactacagcggcttcgacagcatccagagcttcttctacagcagaaagaacttcatgaagcccagccaccagggctacccccacagaaacttccaggaggagatcgagttcctgaacgccatcttccccaacggcgccgcctactgcatgggcagaatgaacagcgactgctggtacctgtacaccctggacttccccgagagcagagtgatcagccagcccgaccagaccctggagatcctgatgagcgagctggaccccgccgtgatggaccagttctacatgaaggacggcgtgaccgccaaggacgtgaccagagagagcggcatcagagacctgatccccggcagcgtgatcgacgccaccatgttcaacccctgcggctacagcatgaacggcatgaagagcgacggcacctactggaccatccacatcacccccgagcccgagttcagctacgtgagcttcgagaccaacctgagccagaccagctacgacgacctgatcagaaaggtggtggaggtgttcaagcccggcaagttcgtgaccaccctgttcgtgaaccagagcagcaagtgcagaaccgtgctggccagcccccagaagatcgagggcttcaagagactggactgccagagcgccatgttcaacgactacaacttcgtgttcaccagcttcgccaagaagcagcagcagcagcagagctag

SEQ ID NO: 72078 - DNA, 645 bp, Artificial Sequence
  Description of Artificial Sequence: Synthetic coding sequence
atggaggccgcccacttcttcgagggcaccgagaagctgctggaggtgtggttcagcagacagcagcccgacgccaaccagggcagcggcgacctgagaaccatccccagatacctgtacaccctggacttccccgagagcagagtgatcagccagcccgaccagaccctggagatcctgatgagcgagctggaccccgccgtgatggaccagttctacatgaaggacggcgtgaccgccaaggacgtgaccagagagagcggcatcagagacctgatccccggcagcgtgatcgacgccaccatgttcaacccctgcggctacagcatgaacggcatgaagagcgacggcacctactggaccatccacatcacccccgagcccgagttcagctacgtgagcttcgagaccaacctgagccagaccagctacgacgacctgatcagaaaggtggtggaggtgttcaagcccggcaagttcgtgaccaccctgttcgtgaaccagagcagcaagtgcagaaccgtgctggccagcccccagaagatcgagggcttcaagagactggactgccagagcgccatgttcaacgactacaacttcgtgttcaccagcttcgccaagaagcagcagcagcagcagagctag

SEQ ID NO: 72079 - DNA, 3360 bp, Artificial Sequence
  Description of Artificial Sequence: Synthetic coding sequence
atggccggcgcccccagaggcggcggcggcggcggcggcggcgccggcgagcccggcggcgccgagagagccgccggcaccagcagaagaagaggcctgagagcctgcgacgaggagttcgcctgccccgagctggaggccctgttcagaggctacaccctgagactggagcaggccgccaccctgaaggccctggccgtgctgagcctgctggccggcgccctggccctggccgagctgctgggcgcccccggccccgcccccggcctggccaagggcagccaccccgtgcactgcgtgctgttcctggccctgctggtggtgaccaacgtgagaagcctgcaggtgccccagctgcagcaggtgggccagctggccctgctgttcagcctgaccttcgccctgctgtgctgccccttcgccctgggcggccccgccagaggcagcgccggcgccgccggcggccccgccaccgccgagcagggcgtgtggcagctgctgctggtgaccttcgtgagctacgccctgctgcccgtgagaagcctgctggccatcggcttcggcctggtggtggccgccagccacctgctggtgaccgccaccctggtgcccgccaagagacccagactgtggagaaccctgggcgccaacgccctgctgttcgtgggcgtgaacatgtacggcgtgttcgtgagaatcctgaccgagagaagccagagaaaggccttcctgcaggccagaagctgcatcgaggacagactgagactggaggacgagaacgagaagcaggagagactgctgatgagcctgctgcccagaaacgtggccatggagatgaaggaggacttcctgaagccccccgagagaatcttccacaagatctacatccagagacacgacaacgtgagcatcctgttcgccgacatcgtgggcttcaccggcctggccagccagtgcaccgcccaggagctggtgaagctgctgaacgagctgttcggcaagttcgacgagctggccaccgagaaccactgcagaagaatcaagatcctgggcgactgctactactgcgtgagcggcctgacccagcccaagaccgaccacgcccactgctgcgtggagatgggcctggacatgatcgacaccatcaccagcgtggccgaggccaccgaggtggacctgaacatgagagtgggcctgcacaccggcagagtgctgtgcggcgtgctgggcctgagaaagtggcagtacgacgtgtggagcaacgacgtgaccctggccaacgtgatggaggccgccggcctgcccggcaaggtgcacatcaccaagaccaccctggcctgcctgaacggcgactacgaggtggagcccggctacggccacgagagaaacagcttcctgaagacccacaacatcgagaccttcttcatcgtgcccagccacagaagaaagatcttccccggcctgatcctgagcgacatcaagcccgccaagagaatgaagttcaagaccgtgtgctacctgctggtgcagctgatgcactgcagaaagatgttcaaggccgagatccccttcagcaacgtgatgacctgcgaggacgacgacaagagaagagccctgagaaccgccagcgagaagctgagaaacagaagcagcttcagcaccaacgtggtgtacaccacccccggcaccagagtgaacagatacatcagcagactgctggaggccagacagaccgagctggagatggccgacctgaacttcttcaccctgaagtacaagcacgtggagagagagcagaagtaccaccagctgcaggacgagtacttcaccagcgccgtggtgctgaccctgatcctggccgccctgttcggcctggtgtacctgctgatcttcccccagagcgtggtggtgctgctgctgctggtgttctgcatctgcttcctggtggcctgcgtgctgtacctgcacatcaccagagtgcagtgcttccccggctgcctgaccatccagatcagaaccgtgctgtgcatcttcatcgtggtgctgatctacagcgtggcccagggctgcgtggtgggctgcctgccctgggcctggagcagcaagcccaacagcagcctggtggtgctgagcagcggcggccagagaaccgccctgcccaccctgccctgcgagagcacccaccacgccctgctgtgctgcctggtgggcaccctgcccctggccatcttcttcagagtgagcagcctgcccaagatgatcctgctgagcggcctgaccaccagctacatcctggtgctggagctgagcggctacaccagaaccggcggcggcgccgtgagcggcagaagctacgagcccatcgtggccatcctgctgttcagctgcgccctggccctgcacgccagacaggtggacatcagactgagactggactacctgtgggccgcccaggccgaggaggagagagaggacatggagaaggtgaagctggacaacagaagaatcctgttcaacctgctgcccgcccacgtggcccagcacttcctgatgagcaaccccagaaacatggacctgtactaccagagctacagccaggtgggcgtgatgttcgccagcatccccaacttcaacgacttctacatcgagctggacggcaacaacatgggcgtggagtgcctgagactgctgaacgagatcatcgccgacttcgacgagctgatggagaaggacttctacaaggacatcgagaagatcaagaccatcggcagcacctacatggccgccgtgggcctggcccccaccagcggcaccaaggccaagaagagcatcagcagccacctgagcaccctggccgacttcgccatcgagatgttcgacgtgctggacgagatcaactaccagagctacaacgacttcgtgctgagagtgggcatcaacgtgggccccgtggtggccggcgtgatcggcgccagaagaccccagtacgacatctggggcaacaccgtgaacgtggccagcagaatggacagcaccggcgtgcagggcagaatccaggtgaccgaggaggtgcacagactgctgagaagatgcccctaccacttcgtgtgcagaggcaaggtgagcgtgaagggcaagggcgagatgctgacctacttcctggagggcagaaccgacggcaacggcagccagatcagaagcctgggcctggacagaaagatgtgccccttcggcagagccggcctgcagggcagaagaccccccgtgtgccccatgcccggcgtgagcgtgagagccggcctgcccccccacagccccggccagtacctgcccagcgccgccgccggcaaggaggcctag

SEQ ID NO: 72080 - DNA, 3174 bp, Artificial Sequence
  Description of Artificial Sequence: Synthetic coding sequence
atggccggcgcccccagaggcggcggcggcggcggcggcggcgccggcgagcccggcggcgccgagagagccgccggcaccagcagaagaagaggcctgagagcctgcgacgaggagttcgcctgccccgagctggaggccctgttcagaggctacaccctgagactggagcaggccgccaccctgaaggccctggccgtgctgagcctgctggccggcgccctggccctggccgagctgctgggcgcccccggccccgcccccggcctggccaagggcagccaccccgtgcactgcgtgctgttcctggccctgctggtggtgaccaacgtgagaagcctgcaggtgccccagctgcagcaggtgggccagctggccctgctgttcagcctgaccttcgccctgctgtgctgccccttcgccctgggcggccccgccagaggcagcgccggcgccgccggcggccccgccaccgccgagcagggcgtgtggcagctgctgctggtgaccttcgtgagctacgccctgctgcccgtgagaagcctgctggccatcggcttcggcctggtggtggccgccagccacctgctggtgaccgccaccctggtgcccgccaagagacccagactgtggagaaccctgggcgccaacgccctgctgttcgtgggcgtgaacatgtacggcgtgttcgtgagaatcctgaccgagagaagccagagaaaggccttcctgcaggccagaagctgcatcgaggacagactgagactggaggacgagaacgagaagcaggagagactgctgatgagcctgctgcccagaaacgtggccatggagatgaaggaggacttcctgaagccccccgagagaatcttccacaagatctacatccagagacacgacaacgtgagcatcctgttcgccgacatcgtgggcttcaccggcctggccagccagtgcaccgcccaggagctggtgaagctgctgaacgagctgttcggcaagttcgacgagctggccaccgagaaccactgcagaagaatcaagatcctgggcgactgctactactgcgtgagcggcctgacccagcccaagaccgaccacgcccactgctgcgtggagatgggcctggacatgatcgacaccatcaccagcgtggccgaggccaccgaggtggacctgaacatgagagtgggcctgcacaccggcagagtgctgtgcggcgtgctgggcctgagaaagtggcagtacgacgtgtggagcaacgacgtgaccctggccaacgtgatggaggccgccggcctgcccggcaaggtgcacatcaccaagaccaccctggcctgcctgaacggcgactacgaggtggagcccggctacggccacgagagaaacagcttcctgaagacccacaacatcgagaccttcttcatcgtgcccagccacagaagaaagatcttccccggcctgatcctgagcgacatcaagcccgccaagagaatgaagttcaagaccgtgtgctacctgctggtgcagctgatgcactgcagaaagatgttcaaggccgagatccccttcagcaacgtgatgacctgcgaggacgacgacaagagaagagccctgagaaccgccagcgagaagctgagaaacagaagcagcttcagcaccaacgtggtgtacaccacccccggcaccagagtgaacagatacatcagcagactgctggaggccagacagaccgagctggagatggccgacctgaacttcttcaccctgaagtacaagcacgtggagagagagcagaagtaccaccagctgcaggacgagtacttcaccagcgccgtggtgctgaccctgatcctggccgccctgttcggcctggtgtacctgctgatcttcccccagagcgtggtggtgctgctgctgctggtgttctgcatctgcttcctggtggcctgcgtgctgtacctgcacatcaccagagtgcagtgcttccccggctgcctgaccatccagatcagaaccgtgctgtgcatcttcatcgtggtgctgatctacagcgtggcccagggctgcgtggtgggctgcctgccctgggcctggagcagcaagcccaacagcagcctggtggtgctgagcagcggcggccagagaaccgccctgcccaccctgccctgcgagagcacccaccacgccctgctgtgctgcctggtgggcaccctgcccctggccatcttcttcagagtgagcagcctgcccaagatgatcctgctgagcggcctgaccaccagctacatcctggtgctggagctgagcggctacaccagaaccggcggcggcgccgtgagcggcagaagctacgagcccatcgtggccatcctgctgttcagctgcgccctggccctgcacgccagacaggtggacatcagactgagactggactacctgtgggccgcccaggccgaggaggagagagaggacatggagaaggtgaagctggacaacagaagaatcctgttcaacctgctgcccgcccacgtggcccagcacttcctgatgagcaaccccagaaacatggacctgtactaccagagctacagccaggtgggcgtgatgttcgccagcatccccaacttcaacgacttctacatcgagctggacggcaacaacatgggcgtggagtgcctgagactgctgaacgagatcatcgccgacttcgacgagctgatggagaaggacttctacaaggacatcgagaagatcaagaccatcggcagcacctacatggccgccgtgggcctggcccccaccagcggcaccaaggccaagaagagcatcagcagccacctgagcaccctggccgacttcgccatcgagatgttcgacgtgctggacgagatcaactaccagagctacaacgacttcgtgctgagagtgggcatcaacgtgggccccgtggtggccggcgtgatcggcgccagaagaccccagtacgacatctggggcaacaccgtgaacgtggccagcagaatggacagcaccggcgtgcagggcagaatccaggtgaccgaggaggtgcacagactgctgagaagatgcccccccctgtgcgtgcccagacagagccagtgccagggccagagaagagacgtggacatcctgagcagaagacaggactag

SEQ ID NO: 72081 - DNA, 3276 bp, Artificial Sequence
  Description of Artificial Sequence: Synthetic coding sequence
atgtggcaggaggccatgagaagaagaagatacctgagagacagaagcgaggaggccgccggcggcggcgacggcctgcccagaagcagagactggctgtacgagagctactactgcatgagccagcagcaccccctgatcgtgttcctgctgctgatcgtgatgggcagctgcctggccctgctggccgtgttcttcgccctgggcctggaggtggaggaccacgtggccttcctgatcaccgtgcccaccgccctggccatcttcttcgccatcttcatcctggtgtgcatcgagagcgtgttcaagaagctgctgagactgttcagcctggtgatctggatctgcctggtggccatgggctacctgttcatgtgcttcggcggcaccgtgagcccctgggaccaggtgagcttcttcctgttcatcatcttcgtggtgtacaccatgctgcccttcaacatgagagacgccatcatcgccagcgtgctgaccagcagcagccacaccatcgtgctgagcgtgtgcctgagcgccacccccggcggcaaggagcacctggtgtggcagatcctggccaacgtgatcatcttcatctgcggcaacctggccggcgcctaccacaagcacctgatggagctggccctgcagcagacctaccaggacacctgcaactgcatcaagagcagaatcaagctggagttcgagaagagacagcaggagagactgctgctgagcctgctgcccgcccacatcgccatggagatgaaggccgagatcatccagagactgcagggccccaaggccggccagatggagaacaccaacaacttccacaacctgtacgtgaagagacacaccaacgtgagcatcctgtacgccgacatcgtgggcttcaccagactggccagcgactgcagccccggcgagctggtgcacatgctgaacgagctgttcggcaagttcgaccagatcgccaaggagaacgagtgcatgagaatcaagatcctgggcgactgctactactgcgtgagcggcctgcccatcagcctgcccaaccacgccaagaactgcgtgaagatgggcctggacatgtgcgaggccatcaagaaggtgagagacgccaccggcgtggacatcaacatgagagtgggcgtgcacagcggcaacgtgctgtgcggcgtgatcggcctgcagaagtggcagtacgacgtgtggagccacgacgtgaccctggccaaccacatggaggccggcggcgtgcccggcagagtgcacatcagcagcgtgaccctggagcacctgaacggcgcctacaaggtggaggagggcgacggcgacatcagagacccctacctgaagcagcacctggtgaagacctacttcgtgatcaaccccaagggcgagagaagaagcccccagcacctgttcagacccagacacaccctggacggcgccaagatgagagccagcgtgagaatgaccagatacctggagagctggggcgccgccaagcccttcgcccacctgcaccacagagacagcatgaccaccgagaacggcaagatcagcaccaccgacgtgcccatgggccagcacaacttccagaacagaaccctgagaaccaagagccagaagaagagattcgaggaggagctgaacgagagaatgatccaggccatcgacggcatcaacgcccagaagcagtggctgaagagcgaggacatccagagaatcagcctgctgttctacaacaaggtgctggagaaggagtacagagccaccgccctgcccgccttcaagtactacgtgacctgcgcctgcctgatcttcttctgcatcttcatcgtgcagatcctggtgctgcccaagaccagcgtgctgggcatcagcttcggcgccgccttcctgctgctggccttcatcctgttcgtgtgcttcgccggccagctgctgcagtgcagcaagaaggccagccccctgctgatgtggctgctgaagagcagcggcatcatcgccaacagaccctggcccagaatcagcctgaccatcatcaccaccgccatcatcctgatgatggccgtgttcaacatgttcttcctgagcgacagcgaggagaccatcccccccaccgccaacaccaccaacaccagcttcagcgccagcaacaaccaggtggccatcctgagagcccagaacctgttcttcctgccctacttcatctacagctgcatcctgggcctgatcagctgcagcgtgttcctgagagtgaactacgagctgaagatgctgatcatgatggtggccctggtgggctacaacaccatcctgctgcacacccacgcccacgtgctgggcgactacagccaggtgctgttcgagagacccggcatctggaaggacctgaagaccatgggcagcgtgagcctgagcatcttcttcatcaccctgctggtgctgggcagacagaacgagtactactgcagactggacttcctgtggaagaacaagttcaagaaggagagagaggagatcgagaccatggagaacctgaacagagtgctgctggagaacgtgctgcccgcccacgtggccgagcacttcctggccagaagcctgaagaacgaggagctgtaccaccagagctacgactgcgtgtgcgtgatgttcgccagcatccccgacttcaaggagttctacaccgagagcgacgtgaacaaggagggcctggagtgcctgagactgctgaacgagatcatcgccgacttcgacgacctgctgagcaagcccaagttcagcggcgtggagaagatcaagaccatcggcagcacctacatggccgccaccggcctgagcgccgtgcccagccaggagcacagccaggagcccgagagacagtacatgcacatcggcaccatggtggagttcgccttcgccctggtgggcaagctggacgccatcaacaagcacagcttcaacgacttcaagctgagagtgggcatcaaccacggccccgtgatcgccggcgtgatcggcgcccagaagccccagtacgacatctggggcaacaccgtgaacgtggccagcagaatggacagcaccggcgtgctggacaagatccaggtgaccgaggagaccagcctggtgctgcagaccctgggctacacctgcacctgcagaggcatcatcaacgtgaagggcaagggcgacctgaagacctacttcgtgaacaccgagatgagcagaagcctgagccagagcaacgtggccagctag

SEQ ID NO: 72082 - DNA, 612 bp, Artificial Sequence
  Description of Artificial Sequence: Synthetic coding sequence
atggagaacctgaacagagtgctgctggagaacgtgctgcccgcccacgtggccgagcacttcctggccagaagcctgaagaacgaggagctgtaccaccagagctacgactgcgtgtgcgtgatgttcgccagcatccccgacttcaaggagttctacaccgagagcgacgtgaacaaggagggcctggagtgcctgagactgctgaacgagatcatcgccgacttcgacgacctgctgagcaagcccaagttcagcggcgtggagaagatcaagaccatcggcagcacctacatggccgccaccggcctgagcgccgtgcccagccaggagcacagccaggagcccgagagacagtacatgcacatcggcaccatggtggagttcgccttcgccctggtgggcaagctggacgccatcaacaagcacagcttcaacgacttcaagctgagagtgggcgtgaccgaggagaccagcctggtgctgcagaccctgggctacacctgcacctgcagaggcatcatcaacgtgaagggcaagggcgacctgaagacctacttcgtgaacaccgagatgagcagaagcctgagccagagcaacgtggccagctag

SEQ ID NO: 72083 - DNA, 2736 bp, Artificial Sequence
  Description of Artificial Sequence: Synthetic coding sequence
atggacctgagatgggccagagacctgcacctgagagaggccagcagaagcgtggccttcaccaccctgagactgggcgccgtgaccaccggcctgctgaccttcagagagcccggcgacaaggagaagagcggcaagggcctgggcaagagatggagaatccagagagaggagagccaggagagactgctgctgagcctgctgcccgcccacatcgccatggagatgaaggccgagatcatccagagactgcagggccccaaggccggccagatggagaacaccaacaacttccacaacctgtacgtgaagagacacaccaacgtgagcatcctgtacgccgacatcgtgggcttcaccagactggccagcgactgcagccccggcgagctggtgcacatgctgaacgagctgttcggcaagttcgaccagatcgccaaggagaacgagtgcatgagaatcaagatcctgggcgactgctactactgcgtgagcggcctgcccatcagcctgcccaaccacgccaagaactgcgtgaagatgggcctggacatgtgcgaggccatcaagaaggtgagagacgccaccggcgtggacatcaacatgagagtgggcgtgcacagcggcaacgtgctgtgcggcgtgatcggcctgcagaagtggcagtacgacgtgtggagccacgacgtgaccctggccaaccacatggaggccggcggcgtgcccggcagagtgcacatcagcagcgtgaccctggagcacctgaacggcgcctacaaggtggaggagggcgacggcgacatcagagacccctacctgaagcagcacctggtgaagacctacttcgtgatcaaccccaagggcgagagaagaagcccccagcacctgttcagacccagacacaccctggacggcgccaagatgagagccagcgtgagaatgaccagatacctggagagctggggcgccgccaagcccttcgcccacctgcaccacagagacagcatgaccaccgagaacggcaagatcagcaccaccgacgtgcccatgggccagcacaacttccagaacagaaccctgagaaccaagagccagaagaagagattcgaggaggagctgaacgagagaatgatccaggccatcgacggcatcaacgcccagaagcagtggctgaagagcgaggacatccagagaatcagcctgctgttctacaacaaggtgctggagaaggagtacagagccaccgccctgcccgccttcaagtactacgtgacctgcgcctgcctgatcttcttctgcatcttcatcgtgcagatcctggtgctgcccaagaccagcgtgctgggcatcagcttcggcgccgccttcctgctgctggccttcatcctgttcgtgtgcttcgccggccagctgctgcagtgcagcaagaaggccagccccctgctgatgtggctgctgaagagcagcggcatcatcgccaacagaccctggcccagaatcagcctgaccatcatcaccaccgccatcatcctgatgatggccgtgttcaacatgttcttcctgagcgacagcgaggagaccatcccccccaccgccaacaccaccaacaccagcttcagcgccagcaacaaccaggtggccatcctgagagcccagaacctgttcttcctgccctacttcatctacagctgcatcctgggcctgatcagctgcagcgtgttcctgagagtgaactacgagctgaagatgctgatcatgatggtggccctggtgggctacaacaccatcctgctgcacacccacgcccacgtgctgggcgactacagccaggtgctgttcgagagacccggcatctggaaggacctgaagaccatgggcagcgtgagcctgagcatcttcttcatcaccctgctggtgctgggcagacagaacgagtactactgcagactggacttcctgtggaagaacaagttcaagaaggagagagaggagatcgagaccatggagaacctgaacagagtgctgctggagaacgtgctgcccgcccacgtggccgagcacttcctggccagaagcctgaagaacgaggagctgtaccaccagagctacgactgcgtgtgcgtgatgttcgccagcatccccgacttcaaggagttctacaccgagagcgacgtgaacaaggagggcctggagtgcctgagactgctgaacgagatcatcgccgacttcgacgacctgctgagcaagcccaagttcagcggcgtggagaagatcaagaccatcggcagcacctacatggccgccaccggcctgagcgccgtgcccagccaggagcacagccaggagcccgagagacagtacatgcacatcggcaccatggtggagttcgccttcgccctggtgggcaagctggacgccatcaacaagcacagcttcaacgacttcaagctgagagtgggcatcaaccacggccccgtgatcgccggcgtgatcggcgcccagaagccccagtacgacatctggggcaacaccgtgaacgtggccagcagaatggacagcaccggcgtgctggacaagatccaggtgaccgaggagaccagcctggtgctgcagaccctgggctacacctgcacctgcagaggcatcatcaacgtgaagggcaagggcgacctgaagacctacttcgtgaacaccgagatgagcagaagcctgagccagagcaacgtggccagctag

SEQ ID NO: 72084 - DNA, 2775 bp, Artificial Sequence
  Description of Artificial Sequence: Synthetic coding sequence
atgctgcccttcaacatgagagacgccatcatcgccagcgtgctgaccagcagcagccacaccatcgtgctgagcgtgtgcctgagcgccacccccggcggcaaggagcacctggtgtggcagatcctggccaacgtgatcatcttcatctgcggcaacctggccggcgcctaccacaagcacctgatggagctggccctgcagcagacctaccaggacacctgcaactgcatcaagagcagaatcaagctggagttcgagaagagacagcaggagagactgctgctgagcctgctgcccgcccacatcgccatggagatgaaggccgagatcatccagagactgcagggccccaaggccggccagatggagaacaccaacaacttccacaacctgtacgtgaagagacacaccaacgtgagcatcctgtacgccgacatcgtgggcttcaccagactggccagcgactgcagccccggcgagctggtgcacatgctgaacgagctgttcggcaagttcgaccagatcgccaaggagaacgagtgcatgagaatcaagatcctgggcgactgctactactgcgtgagcggcctgcccatcagcctgcccaaccacgccaagaactgcgtgaagatgggcctggacatgtgcgaggccatcaagaaggtgagagacgccaccggcgtggacatcaacatgagagtgggcgtgcacagcggcaacgtgctgtgcggcgtgatcggcctgcagaagtggcagtacgacgtgtggagccacgacgtgaccctggccaaccacatggaggccggcggcgtgcccggcagagtgcacatcagcagcgtgaccctggagcacctgaacggcgcctacaaggtggaggagggcgacggcgacatcagagacccctacctgaagcagcacctggtgaagacctacttcgtgatcaaccccaagggcgagagaagaagcccccagcacctgttcagacccagacacaccctggacggcgccaagcccttcgcccacctgcaccacagagacagcatgaccaccgagaacggcaagatcagcaccaccgacgtgcccatgggccagcacaacttccagaacagaaccctgagaaccaagagccagaagaagagattcgaggaggagctgaacgagagaatgatccaggccatcgacggcatcaacgcccagaagcagtggctgaagagcgaggacatccagagaatcagcctgctgttctacaacaaggtgctggagaaggagtacagagccaccgccctgcccgccttcaagtactacgtgacctgcgcctgcctgatcttcttctgcatcttcatcgtgcagatcctggtgctgcccaagaccagcgtgctgggcatcagcttcggcgccgccttcctgctgctggccttcatcctgttcgtgtgcttcgccggccagctgctgcagtgcagcaagaaggccagccccctgctgatgtggctgctgaagagcagcggcatcatcgccaacagaccctggcccagaatcagcctgaccatcatcaccaccgccatcatcctgatgatggccgtgttcaacatgttcttcctgagcgacagcgaggagaccatcccccccaccgccaacaccaccaacaccagcttcagcgccagcaacaaccaggtggccatcctgagagcccagaacctgttcttcctgccctacttcatctacagctgcatcctgggcctgatcagctgcagcgtgttcctgagagtgaactacgagctgaagatgctgatcatgatggtggccctggtgggctacaacaccatcctgctgcacacccacgcccacgtgctgggcgactacagccaggtgctgttcgagagacccggcatctggaaggacctgaagaccatgggcagcgtgagcctgagcatcttcttcatcaccctgctggtgctgggcagacagaacgagtactactgcagactggacttcctgtggaagaacaagttcaagaaggagagagaggagatcgagaccatggagaacctgaacagagtgctgctggagaacgtgctgcccgcccacgtggccgagcacttcctggccagaagcctgaagaacgaggagctgtaccaccagagctacgactgcgtgtgcgtgatgttcgccagcatccccgacttcaaggagttctacaccgagagcgacgtgaacaaggagggcctggagtgcctgagactgctgaacgagatcatcgccgacttcgacgacctgctgagcaagcccaagttcagcggcgtggagaagatcaagaccatcggcagcacctacatggccgccaccggcctgagcgccgtgcccagccaggagcacagccaggagcccgagagacagtacatgcacatcggcaccatggtggagttcgccttcgccctggtgggcaagctggacgccatcaacaagcacagcttcaacgacttcaagctgagagtgggcatcaaccacggccccgtgatcgccggcgtgatcggcgcccagaagccccagtacgacatctggggcaacaccgtgaacgtggccagcagaatggacagcaccggcgtgctggacaagatccaggtgaccgaggagaccagcctggtgctgcagaccctgggctacacctgcacctgcagaggcatcatcaacgtgaagggcaagggcgacctgaagacctacttcgtgaacaccgagatgagcagaagcctgagccagagcaacgtggccagctag

SEQ ID NO: 72085 - DNA, 3435 bp, Artificial Sequence
  Description of Artificial Sequence: Synthetic coding sequence
atgcccagaaaccagggcttcagcgagcccgagtacagcgccgagtacagcgccgagtacagcgtgagcctgcccagcgaccccgacagaggcgtgggcagaacccacgagatcagcgtgagaaacagcggcagctgcctgtgcctgcccagattcatgagactgaccttcgtgcccgagagcctggagaacctgtaccagacctacttcaagagacagagacacgagaccctgctggtgctggtggtgttcgccgccctgttcgactgctacgtggtggtgatgtgcgccgtggtgttcagcagcgacaagctggccagcctggccgtggccggcatcggcctggtgctggacatcatcctgttcgtgctgtgcaagaagggcctgctgcccgacagagtgaccagaagagtgctgccctacgtgctgtggctgctgatcaccgcccagatcttcagctacctgggcctgaacttcgccagagcccacgccgccagcgacaccgtgggctggcaggtgttcttcgtgttcagcttcttcatcaccctgcccctgagcctgagccccatcgtgatcatcagcgtggtgagctgcgtggtgcacaccctggtgctgggcgtgaccgtggcccagcagcagcaggaggagctgaagggcatgcagctgctgagagagatcctggccaacgtgttcctgtacctgtgcgccatcgccgtgggcatcatgagctactacatggccgacagaaagcacagaaaggccttcctggaggccagacagagcctggaggtgaagatgaacctggaggagcagagccagcagcaggagaacctgatgctgagcatcctgcccaagcacgtggccgacgagatgctgaaggacatgaagaaggacgagagccagaaggaccagcagcagttcaacaccatgtacatgtacagacacgagaacgtgagcatcctgttcgccgacatcgtgggcttcacccagctgagcagcgcctgcagcgcccaggagctggtgaagctgctgaacgagctgttcgccagattcgacaagctggccgccaagtaccaccagctgagaatcaagatcctgggcgactgctactactgcatctgcggcctgcccgactacagagaggaccacgccgtgtgcagcatcctgatgggcctggccatggtggaggccatcagctacgtgagagagaagaccaagaccggcgtggacatgagagtgggcgtgcacaccggcaccgtgctgggcggcgtgctgggccagaagagatggcagtacgacgtgtggagcaccgacgtgaccgtggccaacaagatggaggccggcggcatccccggcagagtgcacatcagccagagcaccatggactgcctgaagggcgagttcgacgtggagcccggcgacggcggcagcagatgcgactacctggaggagaagggcatcgagacctacctgatcatcgccagcaagcccgaggtgaagaagaccgccacccagaacggcctgaacggcagcgccctgcccaacggcgcccccgccagcagcaagagcagcagccccgccctgatcgagaccaaggagcccaacggcagcgcccacagcagcggcagcaccagcgagaagcccgaggagcaggacgcccaggccgacaaccccagcttccccaaccccagaagaagactgagactgcaggacctggccgacagagtggtggacgccagcgaggacgagcacgagctgaaccagctgctgaacgaggccctgctggagagagagagcgcccaggtggtgaagaagagaaacaccttcctgctgagcatgagattcatggaccccgagatggagaccagatacagcgtggagaaggagaagcagagcggcgccgccttcagctgcagctgcgtggtgctgctgtgcaccgccctggtggagatcctgatcgacccctggctgatgaccaactacgtgaccttcatggtgggcgagatcctgctgctgatcctgaccatctgcagcctggccgccatcttccccagagccttccccaagaagctggtggccttcagcacctggatcgacagaaccagatgggccagaaacacctgggccatgctggccatcttcatcctggtgatggccaacgtggtggacatgctgagctgcctgcagtactacaccggccccagcaacgccaccgccggcatggagaccgagggcagctgcctggagaaccccaagtactacaactacgtggccgtgctgagcctgatcgccaccatcatgctggtgcaggtgagccacatggtgaagctgaccctgatgctgctggtggccggcgccgtggccaccatcaacctgtacgcctggagacccgtgttcgacgagtacgaccacaagagattcagagagcacgacctgcccatggtggccctggagcagatgcagggcttcaaccccggcctgaacggcaccgacagactgcccctggtgcccagcaagtacagcatgaccgtgatggtgttcctgatgatgctgagcttctactacttcagcagacacgtggagaagctggccagaaccctgttcctgtggaagatcgaggtgcacgaccagaaggagagagtgtacgagatgagaagatggaacgaggccctggtgaccaacatgctgcccgagcacgtggccagacacttcctgggcagcaagaagagagacgaggagctgtacagccagacctacgacgagatcggcgtgatgttcgccagcctgcccaacttcgccgacttctacaccgaggagagcatcaacaacggcggcatcgagtgcctgagattcctgaacgagatcatcagcgacttcgacagcctgctggacaaccccaagttcagagtgatcaccaagatcaagaccatcggcagcacctacatggccgccagcggcgtgacccccgacgtgaacaccaacggcttcgccagcagcaacaaggaggacaagagcgagagagagagatggcagcacctggccgacctggccgacttcgccctggccatgaaggacaccctgaccaacatcaacaaccagagcttcaacaacttcatgctgagaatcggcatgaacaagggcggcgtgctggccggcgtgatcggcgccagaaagccccactacgacatctggggcaacaccgtgaacgtggccagcagaatggagagcaccggcgtgatgggcaacatccaggtggtggaggagacccaggtgatcctgagagagtacggcttcagattcgtgagaagaggccccatcttcgtgaagggcaagggcgagctgctgaccttcttcctgaagggcagagacaagctggccaccttccccaacggccccagcgtgaccctgccccaccaggtggtggacaacagctag

SEQ ID NO: 72086 - DNA, 3360 bp, Artificial Sequence
  Description of Artificial Sequence: Synthetic coding sequence
atgcccagaaaccagggcttcagcgagcccgagtacagcgccgagtacagcgccgagtacagcgtgagcctgcccagattcatgagactgaccttcgtgcccgagagcctggagaacctgtaccagacctacttcaagagacagagacacgagaccctgctggtgctggtggtgttcgccgccctgttcgactgctacgtggtggtgatgtgcgccgtggtgttcagcagcgacaagctggccagcctggccgtggccggcatcggcctggtgctggacatcatcctgttcgtgctgtgcaagaagggcctgctgcccgacagagtgaccagaagagtgctgccctacgtgctgtggctgctgatcaccgcccagatcttcagctacctgggcctgaacttcgccagagcccacgccgccagcgacaccgtgggctggcaggtgttcttcgtgttcagcttcttcatcaccctgcccctgagcctgagccccatcgtgatcatcagcgtggtgagctgcgtggtgcacaccctggtgctgggcgtgaccgtggcccagcagcagcaggaggagctgaagggcatgcagctgctgagagagatcctggccaacgtgttcctgtacctgtgcgccatcgccgtgggcatcatgagctactacatggccgacagaaagcacagaaaggccttcctggaggccagacagagcctggaggtgaagatgaacctggaggagcagagccagcagcaggagaacctgatgctgagcatcctgcccaagcacgtggccgacgagatgctgaaggacatgaagaaggacgagagccagaaggaccagcagcagttcaacaccatgtacatgtacagacacgagaacgtgagcatcctgttcgccgacatcgtgggcttcacccagctgagcagcgcctgcagcgcccaggagctggtgaagctgctgaacgagctgttcgccagattcgacaagctggccgccaagtaccaccagctgagaatcaagatcctgggcgactgctactactgcatctgcggcctgcccgactacagagaggaccacgccgtgtgcagcatcctgatgggcctggccatggtggaggccatcagctacgtgagagagaagaccaagaccggcgtggacatgagagtgggcgtgcacaccggcaccgtgctgggcggcgtgctgggccagaagagatggcagtacgacgtgtggagcaccgacgtgaccgtggccaacaagatggaggccggcggcatccccggcagagtgcacatcagccagagcaccatggactgcctgaagggcgagttcgacgtggagcccggcgacggcggcagcagatgcgactacctggaggagaagggcatcgagacctacctgatcatcgccagcaagcccgaggtgaagaagaccgccacccagaacggcctgaacggcagcgccctgcccaacggcgcccccgccagcagcaagagcagcagccccgccctgatcgagaccaaggagcccaacggcagcgcccacagcagcggcagcaccagcgagaagcccgaggagcaggacgcccaggccgacaaccccagcttccccaaccccagaagaagactgagactgcaggacctggccgacagagtggtggacgccagcgaggacgagcacgagctgaaccagctgctgaacgaggccctgctggagagagagagcgcccaggtggtgaagaagagaaacaccttcctgctgagcatgagattcatggaccccgagatggagaccagatacagcgtggagaaggagaagcagagcggcgccgccttcagctgcagctgcgtggtgctgctgtgcaccgccctggtggagatcctgatcgacccctggctgatgaccaactacgtgaccttcatggtgggcgagatcctgctgctgatcctgaccatctgcagcctggccgccatcttccccagagccttccccaagaagctggtggccttcagcacctggatcgacagaaccagatgggccagaaacacctgggccatgctggccatcttcatcctggtgatggccaacgtggtggacatgctgagctgcctgcagtactacaccggccccagcaacgccaccgccggcatggagaccgagggcagctgcctggagaaccccaagtactacaactacgtggccgtgctgagcctgatcgccaccatcatgctggtgcaggtgagccacatggtgaagctgaccctgatgctgctggtggccggcgccgtggccaccatcaacctgtacgcctggagacccgtgttcgacgagtacgaccacaagagattcagagagcacgacctgcccatggtggccctggagcagatgcagggcttcaaccccggcctgaacggcaccgacagactgcccctggtgcccagcaagtacagcatgaccgtgatggtgttcctgatgatgctgagcttctactacttcagcagacacgtggagaagctggccagaaccctgttcctgtggaagatcgaggtgcacgaccagaaggagagagtgtacgagatgagaagatggaacgaggccctggtgaccaacatgctgcccgagcacgtggccagacacttcctgggcagcaagaagagagacgaggagctgtacagccagacctacgacgagatcggcgtgatgttcgccagcctgcccaacttcgccgacttctacaccgaggagagcatcaacaacggcggcatcgagtgcctgagattcctgaacgagatcatcagcgacttcgacagcctgctggacaaccccaagttcagagtgatcaccaagatcaagaccatcggcagcacctacatggccgccagcggcgtgacccccgacgtgaacaccaacggcttcgccagcagcaacaaggaggacaagagcgagagagagagatggcagcacctggccgacctggccgacttcgccctggccatgaaggacaccctgaccaacatcaacaaccagagcttcaacaacttcatgctgagaatcggcatgaacaagggcggcgtgctggccggcgtgatcggcgccagaaagccccactacgacatctggggcaacaccgtgaacgtggccagcagaatggagagcaccggcgtgatgggcaacatccaggtggtggaggagacccaggtgatcctgagagagtacggcttcagattcgtgagaagaggccccatcttcgtgaagggcaagggcgagctgctgaccttcttcctgaagggcagagacaagctggccaccttccccaacggccccagcgtgaccctgccccaccaggtggtggacaacagctag

SEQ ID NO: 72087 - DNA, 339 bp, Artificial Sequence
  Description of Artificial Sequence: Synthetic coding sequence
atgcccagaaaccagggcttcagcgagcccgagtacagcgccgagtacagcgccgagtacagcgtgagcctgcccagcgaccccgacagaggcgtgggcagaacccacgagatcagcgtgagaaacagcggcagctgcctgtgcctgcccagattcatgagactgaccttcgtgcccgagagcctggagaacctgtaccagacctacttcaagagacagagacacgagaccctgctggtgctggtggtgttcgccgccctgttcgactgctacgtggtggtgatgtgcgccgtggtgttcagcagcgacaagctggccagcctggccgtggccggctag

SEQ ID NO: 72088 - DNA, 3234 bp, Artificial Sequence
  Description of Artificial Sequence: Synthetic coding sequence
atggccagactgttcagccccagacccccccccagcgaggacctgttctacgagacctactacagcctgagccagcagtaccccctgctgctgctgctgctgggcatcgtgctgtgcgccctggccgccctgctggccgtggcctgggccagcggcagagagctgaccagcgaccccagcttcctgaccaccgtgctgtgcgccctgggcggcttcagcctgctgctgggcctggccagcagagagcagagactgcagagatggaccagacccctgagcggcctggtgtgggtggccctgctggccctgggccacgccttcctgttcaccggcggcgtggtgagcgcctgggaccaggtgagctacttcctgttcgtgatcttcaccgcctacgccatgctgcccctgggcatgagagacgccgccgtggccggcctggccagcagcctgagccacctgctggtgctgggcctgtacctgggcccccagcccgacagcagacccgccctgctgccccagctggccgccaacgccgtgctgttcctgtgcggcaacgtggccggcgtgtaccacaaggccctgatggagagagccctgagagccaccttcagagaggccctgagcagcctgcacagcagaagaagactggacaccgagaagaagcaccaggagcacctgctgctgagcatcctgcccgcctacctggccagagagatgaaggccgagatcatggccagactgcaggccggccagggcagcagacccgagagcaccaacaacttccacagcctgtacgtgaagagacaccagggcgtgagcgtgctgtacgccgacatcgtgggcttcaccagactggccagcgagtgcagccccaaggagctggtgctgatgctgaacgagctgttcggcaagttcgaccagatcgccaaggagcacgagtgcatgagaatcaagatcctgggcgactgctactactgcgtgagcggcctgcccctgagcctgcccgaccacgccatcaactgcgtgagaatgggcctggacatgtgcagagccatcagaaagctgagagccgccaccggcgtggacatcaacatgagagtgggcgtgcacagcggcagcgtgctgtgcggcgtgatcggcctgcagaagtggcagtacgacgtgtggagccacgacgtgaccctggccaaccacatggaggccggcggcgtgcccggcagagtgcacatcaccggcgccaccctggccctgctggccggcgcctacgccgtggaggacgccggcatggagcacagagacccctacctgagagagctgggcgagcccacctacctggtgatcgaccccagagccgaggaggaggacgagaagggcaccgccggcggcctgctgagcagcctggagggcctgaagatgagacccagcctgctgatgaccagatacctggagagctggggcgccgccaagcccttcgcccacctgagccacggcgacagccccgtgagcaccagcacccccctgcccgagaagaccctggccagcttcagcacccagtggagcctggacagaagcagaacccccagaggcctggacgacgagctggacaccggcgacgccaagttcttccaggtgatcgagcagctgaacagccagaagcagtggaagcagagcaaggacttcaaccccctgaccctgtacttcagagagaaggagatggagaaggagtacagactgagcgccatccccgccttcaagtactacgaggcctgcaccttcctggtgttcctgagcaacttcatcatccagatgctggtgaccaacagaccccccgccctggccatcacctacagcatcaccttcctgctgttcctgctgatcctgttcgtgtgcttcagcgaggacctgatgagatgcgtgctgaagggccccaagatgctgcactggctgcccgccctgagcggcctggtggccaccagacccggcctgagaatcgccctgggcaccgccaccatcctgctggtgttcgccatggccatcaccagcctgttcttcttccccaccagcagcgactgccccttccaggcccccaacgtgagcagcatgatcagcaacctgagctgggagctgcccggcagcctgcccctgatcagcgtgccctacagcatgcactgctgcaccctgggcttcctgagctgcagcctgttcctgcacatgagcttcgagctgaagctgctgctgctgctgctgtggctggccgccagctgcagcctgttcctgcacagccacgcctggctgagcgagtgcctgatcgtgagactgtacctgggccccctggacagcagacccggcgtgctgaaggagcccaagctgatgggcgccatcagcttcttcatcttcttcttcaccctgctggtgctggccagacagaacgagtactactgcagactggacttcctgtggaagaagaagctgagacaggagagagaggagaccgagaccatggagaacctgaccagactgctgctggagaacgtgctgcccgcccacgtggccccccagttcatcggccagaacagaagaaacgaggacctgtaccaccagagctacgagtgcgtgtgcgtgctgttcgccagcgtgcccgacttcaaggagttctacagcgagagcaacatcaaccacgagggcctggagtgcctgagactgctgaacgagatcatcgccgacttcgacgagctgctgagcaagcccaagttcagcggcgtggagaagatcaagaccatcggcagcacctacatggccgccaccggcctgaacgccaccagcggccaggacgcccagcaggacgccgagagaagctgcagccacctgggcaccatggtggagttcgccgtggccctgggcagcaagctggacgtgatcaacaagcacagcttcaacaacttcagactgagagtgggcctgaaccacggccccgtggtggccggcgtgatcggcgcccagaagccccagtacgacatctggggcaacaccgtgaacgtggccagcagaatggagagcaccggcgtgctgggcaagatccaggtgaccgaggagaccgcctgggccctgcagagcctgggctacacctgctacagcagaggcgtgatcaaggtgaagggcaagggccagctgtgcacctacttcctgaacaccgacctgaccagaaccggcccccccagcgccaccctgggctag

SEQ ID NO: 72089 - DNA, 1260 bp, Artificial Sequence
  Description of Artificial Sequence: Synthetic coding sequence
atgagcagaggcaccagagagagcgcctgctgcatgctgaccagctgggccagcagaggctggcccgccagcgtgcccctgagaagctggtgcagctgcagcatgagcagcctggccagcagcaccagactgcccagaaagctgagagccgccaccggcgtggacatcaacatgagagtgggcgtgcacagcggcagcgtgctgtgcggcgtgatcggcctgcagaagtggcagtacgacgtgtggagccacgacgtgaccctggccaaccacatggaggccggcggcgtgcccggcagagtgcacatcaccggcgccaccctggccctgctggccggcgcctacgccgtggaggacgccggcatggagcacagagacccctacctgagagagctgggcgagcccacctacctggtgatcgaccccagagccgaggaggaggacgagaagggcaccgccggcggcctgctgagcagcctggagggcctgaagatgagacccagcctgctgatgaccagatacctggagagctggggcgccgccaagcccttcgcccacctgagccacggcgacagccccgtgagcaccagcacccccctgcccgagaagaccctggccagcttcagcacccagtggagcctggacagaagcagaacccccagaggcctggacgacgagctggacaccggcgacgccaagttcttccaggtgatcgagcagctgaacagccagaagcagtggaagcagagcaaggacttcaaccccctgaccctgtacttcagagagaaggagatggagaaggagtacagactgagcgccatccccgccttcaagtactacgaggcctgcaccttcctggtgttcctgagcaacttcatcatccagatgctggtgaccaacagaccccccgccctggccatcacctacagcatcaccttcctgctgttcctgctgatcctgttcgtgtgcttcagcgaggacctgatgagatgcgtgctgaagggccccaagatgctgcactggctgcccgccctgagcggcctggtggccaccagacccggcctgagaatcgccctgggcaccgccaccatcctgctggtgttcgccatggccatcaccagcctgttcttcttccccaccagcagcgactgccccttccaggcccccaacgtgagcagcatgatcagcaacctgagctgggagctgcccggcagcctgcccctgatcagcgtgcccgtgagcgtgcccacctgcccctag

SEQ ID NO: 72090 - DNA, 3234 bp, Artificial Sequence; identical to SEQ ID NO: 72088
  Description of Artificial Sequence: Synthetic coding sequence

SEQ ID NO: 72091 - DNA, 3234 bp, Artificial Sequence; identical to SEQ ID NO: 72088
  Description of Artificial Sequence: Synthetic coding sequence

SEQ ID NO: 72092 - DNA, 348 bp, Artificial Sequence
  Description of Artificial Sequence: Synthetic coding sequence
atggccagactgttcagccccagacccccccccagcgaggacctgttctacgagacctactacagcctgagccagcagtaccccctgctgctgctgctgctgggcatcgtgctgtgcgccctggccgccctgctggccgtggcctgggccagcggcagagagctgaccagcgaccccagcttcctgaccaccgtgctgtgcgccctgggcggcttcagcctgctgctgggcctggccagcagagagcagagactgcagagatggaccagacccctgagcggcctggtgtgggtggccctgctggccctgggccacgccttcctgttcaccggcggcgtggtgagctag

SEQ ID NO: 72093 - DNA, 2736 bp, Artificial Sequence
  Description of Artificial Sequence: Synthetic coding sequence
atgaagagccagaaggagggctgctgcagcagaggcgacctgagcatccagaccggccccggcggcgagtgggcccccagaagactggtgagcaacgtgctgatcttcagctgcaccaacatcgtgggcgtgtgcacccactaccccgccgaggtgagccagagacaggccttccaggagaccagagagtgcatccaggccagactgcacagccagagagagaaccagcagcaggagagactgctgctgagcgtgctgcccagacacgtggccatggagatgaaggccgacatcaacgccaagcaggaggacatgatgttccacaagatctacatccagaagcacgacaacgtgagcatcctgttcgccgacatcgagggcttcaccagcctggccagccagtgcaccgcccaggagctggtgatgaccctgaacgagctgttcgccagattcgacaagctggccgccgagaaccactgcctgagaatcaagatcctgggcgactgctactactgcgtgagcggcctgcccgaggccagagccgaccacgcccactgctgcgtggagatgggcatggacatgatcgaggccatcagcctggtgagagaggtgaccggcgtgaacgtgaacatgagagtgggcatccacagcggcagagtgcactgcggcgtgctgggcctgagaaagtggcagttcgacgtgtggagcaacgacgtgaccctggccaaccacatggaggccggcggcaaggccggcagaatccacatcaccaaggccaccctgaactacctgaacggcgactacgaggtggagcccggctgcggcggcgagagaaacgcctacctgaaggagcacagcatcgagaccttcctgatcctgagatgcacccagaagagaaaggaggagaaggccatgatcgccaagatgaacagacagagaaccaacagcatcggccacaaccccccccactggggcgccgagagacccttctacaaccacctgggcggcaaccaggtgagcaaggagatgaagagaatgggcttcgaggaccccaaggacaagaacgcccaggagagcgccaaccccgaggacgaggtggacgagttcctgggcagagccatcgacgccagaagcatcgacagactgagaagcgagcacgtgagaaagttcctgctgaccttcagagagcccgacctggagaagaagtacagcaagcaggtggacgacagattcggcgcctacgtggcctgcgccagcctggtgttcctgttcatctgcttcgtgcagatcaccatcgtgccccacagcatcttcatgctgagcttctacctgacctgcagcctgctgctgaccctggtggtgttcgtgagcgtgatctacagctgcgtgaagctgttccccagccccctgcagaccctgagcagaaagatcgtgagaagcaagatgaacagcaccctggtgggcgtgttcaccatcaccctggtgttcctggccgccttcgtgaacatgttcacctgcaacagcagagacctgctgggctgcctggcccaggagcacaacatcagcgccagccaggtgaacgcctgccacgtggccgagagcgccgtgaactacagcctgggcgacgagcagggcttctgcggcagcccctggcccaactgcaacttccccgagtacttcacctacagcgtgctgctgagcctgctggcctgcagcgtgttcctgcagatcagctgcatcggcaagctggtgctgatgctggccatcgagctgatctacgtgctgatcgtggaggtgcccggcgtgaccctgttcgacaacgccgacctgctggtgaccgccaacgccatcgacttcttcaacaacggcaccagccagtgccccgagcacgccaccaaggtggccctgaaggtggtgacccccatcatcatcagcgtgttcgtgctggccctgtacctgcacgcccagcaggtggagagcaccgccagactggacttcctgtggaagctgcaggccaccgaggagaaggaggagatggaggagctgcaggcctacaacagaagactgctgcacaacatcctgcccaaggacgtggccgcccacttcctggccagagagagaagaaacgacgagctgtactaccagagctgcgagtgcgtggccgtgatgttcgccagcatcgccaacttcagcgagttctacgtggagctggaggccaacaacgagggcgtggagtgcctgagactgctgaacgagatcatcgccgacttcgacgagatcatcagcgaggacagattcagacagctggagaagatcaagaccatcggcagcacctacatggccgccagcggcctgaacgacagcacctacgacaaggtgggcaagacccacatcaaggccctggccgacttcgccatgaagctgatggaccagatgaagtacatcaacgagcacagcttcaacaacttccagatgaagatcggcctgaacatcggccccgtggtggccggcgtgatcggcgccagaaagccccagtacgacatctggggcaacaccgtgaacgtggccagcagaatggacagcaccggcgtgcccgacagaatccaggtgaccaccgacatgtaccaggtgctggccgccaacacctaccagctggagtgcagaggcgtggtgaaggtgaagggcaagggcgagatgatgacctacttcctgaacggcggcccccccctgagctag

SEQ ID NO: 72094 - DNA, 3786 bp, Artificial Sequence
  Description of Artificial Sequence: Synthetic coding sequence
atgagcggcagcaagagcgtgagcccccccggctacgccgcccagaagaccgccgcccccgcccccagaggcggccccgagcacagaagcgcctggggcgaggccgacagcagagccaacggctacccccacgcccccggcggcagcgccagaggcagcaccaagaagcccggcggcgccgtgaccccccagcagcagcagagactggccagcagatggagaagcgacgacgacgacgacccccccctgagcggcgacgaccccctggccggcggcttcggcttcagcttcagaagcaagagcgcctggcaggagagaggcggcgacgactgcggcagaggcagcagaagacagagaagaggcgccgccagcggcggcagcaccagagccccccccgccggcggcggcggcggcagcgccgccgccgccgccagcgccggcggcaccgaggtgagacccagaagcgtggaggtgggcctggaggagagaagaggcaagggcagagccgccgacgagctggaggccggcgccgtggagggcggcgagggcagcggcgacggcggcagcagcgccgacagcggcagcggcgccggccccggcgccgtgctgagcctgggcgcctgctgcctggccctgctgcagatcttcagaagcaagaagttccccagcgacaagctggagagactgtaccagagatacttcttcagactgaaccagagcagcctgaccatgctgatggccgtgctggtgctggtgtgcctggtgatgctggccttccacgccgccagaccccccctgcagctgccctacctggccgtgctggccgccgccgtgggcgtgatcctgatcatggccgtgctgtgcaacagagccgccttccaccaggaccacatgggcctggcctgctacgccctgatcgccgtggtgctggccgtgcaggtggtgggcctgctgctgccccagcccagaagcgccagcgagggcatctggtggaccgtgttcttcatctacaccatctacaccctgctgcccgtgagaatgagagccgccgtgctgagcggcgtgctgctgagcgccctgcacctggccatcgccctgagaaccaacgcccaggaccagttcctgctgaagcagctggtgagcaacgtgctgatcttcagctgcaccaacatcgtgggcgtgtgcacccactaccccgccgaggtgagccagagacaggccttccaggagaccagagagtgcatccaggccagactgcacagccagagagagaaccagcagcaggagagactgctgctgagcgtgctgcccagacacgtggccatggagatgaaggccgacatcaacgccaagcaggaggacatgatgttccacaagatctacatccagaagcacgacaacgtgagcatcctgttcgccgacatcgagggcttcaccagcctggccagccagtgcaccgcccaggagctggtgatgaccctgaacgagctgttcgccagattcgacaagctggccgccgagaaccactgcctgagaatcaagatcctgggcgactgctactactgcgtgagcggcctgcccgaggccagagccgaccacgcccactgctgcgtggagatgggcatggacatgatcgaggccatcagcctggtgagagaggtgaccggcgtgaacgtgaacatgagagtgggcatccacagcggcagagtgcactgcggcgtgctgggcctgagaaagtggcagttcgacgtgtggagcaacgacgtgaccctggccaaccacatggaggccggcggcaaggccggcagaatccacatcaccaaggccaccctgaactacctgaacggcgactacgaggtggagcccggctgcggcggcgagagaaacgcctacctgaaggagcacagcatcgagaccttcctgatcctgagatgcacccagaagagaaaggaggagaaggccatgatcgccaagatgaacagacagagaaccaacagcatcggccacaaccccccccactggggcgccgagagacccttctacaaccacctgggcggcaaccaggtgagcaaggagatgaagagaatgggcttcgaggaccccaaggacaagaacgcccaggagagcgccaaccccgaggacgaggtggacgagttcctgggcagagccatcgacgccagaagcatcgacagactgagaagcgagcacgtgagaaagttcctgctgaccttcagagagcccgacctggagaagaagtacagcaagcaggtggacgacagattcggcgcctacgtggcctgcgccagcctggtgttcctgttcatctgcttcgtgcagatcaccatcgtgccccacagcatcttcatgctgagcttctacctgacctgcagcctgctgctgaccctggtggtgttcgtgagcgtgatctacagctgcgtgaagctgttccccagccccctgcagaccctgagcagaaagatcgtgagaagcaagatgaacagcaccctggtgggcgtgttcaccatcaccctggtgttcctggccgccttcgtgaacatgttcacctgcaacagcagagacctgctgggctgcctggcccaggagcacaacatcagcgccagccaggtgaacgcctgccacgtggccgagagcgccgtgaactacagcctgggcgacgagcagggcttctgcggcagcccctggcccaactgcaacttccccgagtacttcacctacagcgtgctgctgagcctgctggcctgcagcgtgttcctgcagatcagctgcatcggcaagctggtgctgatgctggccatcgagctgatctacgtgctgatcgtggaggtgcccggcgtgaccctgttcgacaacgccgacctgctggtgaccgccaacgccatcgacttcttcaacaacggcaccagccagtgccccgagcacgccaccaaggtggccctgaaggtggtgacccccatcatcatcagcgtgttcgtgctggccctgtacctgcacgcccagcaggtggagagcaccgccagactggacttcctgtggaagctgcaggccaccgaggagaaggaggagatggaggagctgcaggcctacaacagaagactgctgcacaacatcctgcccaaggacgtggccgcccacttcctggccagagagagaagaaacgacgagctgtactaccagagctgcgagtgcgtggccgtgatgttcgccagcatcgccaacttcagcgagttctacgtggagctggaggccaacaacgagggcgtggagtgcctgagactgctgaacgagatcatcgccgacttcgacgagatcatcagcgaggacagattcagacagctggagaagatcaagaccatcggcagcacctacatggccgccagcggcctgaacgacagcacctacgacaaggtgggcaagacccacatcaaggccctggccgacttcgccatgaagctgatggaccagatgaagtacatcaacgagcacagcttcaacaacttccagatgaagatcggcctgaacatcggccccgtggtggccggcgtgatcggcgccagaaagccccagtacgacatctggggcaacaccgtgaacgtggccagcagaatggacagcaccggcgtgcccgacagaatccaggtgaccaccgacatgtaccaggtgctggccgccaacacctaccagctggagtgcagaggcgtggtgaaggtgaagggcaagggcgagatgatgacctacttcctgaacggcggcccccccctgagctag

SEQ ID NO: 72095 - DNA, 2760 bp, Artificial Sequence
  Description of Artificial Sequence: Synthetic coding sequence
atggcccccagcagattcagaacccagctggagctggtgagcaacgtgctgatcttcagctgcaccaacatcgtgggcgtgtgcacccactaccccgccgaggtgagccagagacaggccttccaggagaccagagagtgcatccaggccagactgcacagccagagagagaaccagcagcaggagagactgctgctgagcgtgctgcccagacacgtggccatggagatgaaggccgacatcaacgccaagcaggaggacatgatgttccacaagatctacatccagaagcacgacaacgtgagcatcctgttcgccgacatcgagggcttcaccagcctggccagccagtgcaccgcccaggagctggtgatgaccctgaacgagctgttcgccagattcgacaagctggccgccgagaaccactgcctgagaatcaagatcctgggcgactgctactactgcgtgagcggcctgcccgaggccagagccgaccacgcccactgctgcgtggagatgggcatggacatgatcgaggccatcagcctggtgagagaggtgaccggcgtgaacgtgaacatgagagtgggcatccacagcggcagagtgcactgcggcgtgctgggcctgagaaagtggcagttcgacgtgtggagcaacgacgtgaccctggccaaccacatggaggccggcggcaaggccggcagaatccacatcaccaaggccaccctgaactacctgaacggcgactacgaggtggagcccggctgcggcggcgagagaaacgcctacctgaaggagcacagcatcgagaccttcctgatcctgagatgcacccagaagagaaaggaggagaaggccatgatcgccaagatgaacagacagagaaccaacagcatcggccacaaccccccccactggggcgccgagagacccttctacaaccacctgggcggcaaccaggtgagcaaggagatgaagagaatgggcttcgaggaccccaaggacaagaacgcccaggagagcgccaaccccgaggacgaggtggacgagttcctgggcagagccatcgacgccagaagcatcgacagactgagaagcgagcacgtgagaaagttcctgctgaccttcagagagcccgacctggagaagaagtacagcaagcaggtggacgacagattcggcgcctacgtggcctgcgccagcctggtgttcctgttcatctgcttcgtgcagatcaccatcgtgccccacagcatcttcatgctgagcttctacctgacctgcagcctgctgctgaccctggtggtgttcgtgagcgtgatctacagctgcgtgaagctgttccccagccccctgcagaccctgagcagaaagatcgtgagaagcaagatgaacagcaccctggtgggcgtgttcaccatcaccctggtgttcctggccgccttcgtgaacatgttcacctgcaacagcagagacctgctgggctgcctggcccaggagcacaacatcagcgccagccaggtgaacgcctgccacgtggccgagagcgccgtgaactacagcctgggcgacgagcagggcttctgcggcagcccctggcccaactgcaacttccccgagtacttcacctacagcgtgctgctgagcctgctggcctgcagcgtgttcctgcagatcagctgcatcggcaagctggtgctgatgctggccatcgagctgatctacgtgctgatcgtggaggtgcccggcgtgaccctgttcgacaacgccgacctgctggtgaccgccaacgccatcgacttcttcaacaacggcaccagccagtggagcctgtgcgagaacctgagacacagaagaatggaggccggcacctacttccccagcggcgtgaaggagcagagccccgagcacgccaccaaggtggccctgaaggtggtgacccccatcatcatcagcgtgttcgtgctggccctgtacctgcacgcccagcaggtggagagcaccgccagactggacttcctgtggaagctgcaggccaccgaggagaaggaggagatggaggagctgcaggcctacaacagaagactgctgcacaacatcctgcccaaggacgtggccgcccacttcctggccagagagagaagaaacgacgagctgtactaccagagctgcgagtgcgtggccgtgatgttcgccagcatcgccaacttcagcgagttctacgtggagctggaggccaacaacgagggcgtggagtgcctgagactgctgaacgagatcatcgccgacttcgacgagatcatcagcgaggacagattcagacagctggagaagatcaagaccatcggcagcacctacatggccgccagcggcctgaacgacagcacctacgacaaggtgggcaagacccacatcaaggccctggccgacttcgccatgaagctgatggaccagatgaagtacatcaacgagcacagcttcaacaacttccagatgaagatcggcctgaacatcggccccgtggtggccggcgtgatcggcgccagaaagccccagtacgacatctggggcaacaccgtgaacgtggccagcagaatggacagcaccggcgtgcccgacagaatccaggtgaccaccgacatgtaccaggtgctggccgccaacacctaccagctggagtgcagaggcgtggtgaaggtgaagggcaagggcgagatgatgacctacttcctgaacggcggcccccccctgagctag

SEQ ID NO: 72096 - DNA, 3507 bp, Artificial Sequence
  Description of Artificial Sequence: Synthetic coding sequence
atgagctggttcagcggcctgctggtgcccaaggtggacgagagaaagaccgcctggggcgagagaaacggccagaagagaagcagaagaagaggcaccagagccggcggcttctgcacccccagatacatgagctgcctgagagacgccgagccccccagccccacccccgccggcccccccagatgcccctggcaggacgacgccttcatcagaagaggcggccccggcaagggcaaggagctgggcctgagagccgtggccctgggcttcgaggacaccgaggtgaccaccaccgccggcggcaccgccgaggtggcccccgacgccgtgcccagaagcggcagaagctgctggagaagactggtgcaggtgttccagagcaagcagttcagaagcgccaagctggagagactgtaccagagatacttcttccagatgaaccagagcagcctgaccctgctgatggccgtgctggtgctgctgaccgccgtgctgctggccttccacgccgcccccgccagaccccagcccgcctacgtggccctgctggcctgcgccgccgccctgttcgtgggcctgatggtggtgtgcaacagacacagcttcagacaggacagcatgtgggtggtgagctacgtggtgctgggcatcctggccgccgtgcaggtgggcggcgccctggccgccgaccccagaagccccagcgccggcctgtggtgccccgtgttcttcgtgtacatcgcctacaccctgctgcccatcagaatgagagccgccgtgctgagcggcctgggcctgagcaccctgcacctgatcctggcctggcagctgaacagaggcgacgccttcctgtggaagcagctgggcgccaacgtgctgctgttcctgtgcaccaacgtgatcggcatctgcacccactaccccgccgaggtgagccagagacaggccttccaggagaccagaggctacatccaggccagactgcacctgcagcacgagaacagacagcaggagagactgctgctgagcgtgctgccccagcacgtggccatggagatgaaggaggacatcaacaccaagaaggaggacatgatgttccacaagatctacatccagaagcacgacaacgtgagcatcctgttcgccgacatcgagggcttcaccagcctggccagccagtgcaccgcccaggagctggtgatgaccctgaacgagctgttcgccagattcgacaagctggccgccgagaaccactgcctgagaatcaagatcctgggcgactgctactactgcgtgagcggcctgcccgaggccagagccgaccacgcccactgctgcgtggagatgggcgtggacatgatcgaggccatcagcctggtgagagaggtgaccggcgtgaacgtgaacatgagagtgggcatccacagcggcagagtgcactgcggcgtgctgggcctgagaaagtggcagttcgacgtgtggagcaacgacgtgaccctggccaaccacatggaggccggcggcagagccggcagaatccacatcaccagagccaccctgcagtacctgaacggcgactacgaggtggagcccggcagaggcggcgagagaaacgcctacctgaaggagcagcacatcgagaccttcctgatcctgggcgccagccagaagagaaaggaggagaaggccatgctggccaagctgcagagaaccagagccaacagcatggagggcctgatgcccagatgggtgcccgacagagccttcagcagaaccaaggacagcaaggccttcagacagatgggcatcgacgacagcagcaaggacaacagaggcacccaggacgccctgaaccccgaggacgaggtggacgagttcctgagcagagccatcgacgccagaagcatcgaccagctgagaaaggaccacgtgagaagattcctgctgaccttccagagagaggacctggagaagaagtacagcagaaaggtggaccccagattcggcgcctacgtggcctgcgccctgctggtgttctgcttcatctgcttcatccagctgctgatcttcccccacagcaccctgatgctgggcatctacgccagcatcttcctgctgctgctgatcaccgtgctgatctgcgccgtgtacagctgcggcagcctgttccccaaggccctgcagagactgagcagaagcatcgtgagaagcagagcccacagcaccgccgtgggcatcttcagcgtgctgctggtgttcaccagcgccatcgccaacatgttcacctgcaaccacacccccatcagaagctgcgccgccagaatgctgaacctgacccccgccgacatcaccgcctgccacctgcagcagctgaactacagcctgggcctggacgcccccctgtgcgagggcaccatgcccacctgcagcttccccgagtacttcatcggcaacatgctgctgagcctgctggccagcagcgtgttcctgcacatcagcagcatcggcaagctggccatgatcttcgtgctgggcctgatctacctggtgctgctgctgctgggcccccccgccaccatcttcgacaactacgacctgctgctgggcgtgcacggcctggccagcagcaacgagaccttcgacggcctggactgccccgccgccggcagagtggccctgaagtacatgacccccgtgatcctgctggtgttcgccctggccctgtacctgcacgcccagcaggtggagagcaccgccagactggacttcctgtggaagctgcaggccaccggcgagaaggaggagatggaggagctgcaggcctacaacagaagactgctgcacaacatcctgcccaaggacgtggccgcccacttcctggccagagagagaagaaacgacgagctgtactaccagagctgcgagtgcgtggccgtgatgttcgccagcatcgccaacttcagcgagttctacgtggagctggaggccaacaacgagggcgtggagtgcctgagactgctgaacgagatcatcgccgacttcgacgagatcatcagcgaggagagattcagacagctggagaagatcaagaccatcggcagcacctacatggccgccagcggcctgaacgccagcacctacgaccaggtgggcagaagccacatcaccgccctggccgactacgccatgagactgatggagcagatgaagcacatcaacgagcacagcttcaacaacttccagatgaagatcggcctgaacatgggccccgtggtggccggcgtgatcggcgccagaaagccccagtacgacatctggggcaacaccgtgaacgtgagcagcagaatggacagcaccggcgtgcccgacagaatccaggtgaccaccgacctgtaccaggtgctggccgccaagggctaccagctggagtgcagaggcgtggtgaaggtgaagggcaagggcgagatgaccacctacttcctgaacggcggccccagcagctag

SEQ ID NO: 72097 - DNA, 3348 bp, Artificial Sequence
  Description of Artificial Sequence: Synthetic coding sequence
atgagctggttcagcggcctgctggtgcccaaggtggacgagagaaagaccgcctggggcgagagaaacggccagaagagaagcagaagaagaggcaccagagccggcggcttctgcacccccagatacatgagctgcctgagagacgccgagccccccagccccacccccgccggcccccccagatgcccctggcaggacgacgccttcatcagaagaggcggccccggcaagggcaaggagctgggcctgagagccgtggccctgggcttcgaggacaccgaggtgaccaccaccgccggcggcaccgccgaggtggcccccgacgccgtgcccagaagcggcagaagctgctggagaagactggtgcaggtgttccagagcaagcagttcagaagcgccaagctggagagactgtaccagagatacttcttccagatgaaccagagcagcctgaccctgctgatggccgtgctggtgctgctgaccgccgtgctgctggccttccacgccgcccccgccagaccccagcccgcctacgtggccctgctggcctgcgccgccgccctgttcgtgggcctgatggtggtgtgcaacagacacagcttcagacaggacagcatgtgggtggtgagctacgtggtgctgggcatcctggccgccgtgcaggtgggcggcgccctggccgccgaccccagaagccccagcgccggcctgtggtgccccgtgttcttcgtgtacatcgcctacaccctgctgcccatcagaatgagagccgccgtgctgagcggcctgggcctgagcaccctgcacctgatcctggcctggcagctgaacagaggcgacgccttcctgtggaagcagctgggcgccaacgtgctgctgttcctgtgcaccaacgtgatcggcatctgcacccactaccccgccgaggtgagccagagacaggccttccaggagaccagaggctacatccaggccagactgcacctgcagcacgagaacagacagcaggagagactgctgctgagcgtgctgccccagcacgtggccatggagatgaaggaggacatcaacaccaagaaggaggacatgatgttccacaagatctacatccagaagcacgacaacgtgagcatcctgttcgccgacatcgagggcttcaccagcctggccagccagtgcaccgcccaggagctggtgatgaccctgaacgagctgttcgccagattcgacaagctggccgccgagaaccactgcctgagaatcaagatcctgggcgactgctactactgcgtgagcggcctgcccgaggccagagccgaccacgcccactgctgcgtggagatgggcgtggacatgatcgaggccatcagcctggtgagagaggtgaccggcgtgaacgtgaacatgagagtgggcatccacagcggcagagtgcactgcggcgtgctgggcctgagaaagtggcagttcgacgtgtggagcaacgacgtgaccctggccaaccacatggaggccggcggcagagccggcagaatccacatcaccagagccaccctgcagtacctgaacggcgactacgaggtggagcccggcagaggcggcgagagaaacgcctacctgaaggagcagcacatcgagaccttcctgatcctgggcgccagccagaagagaaaggaggagaaggccatgctggccaagctgcagagaaccagagccaacagcatggagggcctgatgcccagatgggtgcccgacagagccttcagcagaaccaaggacagcaaggccttcagacagatgggcatcgacgacagcagcaaggacaacagaggcacccaggacgccctgaaccccgaggacgaggtggacgagttcctgagcagagccatcgacgccagaagcatcgaccagctgagaaaggaccacgtgagaagattcctgctgaccttccagagagaggacctggagaagaagtacagcagaaaggtggaccccagattcggcgcctacgtggcctgcgccctgctggtgttctgcttcatctgcttcatccagctgctgatcttcccccacagcaccctgatgctgggcatctacgccagcatcttcctgctgctgctgatcaccgtgctgatctgcgccgtgtacagctgcggcagcctgttccccaaggccctgcagagactgagcagaagcatcgtgagaagcagagcccacagcaccgccgtgggcatcttcagcgtgctgctggtgttcaccagcgccatcgccaacatgtacttcatcggcaacatgctgctgagcctgctggccagcagcgtgttcctgcacatcagcagcatcggcaagctggccatgatcttcgtgctgggcctgatctacctggtgctgctgctgctgggcccccccgccaccatcttcgacaactacgacctgctgctgggcgtgcacggcctggccagcagcaacgagaccttcgacggcctggactgccccgccgccggcagagtggccctgaagtacatgacccccgtgatcctgctggtgttcgccctggccctgtacctgcacgcccagcaggtggagagcaccgccagactggacttcctgtggaagctgcaggccaccggcgagaaggaggagatggaggagctgcaggcctacaacagaagactgctgcacaacatcctgcccaaggacgtggccgcccacttcctggccagagagagaagaaacgacgagctgtactaccagagctgcgagtgcgtggccgtgatgttcgccagcatcgccaacttcagcgagttctacgtggagctggaggccaacaacgagggcgtggagtgcctgagactgctgaacgagatcatcgccgacttcgacgagatcatcagcgaggagagattcagacagctggagaagatcaagaccatcggcagcacctacatggccgccagcggcctgaacgccagcacctacgaccaggtgggcagaagccacatcaccgccctggccgactacgccatgagactgatggagcagatgaagcacatcaacgagcacagcttcaacaacttccagatgaagatcggcctgaacatgggccccgtggtggccggcgtgatcggcgccagaaagccccagtacgacatctggggcaacaccgtgaacgtgagcagcagaatggacagcaccggcgtgcccgacagaatccaggtgaccaccgacctgtaccaggtgctggccgccaagggctaccagctggagtgcagaggcgtggtgaaggtgaagggcaagggcgagatgaccacctacttcctgaacggcggccccagcagctag

SEQ ID NO: 72098 - DNA, 3348 bp, Artificial Sequence; identical to SEQ ID NO: 72097
  Description of Artificial Sequence: Synthetic coding sequence

SEQ ID NO: 72099 - DNA, 3243 bp, Artificial Sequence
  Description of Artificial Sequence: Synthetic coding sequence
atgcccgccaagggcagatacttcctgaacgagggcgaggagggccccgaccaggacgccctgtacgagaagtaccagctgaccagccagcacggccccctgctgctgaccctgctgctggtggccgccaccgcctgcgtggccctgatcatcatcgccttcagccagggcgaccccagcagacaccaggccatcctgggcatggccttcctggtgctggccgtgttcgccgccctgagcgtgctgatgtacgtggagtgcctgctgagaagatggctgagagccctggccctgctgacctgggcctgcctggtggccctgggctacgtgctggtgttcgacgcctggaccaaggccgcctgcgcctgggagcaggtgcccttcttcctgttcatcgtgttcgtggtgtacaccctgctgcccttcagcatgagaggcgccgtggccgtgggcgccgtgagcaccgccagccacctgctggtgctgggcagcctgatgggcggcttcaccacccccagcgtgagagtgggcctgcagctgctggccaacgccgtgatcttcctgtgcggcaacctgaccggcgccttccacaagcaccagatgcaggacgccagcagagacctgttcacctacaccgtgaagtgcatccagatcagaagaaagctgagaatcgagaagagacagcaggagaacctgctgctgagcgtgctgcccgcccacatcagcatgggcatgaagctggccatcatcgagagactgaaggagcacggcgacagaagatgcatgcccgacaacaacttccacagcctgtacgtgaagagacaccagaacgtgagcatcctgtacgccgacatcgtgggcttcacccagctggccagcgactgcagccccaaggagctggtggtggtgctgaacgagctgttcggcaagttcgaccagatcgccaaggccaacgagtgcatgagaatcaagatcctgggcgactgctactactgcgtgagcggcctgcccgtgagcctgcccacccacgccagaaactgcgtgaagatgggcctggacatgtgccaggccatcaagcaggtgagagaggccaccggcgtggacatcaacatgagagtgggcatccacagcggcaacgtgctgtgcggcgtgatcggcctgagaaagtggcagtacgacgtgtggagccacgacgtgagcctggccaacagaatggaggccgccggcgtgcccggcagagtgcacatcaccgaggccaccctgaagcacctggacaaggcctacgaggtggaggacggccacggccagcagagagacccctacctgaaggagatgaacatcagaacctacctggtgatcgaccccagaagccagcagccccccccccccagccagcacctgcccagacccaagggcgacgccgccctgaagatgagagccagcgtgagaatgaccagatacctggagagctggggcgccgccagacccttcgcccacctgaaccacagagagagcgtgagcagcggcgagacccacgtgcccaacggcagaagacccaagagcgtgccccagagacacagaagaacccccgacagaagcatgagccccaagggcagaagcgaggacgacagctacgacgacgagatgctgagcgccatcgagggcctgagcagcaccagaccctgctgcagcaagagcgacgacttctacaccttcggcagcatcttcctggagaagggcttcgagagagagtacagactggcccccatccccagagccagacacgacttcgcctgcgccagcctgatcttcgtgtgcatcctgctggtgcacgtgctgctgatgcccagaaccgccgccctgggcgtgagcttcggcctggtggcctgcgtgctgggcctggtgctgggcctgtgcttcgccaccaagttcagcagatgctgccccgccagaggcaccctgtgcaccatcagcgagagagtggagacccagcccctgctgagactgaccctggccgtgctgaccatcggcagcctgctgaccgtggccatcatcaacctgcccctgatgcccttccaggtgcccgagctgcccgtgggcaacgagaccggcctgctggccgccagcagcaagaccagagccctgtgcgagcccctgccctactacacctgcagctgcgtgctgggcttcatcgcctgcagcgtgttcctgagaatgagcctggagcccaaggtggtgctgctgaccgtggccctggtggcctacctggtgctgttcaacctgagcccctgctggcagtgggactgctgcggccagggcctgggcaacctgaccaagcccaacggcaccaccagcggcacccccagctgcagctggaaggacctgaagaccatgaccaacttctacctggtgctgttctacatcaccctgctgaccctgagcagacagatcgactactactgcagactggactgcctgtggaagaagaagttcaagaaggagcacgaggagttcgagaccatggagaacgtgaacagactgctgctggagaacgtgctgcccgcccacgtggccgcccacttcatcggcgacaagctgaacgaggactggtaccaccagagctacgactgcgtgtgcgtgatgttcgccagcgtgcccgacttcaaggtgttctacaccgagtgcgacgtgaacaaggagggcctggagtgcctgagactgctgaacgagatcatcgccgacttcgacgagctgctgctgaagcccaagttcagcggcgtggagaagatcaagaccatcggcagcacctacatggccgccgccggcctgagcgtggccagcggccacgagaaccaggagctggagagacagcacgcccacatcggcgtgatggtggagttcagcatcgccctgatgagcaagctggacggcatcaacagacacagcttcaacagcttcagactgagagtgggcatcaaccacggccccgtgatcgccggcgtgatcggcgccagaaagccccagtacgacatctggggcaacaccgtgaacgtggccagcagaatggagagcaccggcgagctgggcaagatccaggtgaccgaggagacctgcaccatcctgcagggcctgggctacagctgcgagtgcagaggcctgatcaacgtgaagggcaagggcgagctgagaacctacttcgtgtgcaccgacaccgccaagttccagggcctgggcctgaactag

SEQ ID NO: 72100 - DNA, 3243 bp, Artificial Sequence; identical to SEQ ID NO: 72099
  Description of Artificial Sequence: Synthetic coding sequence

SEQ ID NO: 72101 - DNA, 1302 bp, Artificial Sequence
  Description of Artificial Sequence: Synthetic coding sequence
atgcccgccaagggcagatacttcctgaacgagggcgaggagggccccgaccaggacgccctgtacgagaagtaccagctgaccagccagcacggccccctgctgctgaccctgctgctggtggccgccaccgcctgcgtggccctgatcatcatcgccttcagccagggcgaccccagcagacaccaggccatcctgggcatggccttcctggtgctggccgtgttcgccgccctgagcgtgctgatgtacgtggagtgcctgctgagaagatggctgagagccctggccctgctgacctgggcctgcctggtggccctgggctacgtgctggtgttcgacgcctggaccaaggccgcctgcgcctgggagcaggtgcccttcttcctgttcatcgtgttcgtggtgtacaccctgctgcccttcagcatgagaggcgccgtggccgtgggcgccgtgagcaccgccagccacctgctggtgctgggcagcctgatgggcggcttcaccacccccagcgtgagagtgggcctgcagctgctggccaacgccgtgatcttcctgtgcggcaacctgaccggcgccttccacaagcaccagatgcaggacgccagcagagacctgttcacctacaccgtgaagtgcatccagatcagaagaaagctgagaatcgagaagagacagcaggagaacctgctgctgagcgtgctgcccgcccacatcagcatgggcatgaagctggccatcatcgagagactgaaggagcacggcgacagaagatgcatgcccgacaacaacttccacagcctgtacgtgaagagacaccagaacgtgagcatcctgtacgccgacatcgtgggcttcacccagctggccagcgactgcagccccaaggagctggtggtggtgctgaacgagctgttcggcaagttcgaccagatcgccaaggccaacgagtgcatgagaatcaagatcctgggcgactgctactactgcgtgagcggcctgcccgtgagcctgcccacccacgccagaaactgcgtgaagatgggcctggacatgtgccaggccatcaagcaggtgagagaggccaccggcgtggacatcaacatgagagtgggcatccacagcggcaacgtgctgtgcggcgtgatcggcctgagaaagtggcagtacgacgtgtggagccacgacgtgagcctggccaacagaatggaggccgccggcgtgcccggcagagtgcacatcaccgaggccaccctgaagcacctggacaaggccctgctgctgcaggtgagatag

SEQ ID NO: 72102 - DNA, 2205 bp, Artificial Sequence
  Description of Artificial Sequence: Synthetic coding sequence
atgcccgccaagggcagatacttcctgaacgagggcgaggagggccccgaccaggacgccctgtacgagaagtaccagctgaccagccagcacggccccctgctgctgaccctgctgctggtggccgccaccgcctgcgtggccctgatcatcatcgccttcagccagggcgaccccagcagacaccaggccatcctgggcatggccttcctggtgctggccgtgttcgccgccctgagcgtgctgatgtacgtggagtgcctgctgagaagatggctgagagccctggccctgctgacctgggcctgcctggtggccctgggctacgtgctggtgttcgacgcctggaccaaggccgcctgcgcctgggagcaggtgcccttcttcctgttcatcgtgttcgtggtgtacaccctgctgcccttcagcatgagaggcgccgtggccgtgggcgccgtgagcaccgccagccacctgctggtgctgggcagcctgatgggcggcttcaccacccccagcgtgagagtgggcctgcagctgctggccaacgccgtgatcttcctgtgcggcaacctgaccggcgccttccacaagcaccagatgcaggacgccagcagagacctgttcacctacaccgtgaagtgcatccagatcagaagaaagctgagaatcgagaagagacagcaggagaacctgctgctgagcgtgctgcccgcccacatcagcatgggcatgaagctggccatcatcgagagactgaaggagcacggcgacagaagatgcatgcccgacaacaacttccacagcctgtacgtgaagagacaccagaacgtgagcatcctgtacgccgacatcgtgggcttcacccagctggccagcgactgcagccccaaggagctggtggtggtgctgaacgagctgttcggcaagttcgaccagatcgccaaggccaacgagtgcatgagaatcaagatcctgggcgactgctactactgcgtgagcggcctgcccgtgagcctgcccacccacgccagaaactgcgtgaagatgggcctggacatgtgccaggccatcaagcaggtgagagaggccaccggcgtggacatcaacatgagagtgggcatccacagcggcaacgtgctgtgcggcgtgatcggcctgagaaagtggcagtacgacgtgtggagccacgacgtgagcctggccaacagaatggaggccgccggcgtgcccggcagagtgcacatcaccgaggccaccctgaagcacctggacaaggcctacgaggtggaggacggccacggccagcagagagacccctacctgaaggagatgaacatcagaacctacctggtgatcgaccccagaagccagcagccccccccccccagccagcacctgcccagacccaagggcgacgccgccctgaagatgagagccagcgtgagaatgaccagatacctggagagctggggcgccgccagacccttcgcccacctgaaccacagagagagcgtgagcagcggcgagacccacgtgcccaacggcagaagacccaagagcgtgccccagagacacagaagaacccccgacagaagcatgagccccaagggcagaagcgaggacgacagctacgacgacgagatgctgagcgccatcgagggcctgagcagcaccagaccctgctgcagcaagagcgacgacttctacaccttcggcagcatcttcctggagaagggcttcgagagagagtacagactggcccccatccccagagccagacacgacttcgcctgcgccagcctgatcttcgtgtgcatcctgctggtgcacgtgctgctgatgcccagaaccgccgccctgggcgtgagcttcggcctggtggcctgcgtgctgggcctggtgctgggcctgtgcttcgccaccaagttcagcagatgctgccccgccagaggcaccctgtgcaccatcagcgagagagtggagacccagcccctgctgagactgaccctggccgtgctgaccatcggcagcctgctgaccgtggccatcatcaacctgcccctgatgcccttccaggtgcccgagctgcccgtgggcaacgagaccggcctgctggccgccagcagcaagaccagagccctgtgcgagcccctgccccacctgcacaccgtgttcagcagactgaacgagctgaccagctag

SEQ ID NO: 72103 - DNA, 3756 bp, Artificial Sequence
  Description of Artificial Sequence: Synthetic coding sequence
atggagctgagcgacgtgagatgcctgaccggcagcgaggagctgtacaccatccaccccaccccccccgccggcgacggcagaagcgccagcagaccccagagactgctgtggcagaccgccgtgagacacatcaccgagcagagattcatccacggccacagaggcggcagcggcagcggcagcggcggcagcggcaaggccagcgaccccgccggcggcggccccaaccaccacgccccccagctgagcggcgacagcgccctgcccctgtacagcctgggccccggcgagagagcccacagcacctgcggcaccaaggtgttccccgagagaagcggcagcggcagcgccagcggcagcggcggcggcggcgacctgggcttcctgcacctggactgcgcccccagcaacagcgacttcttcctgaacggcggctacagctacagaggcgtgatcttccccaccctgagaaacagcttcaagagcagagacctggagagactgtaccagagatacttcctgggccagagaagaaagagcgaggtggtgatgaacgtgctggacgtgctgaccaagctgaccctgctggtgctgcacctgagcctggccagcgcccccatggaccccctgaagggcatcctgctgggcttcttcaccggcatcgaggtggtgatctgcgccctggtggtggtgagaaaggacaccaccagccacacctacctgcagtacagcggcgtggtgacctgggtggccatgaccacccagatcctggccgccggcctgggctacggcctgctgggcgacggcatcggctacgtgctgttcaccctgttcgccacctacagcatgctgcccctgcccctgacctgggccatcctggccggcctgggcaccagcctgctgcaggtgatcctgcaggtggtgatccccagactggccgtgatcagcatcaaccaggtggtggcccaggccgtgctgttcatgtgcatgaacaccgccggcatcttcatcagctacctgagcgacagagcccagagacaggccttcctggagaccagaagatgcgtggaggccagactgagactggagaccgagaaccagagacaggagagactggtgctgagcgtgctgcccagattcgtggtgctggagatgatcaacgacatgaccaacgtggaggacgagcacctgcagcaccagttccacagaatctacatccacagatacgagaacgtgagcatcctgttcgccgacgtgaagggcttcaccaacctgagcaccaccctgagcgcccaggagctggtgagaatgctgaacgagctgttcgccagattcgacagactggcccacgagcaccactgcctgagaatcaagatcctgggcgactgctactactgcgtgagcggcctgcccgagcccagacaggaccacgcccactgctgcgtggagatgggcctgagcatgatcaagaccatcagatacgtgagaagcagaaccaagcacgacgtggacatgagaatcggcatccacagcggcagcgtgctgtgcggcgtgctgggcctgagaaagtggcagttcgacgtgtggagctgggacgtggacatcgccaacaagctggagagcggcggcatccccggcagaatccacatcagcaaggccaccctggactgcctgaacggcgactacaacgtggaggagggccacggcaaggagagaaacgagttcctgagaaagcacaacatcgagacctacctgatcaagcagcccgaggacagcctgctgagcctgcccgaggacatcgtgaaggagagcgtgagcagcagcgacagaagaaacagcggcgccaccttcaccgagggcagctggagccccgagctgcccttcgacaacatcgtgggcaagcagaacaccctggccgccctgaccagaaacagcatcaacctgctgcccaaccacctggcccaggccctgcacgtgcagagcggccccgaggagatcaacaagagaatcgagcacaccatcgacctgagaagcggcgacaagctgagaagagagcacatcaagcccttcagcctgatgttcaaggacagcagcctggagcacaagtacagccagatgagagacgaggtgttcaagagcaacctggtgtgcgccttcatcgtgctgctgttcatcaccgccatccagagcctgctgcccagcagcagagtgatgcccatgaccatccagttcagcatcctgatcatgctgcacagcgccctggtgctgatcaccaccgccgaggactacaagtgcctgcccctgatcctgagaaagacctgctgctggatcaacgagacctacctggccagaaacgtgatcatcttcgccagcatcctgatcaacttcctgggcgccatcctgaacatcctgtggtgcgacttcgacaagagcatccccctgaagaacctgaccttcaacagcagcgccgtgttcaccgacatctgcagctaccccgagtacttcgtgttcaccggcgtgctggccatggtgacctgcgccgtgttcctgagactgaacagcgtgctgaagctggccgtgctgctgatcatgatcgccatctacgccctgctgaccgagaccgtgtacgccggcctgttcctgagatacgacaacctgaaccacagcggcgaggacttcctgggcaccaaggaggtgagcctgctgctgatggccatgttcctgctggccgtgttctaccacggccagcagctggagtacaccgccagactggacttcctgtggagagtgcaggccaaggaggagatcaacgagatgaaggagctgagagagcacaacgagaacatgctgagaaacatcctgcccagccacgtggccagacacttcctggagaaggacagagacaacgaggagctgtacagccagagctacgacgccgtgggcgtgatgttcgccagcatccccggcttcgccgacttctacagccagaccgagatgaacaaccagggcgtggagtgcctgagactgctgaacgagatcatcgccgacttcgacgagctgctgggcgaggacagattccaggacatcgagaagatcaagaccatcggcagcacctacatggccgtgagcggcctgagccccgagaagcagcagtgcgaggacaagtggggccacctgtgcgccctggccgacttcagcctggccctgaccgagagcatccaggagatcaacaagcacagcttcaacaacttcgagctgagaatcggcatcagccacggcagcgtggtggccggcgtgatcggcgccaagaagccccagtacgacatctggggcaagaccgtgaacctggccagcagaatggacagcaccggcgtgagcggcagaatccaggtgcccgaggagacctacctgatcctgaaggaccagggcttcgccttcgactacagaggcgagatctacgtgaagggcatcagcgagcaggagggcaagatcaagacctacttcctgctgggcagagtgcagcccaaccccttcatcctgccccccagaagactgcccggccagtacagcctggccgccgtggtgctgggcctggtgcagagcctgaacagacagagacagaagcagctgctgaacgagaacaacaacaccggcatcatcaagggccactacaacagaagaaccctgctgagccccagcggcaccgagcccggcgcccaggccgagggcaccgacaagagcgacctgccctag

SEQ ID NO: 72104 - DNA, 4062 bp, Artificial Sequence
  Description of Artificial Sequence: Synthetic coding sequence
atggccagccccccccaccagcagctgctgcaccaccacagcaccgaggtgagctgcgacagcagcggcgacagcaacagcgtgagagtgaagatcaaccccaagcagctgagcagcaacagccaccccaagcactgcaagtacagcatcagcagcagctgcagcagcagcggcgacagcggcggcgtgcccagaagagtgggcggcggcggcagactgagaagacagaagaagctgccccagctgttcgagagagccagcagcagatggtgggaccccaagttcgacagcgtgaacctggaggaggcctgcctggagagatgcttcccccagacccagagaagattcagatacgccctgttctacatcggcttcgcctgcctgctgtggagcatctacttcgccgtgcacatgagaagcagactgatcgtgatggtggcccccgccctgtgcttcctgctggtgtgcgtgggcttcttcctgttcaccttcaccaagctgtacgccagacactacgcctggaccagcctggccctgaccctgctggtgttcgccctgaccctggccgcccagttccaggtgctgacccccgtgagcggcagaggcgacagcagcaacctgaccgccaccgccagacccaccgacacctgcctgagccaggtgggcagcttcagcatgtgcatcgaggtgctgttcctgctgtacaccgtgatgcacctgcccctgtacctgagcctgtgcctgggcgtggcctacagcgtgctgttcgagaccttcggctaccacttcagagacgaggcctgcttccccagccccggcgccggcgccctgcactgggagctgctgagcagaggcctgctgcacggctgcatccacgccatcggcgtgcacctgttcgtgatgagccaggtgagaagcagaagcaccttcctgaaggtgggccagagcatcatgcacggcaaggacctggaggtggagaaggccctgaaggagagaatgatccacagcgtgatgcccagaatcatcgccgacgacctgatgaagcagggcgacgaggagagcgagaacagcgtgaagagacacgccaccagcagccccaagaacagaaagaagaagagcagcatccagaaggcccccatcgccttcagacccttcaagatgcagcagatcgaggaggtgagcatcctgttcgccgacatcgtgggcttcaccaagatgagcgccaacaagagcgcccacgccctggtgggcctgctgaacgacctgttcggcagattcgacagactgtgcgaggagaccaagtgcgagaagatcagcaccctgggcgactgctactactgcgtggccggctgccccgagcccagagccgaccacgcctactgctgcatcgagatgggcctgggcatgatcaaggccatcgagcagttctgccaggagaagaaggagatggtgaacatgagagtgggcgtgcacaccggcaccgtgctgtgcggcatcctgggcatgagaagattcaagttcgacgtgtggagcaacgacgtgaacctggccaacctgatggagcagctgggcgtggccggcaaggtgcacatcagcgaggccaccgccaagtacctggacgacagatacgagatggaggacggcaaggtgatcgagagactgggccagagcgtggtggccgaccagctgaagggcctgaagacctacctgatcagcggccagagagccaaggagagcagatgcagctgcgccgaggccctgctgagcggcttcgaggtgatcgacggcagccaggtgagcagcggccccagaggccagggcaccgccagcagcggcaacgtgagcgacctggcccagaccgtgaagaccttcgacaacctgaagacctgccccagctgcggcatcaccttcgcccccaagagcgaggccggcgccgagggcggcgccccccagaacggctgccaggacgagcacaagaacagcaccaaggccagcggcggccccaaccccaagacccagaacggcctgctgagccccccccaggaggagaagctgaccaacagccagaccagcctgtgcgagatcctgcaggagaagggcagatgggccggcgtgagcctggaccagagcgccctgctgcccctgagattcaagaacatcagagagaagaccgacgcccacttcgtggacgtgatcaaggaggacagcctgatgaaggactacttcttcaagccccccatcaaccagttcagcctgaacttcctggaccaggagctggagagaagctacagaaccagctaccaggaggaggtgatcaagaacagccccgtgaagaccttcgccagccccaccttcagcagcctgctggacgtgttcctgagcaccaccgtgttcctgaccctgagcaccacctgcttcctgaagtacgaggccgccaccgtgccccccccccccgccgccctggccgtgttcagcgccgccctgctgctggaggtgctgagcctggccgtgagcatcagaatggtgttcttcctggaggacgtgatggcctgcaccaagagactgctggagtggatcgccggctggctgcccagacactgcatcggcgccatcctggtgagcctgcccgccctggccgtgtacagccacgtgaccagcgagtacgagaccaacatccacttccccgtgttcaccggcagcgccgccctgatcgccgtggtgcactactgcaacttctgccagctgagcagctggatgagaagcagcctggccaccgtggtgggcgccggccccctgctgctgctgtacgtgagcctgtgccccgacagcagcgtgctgaccagccccctggacgccgtgcagaacttcagcagcgagagaaacccctgcaacagcagcgtgcccagagacctgagaagacccgccagcctgatcggccaggaggtggtgctggtgttcttcctgctgctgctgctggtgtggttcctgaacagagagttcgaggtgagctacagactgcactaccacggcgacgtggaggccgacctgcacagaaccaagatccagagcatgagagaccaggccgactggctgctgagaaacatcatcccctaccacgtggccgagcagctgaaggtgagccagacctacagcaagaaccacgacagcggcggcgtgatcttcgccagcatcgtgaacttcagcgagttctacgaggagaactacgagggcggcaaggagtgctacagagtgctgaacgagctgatcggcgacttcgacgagctgctgagcaagcccgactacagcagcatcgagaagatcaagaccatcggcgccacctacatggccgccagcggcctgaacaccgcccaggcccaggacggcagccacccccaggagcacctgcagatcctgttcgagttcgccaaggagatgatgagagtggtggacgacttcaacaacaacatgctgtggttcaacttcaagctgagagtgggcttcaaccacggccccctgaccgccggcgtgatcggcaccaccaagctgctgtacgacatctggggcgacaccgtgaacatcgccagcagaatggacaccaccggcgtggagtgcagaatccaggtgagcgaggagagctacagagtgctgagcaagatgggctacgacttcgactacagaggcaccgtgaacgtgaagggcaagggccagatgaagacctacctgtaccccaagtgcaccgaccacagagtgatcccccagcaccagctgagcatcagccccgacatcagagtgcaggtggacggcagcatcggcagaagccccaccgacgagatcgccaacctggtgcccagcgtgcagtacgtggacaagaccagcctgggcagcgacagcagcacccaggccaaggacgcccacctgagccccaagagaccctggaaggagcccgtgaaggccgaggagagaggcagattcggcaaggccatcgagaaggacgactgcgacgagaccggcatcgaggaggccaacgagctgaccaagctgaacgtgagcaagagcgtgtag

SEQ ID NO: 72105 - DNA, 531 bp, Artificial Sequence
  Description of Artificial Sequence: Synthetic coding sequence
atgaccatgtgcagcggcgccagactggccctgctggtgtacggcatcatcatgcacagcagcgtgtacagcagccccgccgccgccggcctgagattccccggcatcagacccgaggaggaggcctacggcgaggacggcaaccccctgcccgacttcgacggcagcgagccccccggcgccggcagccccgccagcgcccccagagccgccgccgcctggtacagacccgccggcagaagagacgtggcccacggcatcctgaacgaggcctacagaaaggtgctggaccagctgagcgccggcaagcacctgcagagcctggtggccagaggcgtgggcggcagcctgggcggcggcgccggcgacgacgccgagcccctgagcaagagacacagcgacggcatcttcaccgacagctacagcagatacagaaagcagatggccgtgaagaagtacctggccgccgtgctgggcaagagatacaagcagagagtgaagaacaagggcagaagaatcgcctacctgtag

SEQ ID NO: 72106 - DNA, 531 bp, Artificial Sequence; identical to SEQ ID NO: 72105
  Description of Artificial Sequence: Synthetic coding sequence

SEQ ID NO: 72107 - DNA, 948 bp, Artificial Sequence
  Description of Artificial Sequence: Synthetic coding sequence
atgctgaccaagagagccctgcagaagccctgcagcgacagattcctgagaaccgcccagatcaacagaagcagaagacccgtgaccagcgtgaccagcggcagcagcagcagaagcagagccagcccccacagacccctgttcctgagcagcgccagcctgagcgccccccccagcctgagagtgaccctgccccccggcagcgccagactgcagaccttcgagcagaacaccagcctgggcaagagagtgccccagctgctgctgctgctgcccctggtgcccgccgccagcgcccagacccccacccccgacggcgacgccagcagagtggtgacccccgcccaggagctggaggaggccctgtgcccccccagctacctggccgccctgctggccgccggcggcgtggagggcatgaccatgtgcagcggcgccagactggccctgctggtgtacggcatcatcatgcacagcagcgtgtacagcagccccgccgccgccggcctgagattccccggcatcagacccgaggaggaggcctacggcgaggacggcaaccccctgcccgacttcgacggcagcgagccccccggcgccggcagccccgccagcgcccccagagccgccgccgcctggtacagacccgccggcagaagagacgtggcccacggcatcctgaacgaggcctacagaaaggtgctggaccagctgagcgccggcaagcacctgcagagcctggtggccagaggcgtgggcggcagcctgggcggcggcgccggcgacgacgccgagcccctgagcaagagacacagcgacggcatcttcaccgacagctacagcagatacagaaagcagatggccgtgaagaagtacctggccgccgtgctgggcaagagatacaagcagagagtgaagaacaagggcagaagaatcgcctacctgtag

SEQ ID NO: 72108 - DNA, 531 bp, Artificial Sequence; identical to SEQ ID NO: 72105
  Description of Artificial Sequence: Synthetic coding sequence

SEQ ID NO: 72109 - DNA, 1407 bp, Artificial Sequence
  Description of Artificial Sequence: Synthetic coding sequence
atggccggcgtggtgcacgtgagcctggccgccctgctgctgctgcccatggcccccgccatgcacagcgactgcatcttcaagaaggagcaggccatgtgcctggagaagatccagagagccaacgagctgatgggcttcaacgacagcagccccggctgccccggcatgtgggacaacatcacctgctggaagcccgcccacgtgggcgagatggtgctggtgagctgccccgagctgttcagaatcttcaaccccgaccaggtgtgggagaccgagaccatcggcgagagcgacttcggcgacagcaacagcctggacctgagcgacatgggcgtggtgagcagaaactgcaccgaggacggctggagcgagcccttcccccactacttcgacgcctgcggcttcgacgagtacgagagcgagaccggcgaccaggactactactacctgagcgtgaaggccctgtacaccgtgggctacagcaccagcctggtgaccctgaccaccgccatggtgatcctgtgcagattcagaaagctgcactgcaccagaaacttcatccacatgaacctgttcgtgagcttcatgctgagagccatcagcgtgttcatcaaggactggatcctgtacgccgagcaggacagcaaccactgcttcatcagcaccgtggagtgcaaggccgtgatggtgttcttccactactgcgtggtgagcaactacttctggctgttcatcgagggcctgtacctgttcaccctgctggtggagaccttcttccccgagagaagatacttctactggtacaccatcatcggctggggcacccccaccgtgtgcgtgaccgtgtgggccaccctgagactgtacttcgacgacaccggctgctgggacatgaacgacagcaccgccctgtggtgggtgatcaagggccccgtggtgggcagcatcatggtgaacttcgtgctgttcatcggcatcatcgtgatcctggtgcagaagctgcagagccccgacatgggcggcaacgagagcagcatctacctgagactggccagaagcaccctgctgctgatccccctgttcggcatccactacaccgtgttcgccttcagccccgagaacgtgagcaagagagagagactggtgttcgagctgggcctgggcagcttccagggcttcgtggtggccgtgctgtactgcttcctgaacggcgaggtgcaggccgagatcaagagaaagtggagaagctggaaggtgaacagatacttcgccgtggacttcaagcacagacaccccagcctggccagcagcggcgtgaacggcggcacccagctgagcatcctgagcaagagcagcagccagatcagaatgagcggcctgcccgccgacaacctggccacctag

SEQ ID NO: 72110 - DNA, 594 bp, Artificial Sequence
  Description of Artificial Sequence: Synthetic coding sequence
atggtgttcttccactactgcgtggtgagcaactacttctggctgttcatcgagggcctgtacctgttcaccctgctggtggagaccttcttccccgagagaagatacttctactggtacaccatcatcggctggggcacccccaccgtgtgcgtgaccgtgtgggccaccctgagactgtacttcgacgacaccggctgctgggacatgaacgacagcaccgccctgtggtgggtgatcaagggccccgtggtgggcagcatcatggtgaacttcgtgctgttcatcggcatcatcgtgatcctggtgcagaagctgcagagccccgacatgggcggcaacgagagcagcatctacctgaccaacctgagccccagagtgcccaagaaggccagagaggaccccctgcccgtgcccagcgaccagcacagcctgcccttcctgagctgcgtgcagaagtgctactgcaagccccagagagcccagcagcacagctgcaagatgagcgagctgagcaccatcaccctgagactggccagaagcaccctgctgctgatccccctgttcggcatccactacaccgtgttcgcctag

SEQ ID NO: 72111 - DNA, 1491 bp, Artificial Sequence
  Description of Artificial Sequence: Synthetic coding sequence
atggccggcgtggtgcacgtgagcctggccgccctgctgctgctgcccatggcccccgccatgcacagcgactgcatcttcaagaaggagcaggccatgtgcctggagaagatccagagagccaacgagctgatgggcttcaacgacagcagccccggctgccccggcatgtgggacaacatcacctgctggaagcccgcccacgtgggcgagatggtgctggtgagctgccccgagctgttcagaatcttcaaccccgaccaggtgtgggagaccgagaccatcggcgagagcgacttcggcgacagcaacagcctggacctgagcgacatgggcgtggtgagcagaaactgcaccgaggacggctggagcgagcccttcccccactacttcgacgcctgcggcttcgacgagtacgagagcgagaccggcgaccaggactactactacctgagcgtgaaggccctgtacaccgtgggctacagcaccagcctggtgaccctgaccaccgccatggtgatcctgtgcagattcagaaagctgcactgcaccagaaacttcatccacatgaacctgttcgtgagcttcatgctgagagccatcagcgtgttcatcaaggactggatcctgtacgccgagcaggacagcaaccactgcttcatcagcaccgtggagtgcaaggccgtgatggtgttcttccactactgcgtggtgagcaactacttctggctgttcatcgagggcctgtacctgttcaccctgctggtggagaccttcttccccgagagaagatacttctactggtacaccatcatcggctggggcacccccaccgtgtgcgtgaccgtgtgggccaccctgagactgtacttcgacgacaccggctgctgggacatgaacgacagcaccgccctgtggtgggtgatcaagggccccgtggtgggcagcatcatggtgaacttcgtgctgttcatcggcatcatcgtgatcctggtgcagaagctgcagagccccgacatgggcggcaacgagagcagcatctacttcagctgcgtgcagaagtgctactgcaagccccagagagcccagcagcacagctgcaagatgagcgagctgagcaccatcaccctgagactggccagaagcaccctgctgctgatccccctgttcggcatccactacaccgtgttcgccttcagccccgagaacgtgagcaagagagagagactggtgttcgagctgggcctgggcagcttccagggcttcgtggtggccgtgctgtactgcttcctgaacggcgaggtgcaggccgagatcaagagaaagtggagaagctggaaggtgaacagatacttcgccgtggacttcaagcacagacaccccagcctggccagcagcggcgtgaacggcggcacccagctgagcatcctgagcaagagcagcagccagatcagaatgagcggcctgcccgccgacaacctggccacctag

SEQ ID NO: 72112 - DNA, 1575 bp, Artificial Sequence
  Description of Artificial Sequence: Synthetic coding sequence
atggccggcgtggtgcacgtgagcctggccgccctgctgctgctgcccatggcccccgccatgcacagcgactgcatcttcaagaaggagcaggccatgtgcctggagaagatccagagagccaacgagctgatgggcttcaacgacagcagccccggctgccccggcatgtgggacaacatcacctgctggaagcccgcccacgtgggcgagatggtgctggtgagctgccccgagctgttcagaatcttcaaccccgaccaggtgtgggagaccgagaccatcggcgagagcgacttcggcgacagcaacagcctggacctgagcgacatgggcgtggtgagcagaaactgcaccgaggacggctggagcgagcccttcccccactacttcgacgcctgcggcttcgacgagtacgagagcgagaccggcgaccaggactactactacctgagcgtgaaggccctgtacaccgtgggctacagcaccagcctggtgaccctgaccaccgccatggtgatcctgtgcagattcagaaagctgcactgcaccagaaacttcatccacatgaacctgttcgtgagcttcatgctgagagccatcagcgtgttcatcaaggactggatcctgtacgccgagcaggacagcaaccactgcttcatcagcaccgtggagtgcaaggccgtgatggtgttcttccactactgcgtggtgagcaactacttctggctgttcatcgagggcctgtacctgttcaccctgctggtggagaccttcttccccgagagaagatacttctactggtacaccatcatcggctggggcacccccaccgtgtgcgtgaccgtgtgggccaccctgagactgtacttcgacgacaccggctgctgggacatgaacgacagcaccgccctgtggtgggtgatcaagggccccgtggtgggcagcatcatggtgaacttcgtgctgttcatcggcatcatcgtgatcctggtgcagaagctgcagagccccgacatgggcggcaacgagagcagcatctacctgaccaacctgagccccagagtgcccaagaaggccagagaggaccccctgcccgtgcccagcgaccagcacagcctgcccttcctgagctgcgtgcagaagtgctactgcaagccccagagagcccagcagcacagctgcaagatgagcgagctgagcaccatcaccctgagactggccagaagcaccctgctgctgatccccctgttcggcatccactacaccgtgttcgccttcagccccgagaacgtgagcaagagagagagactggtgttcgagctgggcctgggcagcttccagggcttcgtggtggccgtgctgtactgcttcctgaacggcgaggtgcaggccgagatcaagagaaagtggagaagctggaaggtgaacagatacttcgccgtggacttcaagcacagacaccccagcctggccagcagcggcgtgaacggcggcacccagctgagcatcctgagcaagagcagcagccagatcagaatgagcggcctgcccgccgacaacctggccacctag

SEQ ID NO: 72113 - DNA, 225 bp, Artificial Sequence
  Description of Artificial Sequence: Synthetic coding sequence
atggccggcgtggtgcacgtgagcctggccgccctgctgctgctgcccatggcccccgccatgcacagcgactgcatcttcaagaaggagcaggccatgtgcctggagaagatccagagagccaacgagctgatgggcttcaacgacagcagccccggctgccccggcatgtgggacaacatcacctgctggaagcccgcccacgtgggcgagatggtgctgtag

SEQ ID NO: 72114 - DNA, 447 bp, Artificial Sequence
  Description of Artificial Sequence: Synthetic coding sequence
tgagccaccctgagactgtacttcgacgacaccggctgctgggacatgaacgacagcaccgccctgtggtgggtgatcaagggccccgtggtgggcagcatcatggtgaacttcgtgctgttcatcggcatcatcgtgatcctggtgcagaagctgcagagccccgacatgggcggcaacgagagcagcatctacctgaccaacctgagccccagagtgcccaagaaggccagagaggaccccctgcccgtgcccagcgaccagcacagcctgcccttcctgagactggccagaagcaccctgctgctgatccccctgttcggcatccactacaccgtgttcgccttcagccccgagaacgtgagcaagagagagagactggtgttcgagctgggcctgggcagcttccagggcttcgtggtggccgtgctgtactgcttcctgtag

SEQ ID NO: 72115 - DNA, 1344 bp, Artificial Sequence
  Description of Artificial Sequence: Synthetic coding sequence
atggccggcgtggtgcacgtgagcctggccgccctgctgctgctgcccatggcccccgccatgcacagcgactgcatcttcaagaaggagcaggccatgtgcctggagaagatccagagagccaacgagctgatgggcttcaacgacagcagccccggctgccccggcatgtgggacaacatcacctgctggaagcccgcccacgtgggcgagatggtgctggtgagctgccccgagctgttcagaatcttcaaccccgaccaggacatgggcgtggtgagcagaaactgcaccgaggacggctggagcgagcccttcccccactacttcgacgcctgcggcttcgacgagtacgagagcgagaccggcgaccaggactactactacctgagcgtgaaggccctgtacaccgtgggctacagcaccagcctggtgaccctgaccaccgccatggtgatcctgtgcagattcagaaagctgcactgcaccagaaacttcatccacatgaacctgttcgtgagcttcatgctgagagccatcagcgtgttcatcaaggactggatcctgtacgccgagcaggacagcaaccactgcttcatcagcaccgtggagtgcaaggccgtgatggtgttcttccactactgcgtggtgagcaactacttctggctgttcatcgagggcctgtacctgttcaccctgctggtggagaccttcttccccgagagaagatacttctactggtacaccatcatcggctggggcacccccaccgtgtgcgtgaccgtgtgggccaccctgagactgtacttcgacgacaccggctgctgggacatgaacgacagcaccgccctgtggtgggtgatcaagggccccgtggtgggcagcatcatggtgaacttcgtgctgttcatcggcatcatcgtgatcctggtgcagaagctgcagagccccgacatgggcggcaacgagagcagcatctacctgagactggccagaagcaccctgctgctgatccccctgttcggcatccactacaccgtgttcgccttcagccccgagaacgtgagcaagagagagagactggtgttcgagctgggcctgggcagcttccagggcttcgtggtggccgtgctgtactgcttcctgaacggcgaggtgcaggccgagatcaagagaaagtggagaagctggaaggtgaacagatacttcgccgtggacttcaagcacagacaccccagcctggccagcagcggcgtgaacggcggcacccagctgagcatcctgagcaagagcagcagccagatcagaatgagcggcctgcccgccgacaacctggccacctag

SEQ ID NO: 72116 - DNA, 705 bp, Artificial Sequence
  Description of Artificial Sequence: Synthetic coding sequence
atggaccccggcctgcagcaggccctgaacggcatggccccccccggcgacaccgccatgcacgtgcccgccggcagcgtggccagccacctgggcaccaccagcagaagctacttctacctgaccaccgccaccctggccctgtgcctggtgttcaccgtggccaccatcatggtgctggtggtgcagagaaccgacagcatccccaacagccccgacaacgtgcccctgaagggcggcaactgcagcgaggacctgctgtgcatcctgaagagagcccccttcaagaagagctgggcctacctgcaggtggccaagcacctgaacaagaccaagctgagctggaacaaggacggcatcctgcacggcgtgagataccaggacggcaacctggtgatccagttccccggcctgtacttcatcatctgccagctgcagttcctggtgcagtgccccaacaacagcgtggacctgaagctggagctgctgatcaacaagcacatcaagaagcaggccctggtgaccgtgtgcgagagcggcatgcagaccaagcacgtgtaccagaacctgagccagttcctgctggactacctgcaggtgaacaccaccatcagcgtgaacgtggacaccttccagtacatcgacaccagcaccttccccctggagaacgtgctgagcatcttcctgtacagcaacagcgactag

SEQ ID NO: 72117 - DNA, 585 bp, Artificial Sequence
  Description of Artificial Sequence: Synthetic coding sequence
atggaggagaagctgaagaagaccaagatcatcttcgtggtgggcggccccggcagcggcaagggcacccagtgcgagaagatcgtgcagaagtacggctacacccacctgagcaccggcgacctgctgagaagcgaggtgagcagcggcagcgccagaggcaagaagctgagcgagatcatggagaagggccagctggtgcccctggagaccgtgctggacatgctgagagacgccatggtggccaaggtgaacaccagcaagggcttcctgatcgacggctaccccagagaggtgcagcagggcgaggagttcgagagaagaatcggccagcccaccctgctgctgtacgtggacgccggccccgagaccatgacccagagactgctgaagagaggcgagaccagcggcagagtggacgacaacgaggagaccatcaagaagagactggagacctactacaaggccaccgagcccgtgatcgccttctacgagaagagaggcatcgtgagaaaggtgaacgccgagggcagcgtggacagcgtgttcagccaggtgtgcacccacctggacgccctgaagtag

SEQ ID NO: 72118 - DNA, 585 bp, Artificial Sequence; identical to SEQ ID NO: 72117
  Description of Artificial Sequence: Synthetic coding sequence

SEQ ID NO: 72119 - DNA, 720 bp, Artificial Sequence
  Description of Artificial Sequence: Synthetic coding sequence
atggcccccagcgtgcccgccgccgagcccgagtaccccaagggcatcagagccgtgctgctgggcccccccggcgccggcaagggcacccaggcccccagactggccgagaacttctgcgtgtgccacctggccaccggcgacatgctgagagccatggtggccagcggcagcgagctgggcaagaagctgaaggccaccatggacgccggcaagctggtgagcgacgagatggtggtggagctgatcgagaagaacctggagacccccctgtgcaagaacggcttcctgctggacggcttccccagaaccgtgagacaggccgagatgctggacgacctgatggagaagagaaaggagaagctggacagcgtgatcgagttcagcatccccgacagcctgctgatcagaagaatcaccggcagactgatccaccccaagagcggcagaagctaccacgaggagttcaacccccccaaggagcccatgaaggacgacatcaccggcgagcccctgatcagaagaagcgacgacaacgagaaggccctgaagatcagactgcaggcctaccacacccagaccacccccctgatcgagtactacagaaagagaggcatccacagcgccatcgacgccagccagacccccgacgtggtgttcgccagcatcctggccgccttcagcaaggccacctgcaaggacctggtgatgttcatctag

SEQ ID NO: 72120 - DNA, 699 bp, Artificial Sequence
  Description of Artificial Sequence: Synthetic coding sequence
atggcccccagcgtgcccgccgccgagcccgagtaccccaagggcatcagagccgtgctgctgggcccccccggcgccggcaagggcacccaggcccccagactggccgagaacttctgcgtgtgccacctggccaccggcgacatgctgagagccatggtggccagcggcagcgagctgggcaagaagctgaaggccaccatggacgccggcaagctggtgagcgacgagatggtggtggagctgatcgagaagaacctggagacccccctgtgcaagaacggcttcctgctggacggcttccccagaaccgtgagacaggccgagatgctggacgacctgatggagaagagaaaggagaagctggacagcgtgatcgagttcagcatccccgacagcctgctgatcagaagaatcaccggcagactgatccaccccaagagcggcagaagctaccacgaggagttcaacccccccaaggagcccatgaaggacgacatcaccggcgagcccctgatcagaagaagcgacgacaacgagaaggccctgaagatcagactgcaggcctaccacacccagaccacccccctgatcgagtactacagaaagagaggcatccacagcgccatcgacgccagccagacccccgacgtggtgttcgccagcatcctggccgccttcagcaaggccaccagctag

SEQ ID NO: 72121 - DNA, 609 bp, Artificial Sequence
  Description of Artificial Sequence: Synthetic coding sequence
atggcccccagcgtgcccgccgccgagcccgagtaccccaagggcatcagagccgtgctgctgggcccccccggcgccggcaagggcacccaggcccccagactggccgagaacttctgcgtgtgccacctggccaccggcgacatgctgagagccatggtggccagcggcagcgagctgggcaagaagctgaaggccaccatggacgccggcaagctggtgagcgacgagatggtggtggagctgatcgagaagaacctggagacccccctgtgcaagaacggcttcctgctggacggcttccccagaaccgtgagacaggccgagatgctggacgacctgatggagaagagaaaggagaagctggacagcgtgatcgagttcagcatccccgacagcctgctgatcagaagaatcaccggcagactgatccaccccaagagcggcagaagctaccacgaggagttcaacccccccaaggagcccatgaaggacgacatcaccggcgagcccctgatcagaagaagcgtgatcggccaggccaagagaagcttcctgagactggccaagatcagcttcgacgtgctgatcaagaaggccctggcctag

SEQ ID NO: 72122 - DNA, 474 bp, Artificial Sequence
  Description of Artificial Sequence: Synthetic coding sequence
atgaccagactggccctgcacgagctgaagaacctgacccagtacagctggctgctggacggcttccccagaaccctgccccaggccgaggccctggacagagcctaccagatcgacaccgtgatcaacctgaacgtgcccttcgaggtgatcaagcagagactgaccgccagatggatccaccccgccagcggcagagtgtacaacatcgagttcaacccccccaagaccgtgggcatcgacgacctgaccggcgagcccctgatccagagagaggacgacaagcccgagaccgtgatcaagagactgaaggcctacgaggaccagaccaagcccgtgctggagtactaccagaagaagggcgtgctggagaccttcagcggcaccgagaccaacaagatctggccctacgtgtacgccttcctgcagaccaaggtgccccagagaagccagaaggccagcgtgaccccctag

SEQ ID NO: 72123 - DNA, 684 bp, Artificial Sequence
  Description of Artificial Sequence: Synthetic coding sequence
atgggcgccagcgccagactgctgagagccgtgatcatgggcgcccccggcagcggcaagggcaccgtgagcagcagaatcaccacccacttcgagctgaagcacctgagcagcggcgacctgctgagagacaacatgctgagaggcaccgagatcggcgtgctggccaaggccttcatcgaccagggcaagctgatccccgacgacgtgatgaccagactggccctgcacgagctgaagaacctgacccagtacagctggctgctggacggcttccccagaaccctgccccaggccgaggccctggacagagcctaccagatcgacaccgtgatcaacctgaacgtgcccttcgaggtgatcaagcagagactgaccgccagatggatccaccccgccagcggcagagtgtacaacatcgagttcaacccccccaagaccgtgggcatcgacgacctgaccggcgagcccctgatccagagagaggacgacaagcccgagaccgtgatcaagagactgaaggcctacgaggaccagaccaagcccgtgctggagtactaccagaagaagggcgtgctggagaccttcagcggcaccgagaccaacaagatctggccctacgtgtacgccttcctgcagaccaaggtgccccagagaagccagaaggccagcgtgaccccctag

SEQ ID NO: 72124 - DNA, 564 bp, Artificial Sequence
  Description of Artificial Sequence: Synthetic coding sequence
atgggcgccagcgccagactgctgagagccgtgatcatgggcgcccccggcagcggcaagggcaccgtgagcagcagaatcaccacccacttcgagctgaagcacctgagcagcggcgacctgctgagagacaacatgctgagaggcaccggcttccccagaaccctgccccaggccgaggccctggacagagcctaccagatcgacaccgtgatcaacctgaacgtgcccttcgaggtgatcaagcagagactgaccgccagatggatccaccccgccagcggcagagtgtacaacatcgagttcaacccccccaagaccgtgggcatcgacgacctgaccggcgagcccctgatccagagagaggacgacaagcccgagaccgtgatcaagagactgaaggcctacgaggaccagaccaagcccgtgctggagtactaccagaagaagggcgtgctggagaccttcagcggcaccgagaccaacaagatctggccctacgtgtacgccttcctgcagaccaaggtgccccagagaagccagaaggccagcgtgaccccctag

SEQ ID NO: 72125 - DNA, 474 bp, Artificial Sequence; identical to SEQ ID NO: 72122
  Description of Artificial Sequence: Synthetic coding sequence

SEQ ID NO: 72126 - DNA, 1611 bp, Artificial Sequence
  Description of Artificial Sequence: Synthetic coding sequence
atgtgcagcaagcccgaggaccccgtggagtacctggagagctgcctgcagaaggtgaaggagctgggcggctgcgacaaggtgaagtgggacaccttcgtgagccaggagaagaagaccctgccccccctgaacggcggccagagcagaagaagcttcctgagaaacgtgatgcccgagaacagcaacttcccctacagaagatacgacagactgccccccatccaccagttcagcatcgagagcgacaccgacctgagcgagaccgccgagctgatcgaggagtacgaggtgttcgaccccaccagacccagacccaagatcatcctggtgatcggcggccccggcagcggcaagggcacccagagcctgaagatcgccgagagatacggcttccagtacatcagcgtgggcgagctgctgagaaagaagatccacagcaccagcagcaacagaaagtggagcctgatcgccaagatcatcaccaccggcgagctggccccccaggagaccaccatcaccgagatcaagcagaagctgatgcagatccccgacgaggagggcatcgtgatcgacggcttccccagagacgtggcccaggccctgagcttcgaggaccagatctgcacccccgacctggtggtgttcctggcctgcgccaaccagagactgaaggagagactgctgaagagagccgagcagcagggcagacccgacgacaacgtgaaggccacccagagaagactgatgaacttcaagcagaacgccgcccccctggtgaagtacttccaggagaagggcctgatcatgaccttcgacgccgacagagacgaggacgaggtgttctacgacatcagcatggccgtggacaacaagctgttccccaacaaggaggccgccgccggcagcagcgacctggaccccagcatgatcctggacaccggcgagatcatcgacaccggcagcgactacgaggaccagggcgacgaccagctgaacgtgttcggcgaggacaccatgggcggcttcatggaggacctgagaaagtgcaagatcatcttcatcatcggcggccccggcagcggcaagggcacccagtgcgagaagctggtggagaagtacggcttcacccacctgagcaccggcgagctgctgagagaggagctggccagcgagagcgagagaagcaagctgatcagagacatcatggagagaggcgacctggtgcccagcggcatcgtgctggagctgctgaaggaggccatggtggccagcctgggcgacaccagaggcttcctgatcgacggctaccccagagaggtgaagcagggcgaggagttcggcagaagaatcggcgacccccagctggtgatctgcatggactgcagcgccgacaccatgaccaacagactgctgcagagaagcagaagcagcctgcccgtggacgacaccaccaagaccatcgccaagagactggaggcctactacagagccagcatccccgtgatcgcctactacgagaccaagacccagctgcacaagatcaacgccgagggcacccccgaggacgtgttcctgcagctgtgcaccgccatcgacagcatcttctag

SEQ ID NO: 72127 - DNA, 1689 bp, Artificial Sequence
  Description of Artificial Sequence: Synthetic coding sequence
atgaacaccaacgacgccaaggagtacctggccagaagagagatcccccagctgttcgagagcctgctgaacggcctgatgtgcagcaagcccgaggaccccgtggagtacctggagagctgcctgcagaaggtgaaggagctgggcggctgcgacaaggtgaagtgggacaccttcgtgagccaggagaagaagaccctgccccccctgaacggcggccagagcagaagaagcttcctgagaaacgtgatgcccgagaacagcaacttcccctacagaagatacgacagactgccccccatccaccagttcagcatcgagagcgacaccgacctgagcgagaccgccgagctgatcgaggagtacgaggtgttcgaccccaccagacccagacccaagatcatcctggtgatcggcggccccggcagcggcaagggcacccagagcctgaagatcgccgagagatacggcttccagtacatcagcgtgggcgagctgctgagaaagaagatccacagcaccagcagcaacagaaagtggagcctgatcgccaagatcatcaccaccggcgagctggccccccaggagaccaccatcaccgagatcaagcagaagctgatgcagatccccgacgaggagggcatcgtgatcgacggcttccccagagacgtggcccaggccctgagcttcgaggaccagatctgcacccccgacctggtggtgttcctggcctgcgccaaccagagactgaaggagagactgctgaagagagccgagcagcagggcagacccgacgacaacgtgaaggccacccagagaagactgatgaacttcaagcagaacgccgcccccctggtgaagtacttccaggagaagggcctgatcatgaccttcgacgccgacagagacgaggacgaggtgttctacgacatcagcatggccgtggacaacaagctgttccccaacaaggaggccgccgccggcagcagcgacctggaccccagcatgatcctggacaccggcgagatcatcgacaccggcagcgactacgaggaccagggcgacgaccagctgaacgtgttcggcgaggacaccatgggcggcttcatggaggacctgagaaagtgcaagatcatcttcatcatcggcggccccggcagcggcaagggcacccagtgcgagaagctggtggagaagtacggcttcacccacctgagcaccggcgagctgctgagagaggagctggccagcgagagcgagagaagcaagctgatcagagacatcatggagagaggcgacctggtgcccagcggcatcgtgctggagctgctgaaggaggccatggtggccagcctgggcgacaccagaggcttcctgatcgacggctaccccagagaggtgaagcagggcgaggagttcggcagaagaatcggcgacccccagctggtgatctgcatggactgcagcgccgacaccatgaccaacagactgctgcagagaagcagaagcagcctgcccgtggacgacaccaccaagaccatcgccaagagactggaggcctactacagagccagcatccccgtgatcgcctactacgagaccaagacccagctgcacaagatcaacgccgagggcacccccgaggacgtgttcctgcagctgtgcaccgccatcgacagcatcttctag

SEQ ID NO: 72128 - DNA, 531 bp, Artificial Sequence
  Description of Artificial Sequence: Synthetic coding sequence
atgtgcagcaagcccgaggaccccgtggagtacctggagagctgcctgcagaaggtgaaggagctgggcggctgcgacaaggtgaagtgggacaccttcgtgagccaggagaagaagaccctgccccccctgaacggcggccagagcagaagaagcttcctgagaaacgtgatgcccgagaacagcaacttcccctacagaagatacgacagactgccccccatccaccagttcagcatcgagagcgacaccgacctgagcgagaccgccgagctgatcgaggagtacgaggtgttcgaccccaccagacccagacccaagatcatcctggtgatcggcggccccggcagcggcaagggcacccagagcctgaagatcgccgagagatacggcttccagtacatcagcgtgggcgagctgctgagaaagaagatccacagcaccagcagcaacagaaagtggagcctgatcgccaagatcatcaccaccggcgagctggccccccaggagaccaccatcaccgagatctag

SEQ ID NO: 72129 - DNA, 1647 bp, Artificial Sequence
  Description of Artificial Sequence: Synthetic coding sequence
atggccaagttcatgacccccgtgatccaggacaaccccagcggctggggcccctgcgccgtgcccgagcagttcagagacatgccctaccagcccttcagcaagggcgacagactgggcaaggtggccgactggaccggcgccacctaccaggacaagagatacaccaacaagtacagcagccagttcggcggcggcagccagtacgcctacttccacgaggaggacgagagcagcttccagctggtggacaccgccagaacccagaagaccgcctaccagagaaacagaatgagattcgcccagagaaacctgagaagagacaaggacagaagaaacatgctgcagttcaacctgcagatcctgcccaagagcgccaagcagaaggagagagagagaatcagactgcagaagaagttccagaagcagttcggcgtgagacagaagtgggaccagaagagccagaagcccagagacagcagcgtggaggtgagaagcgactgggaggtgaaggaggagatggacttcccccagctgatgaagatgagatacctggaggtgagcgagccccaggacatcgagtgctgcggcgccctggagtactacgacaaggccttcgacagaatcaccaccagaagcgagaagcccctgagaagcatcaagagaatcttccacaccgtgaccaccaccgacgaccccgtgatcagaaagctggccaagacccagggcaacgtgttcgccaccgacgccatcctggccaccctgatgagctgcaccagaagcgtgtacagctgggacatcgtggtgcagagagtgggcagcaagctgttcttcgacaagagagacaacagcgacttcgacctgctgaccgtgagcgagaccgccaacgagcccccccaggacgagggcaacagcttcaacagccccagaaacctggccatggaggccacctacatcaaccacaacttcagccagcagtgcctgagaatgggcaaggagagatacaacttccccaaccccaaccccttcgtggaggacgacatggacaagaacgagatcgccagcgtggcctacagatacagaagatggaagctgggcgacgacatcgacctgatcgtgagatgcgagcacgacggcgtgatgaccggcgccaacggcgaggtgagcttcatcaacatcaagaccctgaacgagtgggacagcagacactgcaacggcgtggactggagacagaagctggacagccagagaggcgccgtgatcgccaccgagctgaagaacaacagctacaagctggccagatggacctgctgcgccctgctggccggcagcgagtacctgaagctgggctacgtgagcagataccacgtgaaggacagcagcagacacgtgatcctgggcacccagcagttcaagcccaacgagttcgccagccagatcaacctgagcgtggagaacgcctggggcatcctgagatgcgtgatcgacatctgcatgaagctggaggagggcaagtacctgatcctgaaggaccccaacaagcaggtgatcagagtgtacagcctgcccgacggcaccttcagcagcgacgaggacgaggaggaggaggaggaggaggaggaggaggaggaggaggaggagacctag

SEQ ID NO: 72130 - DNA, 1278 bp, Artificial Sequence
  Description of Artificial Sequence: Synthetic coding sequence
atggccgccggcggcgaccacggcagccccgacagctacagaagccccctggccagcagatacgccagccccgagatgtgcttcgtgttcagcgacagatacaagttcagaacctggagacagctgtggctgtggctggccgaggccgagcagaccctgggcctgcccatcaccgacgagcagatccaggagatgaagagcaacctggagaacatcgacttcaagatggccgccgaggaggagaagagactgagacacgacgtgatggcccacgtgcacaccttcggccactgctgccccaaggccgccggcatcatccacctgggcgccaccagctgctacgtgggcgacaacaccgacctgatcatcctgagaaacgccctggacctgctgctgcccaagctggccagagtgatcagcagactggccgacttcgccaaggagagagccagcctgcccaccctgggcttcacccacttccagcccgcccagctgaccaccgtgggcaagagatgctgcctgtggatccaggacctgtgcatggacctgcagaacctgaagagagtgagagacgacctgagattcagaggcgtgaagggcaccaccggcacccaggccagcttcctgcagctgttcgagggcgacgaccacaaggtggagcagctggacaagatggtgaccgagaaggccggcttcaagagagccttcatcatcaccggccagacctacaccagaaaggtggacatcgaggtgctgagcgtgctggccagcctgggcgccagcgtgcacaagatctgcaccgacatcagactgctggccaacctgaaggagatggaggagcccttcgagaagcagcagatcggcagcagcgccatgccctacaagagaaaccccatgagaagcgagagatgctgcagcctggccagacacctgatgaccctggtgatggaccccctgcagaccgccagcgtgcagtggttcgagagaaccctggacgacagcgccaacagaagaatctgcctggccgaggccttcctgaccgccgacaccatcctgaacaccctgcagaacatcagcgagggcctggtggtgtaccccaaggtgatcgagagaagaatcagacaggagctgcccttcatggccaccgagaacatcatcatggccatggtgaaggccggcggcagcagacaggtgcagagattcctggaggaggaggtgtaccccctgctgaagccctacgagagcgtgatgaaggtgaaggccgagctgtgcctgtag

SEQ ID NO: 72131 - DNA, 1497 bp, Artificial Sequence
  Description of Artificial Sequence: Synthetic coding sequence
atggccgccggcggcgaccacggcagccccgacagctacagaagccccctggccagcagatacgccagccccgagatgtgcttcgtgttcagcgacagatacaagttcagaacctggagacagctgtggctgtggctggccgaggccgagcagaccctgggcctgcccatcaccgacgagcagatccaggagatgaagagcaacctggagaacatcgacttcaagatggccgccgaggaggagaagagactgagacacgacgtgatggcccacgtgcacaccttcggccactgctgccccaaggccgccggcatcatccacctgggcgccaccagctgctacgtgggcgacaacaccagcctgatcctgagcagaggcgtgatcaaggcctactgcaacctgagactgcccggcagcgacagcagccccgtgagcgtgagccagctggccagagtgatcagcagactggccgacttcgccaaggagagagccagcctgcccaccctgggcttcacccacttccagcccgcccagctgaccaccgtgggcaagagatgctgcctgtggatccaggacctgtgcatggacctgcagaacctgaagagagtgagagacgacctgagattcagaggcgtgaagggcaccaccggcacccaggccagcttcctgcagctgttcgagggcgacgaccacaaggtggagcagctggacaagatggtgaccgagaaggccggcttcaagagagccttcatcatcaccggccagacctacaccagaaaggtggacatcgaggtgctgagcgtgctggccagcctgggcgccagcgtgcacaagatctgcaccgacatcagactgctggccaacctgaaggagatggaggagcccttcgagaagcagcagatcggcagcagcgccatgccctacaagagaaaccccatgagaagcgagagatgctgcagcctggccagacacctgatgaccctggtgatggaccccctgcagaccgccagcgtgcagtggttcgagagaaccctggacgacagcgccaacagaagaatctgcctggccgaggccttcctgaccgccgacaccatcctgaacaccctgcagaacatcagcgagggcctggtggtgtaccccaaggtgatcgagagaagaatcagacaggagctgcccttcatggccaccgagaacatcatcatggccatggtgaaggccggcggcagcagacaggactgccacgagaagatcagagtgctgagccagcaggccgccagcgtggtgaagcaggagggcggcgacaacgacctgatcgagagaatccaggtggacgcctacttcagccccatccacagccagctggaccacctgctggaccccagcagcttcaccggcagagccagccagcaggtgcagagattcctggaggaggaggtgtaccccctgctgaagccctacgagagcgtgatgaaggtgaaggccgagctgtgcctgtag

SEQ ID NO: 72132 - DNA, 915 bp, Artificial Sequence
  Description of Artificial Sequence: Synthetic coding sequence
atggacctgcagaacctgaagagagtgagagacgacctgagattcagaggcgtgaagggcaccaccggcacccaggccagcttcctgcagctgttcgagggcgacgaccacaaggtggagcagctggacaagatggtgaccgagaaggccggcttcaagagagccttcatcatcaccggccagacctacaccagaaaggtggacatcgaggtgctgagcgtgctggccagcctgggcgccagcgtgcacaagatctgcaccgacatcagactgctggccaacctgaaggagatggaggagcccttcgagaagcagcagatcggcagcagcgccatgccctacaagagaaaccccatgagaagcgagagatgctgcagcctggccagacacctgatgaccctggtgatggaccccctgcagaccgccagcgtgcagtggttcgagagaaccctggacgacagcgccaacagaagaatctgcctggccgaggccttcctgaccgccgacaccatcctgaacaccctgcagaacatcagcgagggcctggtggtgtaccccaaggtgatcgagagaagaatcagacaggagctgcccttcatggccaccgagaacatcatcatggccatggtgaaggccggcggcagcagacaggactgccacgagaagatcagagtgctgagccagcaggccgccagcgtggtgaagcaggagggcggcgacaacgacctgatcgagagaatccaggtggacgcctacttcagccccatccacagccagctggaccacctgctggaccccagcagcttcaccggcagagccagccagcaggtgcagagattcctggaggaggaggtgtaccccctgctgaagccctacgagagcgtgatgaaggtgaaggccgagctgtgcctgtag

SEQ ID NO: 72133 - DNA, 384 bp, Artificial Sequence
  Description of Artificial Sequence: Synthetic coding sequence
atggccgccggcggcgaccacggcagccccgacagctacagaagccccctggccagcagatacgccagccccgagatgtgcttcgtgttcagcgacagatacaagttcagaacctggagacagctgtggctgtggctggccgaggccgagcagaccctgggcctgcccatcaccgacgagcagatccaggagatgaagagcaacctggagaacatcgacttcaagatggccgccgaggaggagaagagactgagacacgacgtgatggcccacgtgcacaccttcggccactgctgccccaaggccgccggcatcatccacctgggcgccaccagctgctacgtgggcgacaacaccgtgggcgcctgcgtggtgtacacctag

SEQ ID NO: 72134 - DNA, 1371 bp, Artificial Sequence
  Description of Artificial Sequence: Synthetic coding sequence
atggccttcgccgagacctaccccgccgccagcagcctgcccaacggcgactgcggcagacccagagccagacccggcggcaacagagtgaccgtggtgctgggcgcccagtggggcgacgagggcaagggcaaggtggtggacctgctggcccaggacgccgacatcgtgtgcagatgccagggcggcaacaacgccggccacaccgtggtggtggacagcgtggagtacgacttccacctgctgcccagcggcatcatcaaccccaacgtgaccgccttcatcggcaacggcgtggtgatccacctgcccggcctgttcgaggaggccgagaagaacgtgcagaagggcaagggcctggagggctgggagaagagactgatcatcagcgacagagcccacatcgtgttcgacttccaccaggccgccgacggcatccaggagcagcagagacaggagcaggccggcaagaacctgggcaccaccaagaagggcatcggccccgtgtacagcagcaaggccgccagaagcggcctgagaatgtgcgacctggtgagcgacttcgacggcttcagcgagagattcaaggtgctggccaaccagtacaagagcatctaccccaccctggagatcgacatcgagggcgagctgcagaagctgaagggctacatggagaagatcaagcccatggtgagagacggcgtgtacttcctgtacgaggccctgcacggcccccccaagaagatcctggtggagggcgccaacgccgccctgctggacatcgacttcggcacctaccccttcgtgaccagcagcaactgcaccgtgggcggcgtgtgcaccggcctgggcatgcccccccagaacgtgggcgaggtgtacggcgtggtgaaggcctacaccaccagagtgggcatcggcgccttccccaccgagcaggacaacgagatcggcgagctgctgcagaccagaggcagagagttcggcgtgaccaccggcagaaagagaagatgcggctggctggacctggtgctgctgaagtacgcccacatgatcaacggcttcaccgccctggccctgaccaagctggacatcctggacatgttcaccgagatcaaggtgggcgtggcctacaagctggacggcgagatcatcccccacatccccgccaaccaggaggtgctgaacaaggtggaggtgcagtacaagaccctgcccggctggaacaccgacatcagcaacgccagagccttcaaggagctgcccgtgaacgcccagaactacgtgagattcatcgaggacgagctgcagatccccgtgaagtggatcggcgtgggcaagagcagagagagcatgatccagctgttctag

SEQ ID NO: 72135 - DNA, 1308 bp, Artificial Sequence
  Description of Artificial Sequence: Synthetic coding sequence
atggccttcgccgagacctaccccgccgccagcagcctgcccaacggcgactgcgacgagggcaagggcaaggtggtggacctgctggcccaggacgccgacatcgtgtgcagatgccagggcggcaacaacgccggccacaccgtggtggtggacagcgtggagtacgacttccacctgctgcccagcggcatcatcaaccccaacgtgaccgccttcatcggcaacggcgtggtgatccacctgcccggcctgttcgaggaggccgagaagaacgtgcagaagggcaagggcctggagggctgggagaagagactgatcatcagcgacagagcccacatcgtgttcgacttccaccaggccgccgacggcatccaggagcagcagagacaggagcaggccggcaagaacctgggcaccaccaagaagggcatcggccccgtgtacagcagcaaggccgccagaagcggcctgagaatgtgcgacctggtgagcgacttcgacggcttcagcgagagattcaaggtgctggccaaccagtacaagagcatctaccccaccctggagatcgacatcgagggcgagctgcagaagctgaagggctacatggagaagatcaagcccatggtgagagacggcgtgtacttcctgtacgaggccctgcacggcccccccaagaagatcctggtggagggcgccaacgccgccctgctggacatcgacttcggcacctaccccttcgtgaccagcagcaactgcaccgtgggcggcgtgtgcaccggcctgggcatgcccccccagaacgtgggcgaggtgtacggcgtggtgaaggcctacaccaccagagtgggcatcggcgccttccccaccgagcaggacaacgagatcggcgagctgctgcagaccagaggcagagagttcggcgtgaccaccggcagaaagagaagatgcggctggctggacctggtgctgctgaagtacgcccacatgatcaacggcttcaccgccctggccctgaccaagctggacatcctggacatgttcaccgagatcaaggtgggcgtggcctacaagctggacggcgagatcatcccccacatccccgccaaccaggaggtgctgaacaaggtggaggtgcagtacaagaccctgcccggctggaacaccgacatcagcaacgccagagccttcaaggagctgcccgtgaacgcccagaactacgtgagattcatcgaggacgagctgcagatccccgtgaagtggatcggcgtgggcaagagcagagagagcatgatccagctgttctag

SEQ ID NO: 72136 - DNA, 1236 bp, Artificial Sequence
  Description of Artificial Sequence: Synthetic coding sequence
atgtggatccagcagctgctgggcctgagcagcatgagcatcagatggcccggcagacccctgggcagccacgcctggatcctgatcgccatgttccagctggccgtggacctgcccgcctgcgaggccctgggccccggccccgagttctggctgctgcccagaagcccccccagaccccccagactgtggagcttcagaagcggccagcccgccagagtgcccgcccccgtgtggagccccagaccccccagagtggagagaatccacggccagatgcagatgcccagagccagaagagcccacagacccagagaccaggccgccgccctggtgcccaaggccggcctggccaagccccccgccgccgccaagagcagccccagcctggccagcagcagcagcagcagcagcagcgccgtggccggcggcgcccccgagcagcaggccctgctgagaagaggcaagagacacctgcagggcgacggcctgagcagcttcgacagcagaggcagcagacccaccaccgagaccgagttcatcgcctggggccccaccggcgacgaggaggccctggagagcaacaccttccccggcgtgtacggccccaccaccgtgagcatcctgcagaccagaaagaccaccgtggccgccaccaccaccaccaccaccaccgccacccccatgaccctgcagaccaagggcttcaccgagagcctggaccccagaagaagaatccccggcggcgtgagcaccaccgagcccagcaccagccccagcaacaacggcgaggtgacccagccccccagaatcctgggcgaggccagcggcctggccgtgcaccagatcatcaccatcaccgtgagcctgatcatggtgatcgccgccctgatcaccaccctggtgctgaagaactgctgcgcccagagcggcaacaccagaagaaacagccaccagagaaagaccaaccagcaggaggagagctgccagaacctgaccgacttccccagcgccagagtgcccagcagcctggacatcttcaccgcctacaacgagaccctgcagtgcagccacgagtgcgtgagagccagcgtgcccgtgtacaccgacgagaccctgcacagcaccaccggcgagtacaagagcaccttcaacggcaacagacccagcagcagcgacagacacctgatccccgtggccttcgtgagcgagaagtggttcgagatcagctgctag

SEQ ID NO: 72137 - DNA, 1236 bp, Artificial Sequence; identical to SEQ ID NO: 72136
  Description of Artificial Sequence: Synthetic coding sequence

SEQ ID NO: 72138 - DNA, 1155 bp, Artificial Sequence
  Description of Artificial Sequence: Synthetic coding sequence
atggtgagcggcgactacagcctgggcctgaacgacctgaacgtgagcccccccgagctgaccgtgcacgtgggcgacagcgccctgatgggctgcgtgttccagagcaccgaggacaagtgcatcttcaagatcgactggaccctgagccccggcgagcacgccaaggacgagtacgtgctgtactactacagcaacctgagcgtgcccatcggcagattccagaacagagtgcacctgatgggcgacatcctgtgcaacgacggcagcctgctgctgcaggacgtgcaggaggccgaccagggcacctacatctgcgagatcagactgaagggcgagagccaggtgttcaagaaggccgtggtgctgcacgtgctgcccgaggagcccaaggagctgatggtgcacgtgggcggcctgatccagatgggctgcgtgttccagagcaccgaggtgaagcacgtgaccaaggtggagtggatcttcagcggcagaagagccaaggaggagatcgtgttcagatactaccacaagctgagaatgagcgtggagtacagccagagctggggccacttccagaacagagtgaacctggtgggcgacatcttcagaaacgacggcagcatcatgctgcagggcgtgagagagagcgacggcggcaactacacctgcagcatccacctgggcaacctggtgttcaagaagaccatcgtgctgcacgtgagccccgaggagcccagaaccctggtgacccccgccgccctgagacccctggtgctgggcggcaaccagctggtgatcatcgtgggcatcgtgtgcgccaccatcctgctgctgcccgtgctgatcctgatcgtgaagaagacctgcggcaacaagagcagcgtgaacagcaccgtgctggtgaagaacaccaagaagaccaaccccgagatcaaggagaagccctgccacttcgagagatgcgagggcgagaagcacatctacagccccatcatcgtgagagaggtgatcgaggaggaggagcccagcgagaagagcgaggccacctacatgaccatgcaccccgtgtggcccagcctgagaagcgacagaaacaacagcctggagaagaagagcggcggcggcatgcccaagacccagcaggccttctag

SEQ ID NO: 72139 - DNA, 1185 bp, Artificial Sequence
  Description of Artificial Sequence: Synthetic coding sequence
atgttctgccccctgaagctgatcctgctgcccgtgctgctggactacagcctgggcctgaacgacctgaacgtgagcccccccgagctgaccgtgcacgtgggcgacagcgccctgatgggctgcgtgttccagagcaccgaggacaagtgcatcttcaagatcgactggaccctgagccccggcgagcacgccaaggacgagtacgtgctgtactactacagcaacctgagcgtgcccatcggcagattccagaacagagtgcacctgatgggcgacatcctgtgcaacgacggcagcctgctgctgcaggacgtgcaggaggccgaccagggcacctacatctgcgagatcagactgaagggcgagagccaggtgttcaagaaggccgtggtgctgcacgtgctgcccgaggagcccaaggagctgatggtgcacgtgggcggcctgatccagatgggctgcgtgttccagagcaccgaggtgaagcacgtgaccaaggtggagtggatcttcagcggcagaagagccaaggaggagatcgtgttcagatactaccacaagctgagaatgagcgtggagtacagccagagctggggccacttccagaacagagtgaacctggtgggcgacatcttcagaaacgacggcagcatcatgctgcagggcgtgagagagagcgacggcggcaactacacctgcagcatccacctgggcaacctggtgttcaagaagaccatcgtgctgcacgtgagccccgaggagcccagaaccctggtgacccccgccgccctgagacccctggtgctgggcggcaaccagctggtgatcatcgtgggcatcgtgtgcgccaccatcctgctgctgcccgtgctgatcctgatcgtgaagaagacctgcggcaacaagagcagcgtgaacagcaccgtgctggtgaagaacaccaagaagaccaaccccgagatcaaggagaagccctgccacttcgagagatgcgagggcgagaagcacatctacagccccatcatcgtgagagaggtgatcgaggaggaggagcccagcgagaagagcgaggccacctacatgaccatgcaccccgtgtggcccagcctgagaagcgacagaaacaacagcctggagaagaagagcggcggcggcatgcccaagacccagcaggccttctag

SEQ ID NO: 72140 - DNA, 468 bp, Artificial Sequence
  Description of Artificial Sequence: Synthetic coding sequence
atgttctgccccctgaagctgatcctgctgcccgtgctgctggactacagcctgggcctgaacgacctgaacgtgagcccccccgagctgaccgtgcacgtgggcgacagcgccctgatgggctgcgtgttccagagcaccgaggacaagtgcatcttcaagatcgactggaccctgagccccggcgagcacgccaaggacgagtacgtgctgtactactacagcaacctgagcgtgcccatcggcagattccagaacagagtgcacctgatgggcgacatcctgtgcaacgacggcagcctgctgctgcaggacgtgcaggaggccgaccagggcacctacatctgcgagatcagactgaagggcgagagccaggtgttcaagaaggccgtggtgctgcacgtgctgcccgaggagcccaaggagctgatggtgcacgtgggcggcctgatccagatgggctgctag

SEQ ID NO: 72141 - DNA, 663 bp, Artificial Sequence
  Description of Artificial Sequence: Synthetic coding sequence
atgggctgcgtgttccagagcaccgaggacaagtgcatcttcaagatcgactggaccctgagccccggcgagcacgccaaggacgagtacgtgctgtactactacagcaacctgagcgtgcccatcggcagattccagaacagagtgcacctgatgggcgacatcctgtgcaacgacggcagcctgctgctgcaggacgtgcaggaggccgaccagggcacctacatctgcgagatcagactgaagggcgagagccaggtgttcaagaaggccgtggtgctgcacgtgctgcccgaggagcccaaggagctgatggtgcacgtgggcggcctgatccagatgggctgcgtgttccagagcaccgaggtgaagcacgtgaccaaggtggagtggatcttcagcggcagaagagccaaggaggagatcgtgttcagatactaccacaagctgagaatgagcgtggagtacagccagagctggggccacttccagaacagagtgaacctggtgggcgacatcttcagaaacgacggcagcatcatgctgcagggcgtgagagagagcgacggcggcaactacacctgcagcatccacctgggcaacctggtgttcaagaagaccatcgtgctgcacgtgagccccgaggagcccagaaagtggtag

SEQ ID NO: 72142 - DNA, 1128 bp, Artificial Sequence
  Description of Artificial Sequence: Synthetic coding sequence
atgagcagccacaagggcagcgtggtggcccagggcaacggcgcccccgccagcaacagagaggccgacaccgtggagctggccgagctgggccccctgctggaggagaagggcaagagagtgatcgccaacccccccaaggccgaggaggagcagacctgccccgtgccccaggaggaggaggaggaggtgagagtgctgaccctgcccctgcaggcccaccacgccatggagaagatggaggagttcgtgtacaaggtgtgggagggcagatggagagtgatcccctacgacgtgctgcccgactggctgaaggacaacgactacctgctgcacggccacagaccccccatgcccagcttcagagcctgcttcaagagcatcttcagaatccacaccgagaccggcaacatctggacccacctgctgggcttcgtgctgttcctgttcctgggcatcctgaccatgctgagacccaacatgtacttcatggcccccctgcaggagaaggtggtgttcggcatgttcttcctgggcgccgtgctgtgcctgagcttcagctggctgttccacaccgtgtactgccacagcgagaaggtgagcagaaccttcagcaagctggactacagcggcatcgccctgctgatcatgggcagcttcgtgccctggctgtactacagcttctactgcagcccccagcccagactgatctacctgagcatcgtgtgcgtgctgggcatcagcgccatcatcgtggcccagtgggacagattcgccacccccaagcacagacagaccagagccggcgtgttcctgggcctgggcctgagcggcgtggtgcccaccatgcacttcaccatcgccgagggcttcgtgaaggccaccaccgtgggccagatgggctggttcttcctgatggccgtgatgtacatcaccggcgccggcctgtacgccgccagaatccccgagagattcttccccggcaagttcgacatctggttccagagccaccagatcttccacgtgctggtggtggccgccgccttcgtgcacttctacggcgtgagcaacctgcaggagttcagatacggcctggagggcggctgcaccgacgacaccctgctgtag

SEQ ID NO: 72143 - DNA, 516 bp, Artificial Sequence
  Description of Artificial Sequence: Synthetic coding sequence
atgagcagccacaagggcagcgtggtggcccagggcaacggcgcccccgccagcaacagagaggccgacaccgtggagctggccgagctgggccccctgctggaggagaagggcaagagagtgatcgccaacccccccaaggccgaggaggagcagacctgccccgtgccccaggaggaggaggaggaggtgagagtgctgaccctgcccctgcaggcccaccacgccatggagaagatggaggagttcgtgtacaaggtgtgggagggcagatggagagtgatcccctacgacgtgctgcccgactggctgaaggacaacgactacctgctgcacggccacagaccccccatgcccagcttcagagcctgcttcaagagcatcttcagaatccacaccgagaccggcaacatctggacccacctgctggccaccgcccacctgcccctgcacagactgtgccccggccacttctgccaccactgcggcgccgtgggccccgtgtgccacagctag

SEQ ID NO: 72144 - DNA, 801 bp, Artificial Sequence
  Description of Artificial Sequence: Synthetic coding sequence
atgagcagccacaagggcagcgtggtggcccagggcaacggcgcccccgccagcaacagagaggccgacaccgtggagctggccgagctgggccccctgctggaggagaagggcaagagagtgatcgccaacccccccaaggccgaggaggagcagacctgccccgtgccccaggaggaggaggaggaggtgagagtgctgaccctgcccctgcaggcccaccacgccatggagaagatggaggagttcgtgtacaaggtgtgggagggcagatggagagtgatcccctacgacgtgctgcccgactggctgaaggacaacgactacctgctgcacggccacagaccccccatgcccagcttcagagcctgcttcaagagcatcttcagaatccacaccgagaccggcaacatctggacccacctgctgggcttcgtgctgttcctgttcctgggcatcctgaccatgctgagacccaacatgtacttcatggcccccctgcaggagaaggtggtgttcggcatgttcttcctgggcgccgtgctgtgcctgagcttcagctggctgttccacaccgtgtactgccacagcgagaaggtgagcagaaccttcagcaagctggactacagcggcatcgccctgctgatcatgggcagcttcgtgccctggctgtactacagcttctactgcagcccccagcccagactgatctacctgagcatcgtgtgcgtgctgggcatcagcgccatcatcgtggcccagtgggacagattcgccacccccaagcacagacagacctag

SEQ ID NO: 72145 - DNA, 618 bp, Artificial Sequence
  Description of Artificial Sequence: Synthetic coding sequence
atgagcagccacaagggcagcgtggtggcccagggcaacggcgcccccgccagcaacagagaggccgacaccgtggagctggccgagctgggccccctgctggaggagaagggcaagagagtgatcgccaacccccccaaggccgaggaggagcagacctgccccgtgccccaggaggaggaggaggaggtgagagtgctgaccctgcccctgcaggcccaccacgccatggagaagatggaggagttcgtgtacaaggtgtgggagggcagatggagagtgatcccctacgacgtgctgcccgactggctgaaggacaacgactacctgctgcacggccacagaccccccatgcccagcttcagagcctgcttcaagagcatcttcagaatccacaccgagaccggcaacatctggacccacctgctgggcttcgtgctgttcctgttcctgggcatcctgaccatgctgagacccaacatgtacttcatggcccccctgcaggagaaggtggtgttcggcatgttcttcctgggcgccgtgctgtgcctgagcttcagctggctgttccacaccgtgtactgccacagcgagaaggtgagcagaaccttcagctag

SEQ ID NO: 72146 - DNA, 1128 bp, Artificial Sequence; identical to SEQ ID NO: 72142
  Description of Artificial Sequence: Synthetic coding sequence

SEQ ID NO: 72147 - DNA, 1161 bp, Artificial Sequence
  Description of Artificial Sequence: Synthetic coding sequence
atgaacgagcccaccgagaacagactgggctgcagcagaacccccgagcccgacatcagactgagaaagggccaccagctggacggcaccagaagaggcgacaacgacagccaccagggcgacctggagcccatcctggaggccagcgtgctgagcagccaccacaagaagagcagcgaggagcacgagtacagcgacgaggccccccaggaggacgagggcttcatgggcatgagccccctgctgcaggcccaccacgccatggagaagatggaggagttcgtgtgcaaggtgtgggagggcagatggagagtgatcccccacgacgtgctgcccgactggctgaaggacaacgacttcctgctgcacggccacagaccccccatgcccagcttcagagcctgcttcaagagcatcttcagaatccacaccgagaccggcaacatctggacccacctgctgggctgcgtgttcttcctgtgcctgggcatcttctacatgttcagacccaacatcagcttcgtggcccccctgcaggagaaggtggtgttcggcctgttcttcctgggcgccatcctgtgcctgagcttcagctggctgttccacaccgtgtactgccacagcgagggcgtgagcagactgttcagcaagctggactacagcggcatcgccctgctgatcatgggcagcttcgtgccctggctgtactacagcttctactgcaacccccagccctgcttcatctacctgatcgtgatctgcgtgctgggcatcgccgccatcatcgtgagccagtgggacatgttcgccaccccccagtacagaggcgtgagagccggcgtgttcctgggcctgggcctgagcggcatcatccccaccctgcactacgtgatcagcgagggcttcctgaaggccgccaccatcggccagatcggctggctgatgctgatggccagcctgtacatcaccggcgccgccctgtacgccgccagaatccccgagagattcttccccggcaagtgcgacatctggttccacagccaccagctgttccacatcttcgtggtggccggcgccttcgtgcacttccacggcgtgagcaacctgcaggagttcagattcatgatcggcggcggctgcagcgaggaggacgccctgtag

SEQ ID NO: 72148 - DNA, 735 bp, Artificial Sequence
  Description of Artificial Sequence: Synthetic coding sequence
atgctgctgctgggcgccgtgctgctgctgctggccctgcccggccacgaccaggagaccaccacccagggccccggcgtgctgctgcccctgcccaagggcgcctgcaccggctggatggccggcatccccggccaccccggccacaacggcgcccccggcagagacggcagagacggcacccccggcgagaagggcgagaagggcgaccccggcctgatcggccccaagggcgacatcggcgagaccggcgtgcccggcgccgagggccccagaggcttccccggcatccagggcagaaagggcgagcccggcgagggcgcctacgtgtacagaagcgccttcagcgtgggcctggagacctacgtgaccatccccaacatgcccatcagattcaccaagatcttctacaaccagcagaaccactacgacggcagcaccggcaagttccactgcaacatccccggcctgtactacttcgcctaccacatcaccgtgtacatgaaggacgtgaaggtgagcctgttcaagaaggacaaggccatgctgttcacctacgaccagtaccaggagaacaacgtggaccaggccagcggcagcgtgctgctgcacctggaggtgggcgaccaggtgtggctgcaggtgtacggcgagggcgagagaaacggcctgtacgccgacaacgacaacgacagcaccttcaccggcttcctgctgtaccacgacaccaactag

SEQ ID NO: 72149 - DNA, 735 bp, Artificial Sequence; identical to SEQ ID NO: 72148
  Description of Artificial Sequence: Synthetic coding sequence

SEQ ID NO: 72150 - DNA, 735 bp, Artificial Sequence; identical to SEQ ID NO: 72148
  Description of Artificial Sequence: Synthetic coding sequence

SEQ ID NO: 72151 - DNA, 1491 bp, Artificial Sequence
  Description of Artificial Sequence: Synthetic coding sequence
atggccctgtggagaggcagcgcctacgccggcttcctggccctggccgtgggctgcgtgttcctgctggagcccgagctgcccggcagcgccctgagaagcctgtggagcagcctgtgcctgggccccgcccccgccccccccggccccgtgagccccgagggcagactggccgccgcctgggacgccctgatcgtgagacccgtgagaagatggagaagagtggccgtgggcgtgaacgcctgcgtggacgtggtgctgagcggcgtgaagctgctgcaggccctgggcctgagccccggcaacggcaaggaccacagcatcctgcacagcagaaacgacctggaggaggccttcatccacttcatgggcaagggcgccgccgccgagagattcttcagcgacaaggagaccttccacgacatcgcccaggtggccagcgagttccccggcgcccagcactacgtgggcggcaacgccgccctgatcggccagaagttcgccgccaacagcgacctgaaggtgctgctgtgcggccccgtgggccccaagctgcacgagctgctggacgacaacgtgttcgtgccccccgagagcctgcaggaggtggacgagttccacctgatcctggagtaccaggccggcgaggagtggggccagctgaaggccccccacgccaacagattcatcttcagccacgacctgagcaacggcgccatgaacatgctggaggtgttcgtgagcagcctggaggagttccagcccgacctggtggtgctgagcggcctgcacatgatggagggccagagcaaggagctgcagagaaagagactgctggaggtggtgaccagcatcagcgacatccccaccggcatccccgtgcacctggagctggccagcatgaccaacagagagctgatgagcagcatcgtgcaccaggtgttccccgccgtgaccagcctgggcctgaacgagcaggagctgctgttcctgacccagagcgccagcggcccccacagcagcctgagcagctggaacggcgtgcccgacgtgggcatggtgagcgacatcctgttctggatcctgaaggagcacggcagaagcaagagcagagccagcgacctgaccagaatccacttccacaccctggtgtaccacatcctggccaccgtggacggccactgggccaaccagctggccgccgtggccgccggcgccagagtggccggcacccaggcctgcgccaccgagaccatcgacaccagcagagtgagcctgagagccccccaggagttcatgaccagccacagcgaggccggcagcagaatcgtgctgaaccccaacaagcccgtggtggagtggcacagagagggcatcagcttccacttcacccccgtgctggtgtgcaaggaccccatcagaaccgtgggcctgggcgacgccatcagcgccgagggcctgttctacagcgaggtgcacccccactactag

SEQ ID NO: 72152 - DNA, 1041 bp, Artificial Sequence
  Description of Artificial Sequence: Synthetic coding sequence
atgggcaagggcgccgccgccgagagattcttcagcgacaaggagaccttccacgacatcgcccaggtggccagcgagttccccggcgcccagcactacgtgggcggcaacgccgccctgatcggccagaagttcgccgccaacagcgacctgaaggtgctgctgtgcggccccgtgggccccaagctgcacgagctgctggacgacaacgtgttcgtgccccccgagagcctgcaggaggtggacgagttccacctgatcctggagtaccaggccggcgaggagtggggccagctgaaggccccccacgccaacagattcatcttcagccacgacctgagcaacggcgccatgaacatgctggaggtgttcgtgagcagcctggaggagttccagcccgacctggtggtgctgagcggcctgcacatgatggagggccagagcaaggagctgcagagaaagagactgctggaggtggtgaccagcatcagcgacatccccaccggcatccccgtgcacctggagctggccagcatgaccaacagagagctgatgagcagcatcgtgcaccagcaggtgttccccgccgtgaccagcctgggcctgaacgagcaggagctgctgttcctgacccagagcgccagcggcccccacagcagcctgagcagctggaacggcgtgcccgacgtgggcatggtgagcgacatcctgttctggatcctgaaggagcacggcagaagcaagagcagagccagcgacctgaccagaatccacttccacaccctggtgtaccacatcctggccaccgtggacggccactgggccaaccagctggccgccgtggccagcagctgcggctgggacaccggcctgagacacagaaaccacagacaccagcccagcgtgagcgagggcacccccagagtgcacgacttccccttcggcggcagactgcaggactgcatcaagcccaagcaggccagcagcagaatggcccagagaggcaacatcctgcccctgcacaccagcatcggcgtgtag

SEQ ID NO: 72153 - DNA, 1251 bp, Artificial Sequence
  Description of Artificial Sequence: Synthetic coding sequence
atggccctgtggagaggcagcgcctacgccggcttcctggccctgggcctgagccccggcaacggcaaggaccacagcatcctgcacagcagaaacgacctggaggaggccttcatccacttcatgggcaagggcgccgccgccgagagattcttcagcgacaaggagaccttccacgacatcgcccaggtggccagcgagttccccggcgcccagcactacgtgggcggcaacgccgccctgatcggccagaagttcgccgccaacagcgacctgaaggtgctgctgtgcggccccgtgggccccaagctgcacgagctgctggacgacaacgtgttcgtgccccccgagagcctgcaggaggtggacgagttccacctgatcctggagtaccaggccggcgaggagtggggccagctgaaggccccccacgccaacagattcatcttcagccacgacctgagcaacggcgccatgaacatgctggaggtgttcgtgagcagcctggaggagttccagcccgacctggtggtgctgagcggcctgcacatgatggagggccagagcaaggagctgcagagaaagagactgctggaggtggtgaccagcatcagcgacatccccaccggcatccccgtgcacctggagctggccagcatgaccaacagagagctgatgagcagcatcgtgcaccagcaggtgttccccgccgtgaccagcctgggcctgaacgagcaggagctgctgttcctgacccagagcgccagcggcccccacagcagcctgagcagctggaacggcgtgcccgacgtgggcatggtgagcgacatcctgttctggatcctgaaggagcacggcagaagcaagagcagagccagcgacctgaccagaatccacttccacaccctggtgtaccacatcctggccaccgtggacggccactgggccaaccagctggccgccgtggccgccggcgccagagtggccggcacccaggcctgcgccaccgagaccatcgacaccagcagagtgagcctgagagccccccaggagttcatgaccagccacagcgaggccggcagcagaatcgtgctgaaccccaacaagcccgtggtggagtggcacagagagggcatcagcttccacttcacccccgtgctggtgtgcaaggaccccatcagaaccgtgggcctgggcgacgccatcagcgccgagggcctgttctacagcgaggtgcacccccactactag

SEQ ID NO: 72154 - DNA, 669 bp, Artificial Sequence
  Description of Artificial Sequence: Synthetic coding sequence
atggccgccagctgcagagtggtgaccagcatcagcgacatccccaccggcatccccgtgcacctggagctggccagcatgaccaacagagagctgatgagcagcatcgtgcaccaggtgttccccgccgtgaccagcctgggcctgaacgagcaggagctgctgttcctgacccagagcgccagcggcccccacagcagcctgagcagctggaacggcgtgcccgacgtgggcatggtgagcgacatcctgttctggatcctgaaggagcacggcagaagcaagagcagagccagcgacctgaccagaatccacttccacaccctggtgtaccacatcctggccaccgtggacggccactgggccaaccagctggccgccgtggccgccggcgccagagtggccggcacccaggcctgcgccaccgagaccatcgacaccagcagagtgagcctgagagccccccaggagttcatgaccagccacagcgaggccggcagcagaatcgtgctgaaccccaacaagcccgtggtggagtggcacagagagggcatcagcttccacttcacccccgtgctggtgtgcaaggaccccatcagaaccgtgggcctgggcgacgccatcagcgccgagggcctgttctacagcgaggtgcacccccactactag

SEQ ID NO: 72155 - DNA, 546 bp, Artificial Sequence
  Description of Artificial Sequence: Synthetic coding sequence
atgggcaacatcttcgccaacctgttcaagggcctgttcggcaagaaggagatgagaatcctgatggtgggcctggacgccgccggcaagaccaccatcctgtacaagctgaagctgggcgagatcgtgaccaccatccccaccatcggcttcaacgtggagaccgtggagtacaagaacatcagcttcaccgtgtgggacgtgggcggccaggacaagatcagacccctgtggagacactacttccagaacacccagggcctgatcttcgtggtggacagcaacgacagagagagagtgaacgaggccagagaggagctgatgagaatgctggccgaggacgagctgagagacgccgtgctgctggtgttcgccaacaagcaggacctgcccaacgccatgaacgccgccgagatcaccgacaagctgggcctgcacagcctgagacacagaaactggtacatccaggccacctgcgccaccagcggcgacggcctgtacgagggcctggactggctgagcaaccagctgagaaaccagaagtag

SEQ ID NO: 72156 - DNA, 546 bp, Artificial Sequence; identical to SEQ ID NO: 72155
  Description of Artificial Sequence: Synthetic coding sequence

SEQ ID NO: 72157 - DNA, 546 bp, Artificial Sequence; identical to SEQ ID NO: 72155
  Description of Artificial Sequence: Synthetic coding sequence

SEQ ID NO: 72158 - DNA, 519 bp, Artificial Sequence
  Description of Artificial Sequence: Synthetic coding sequence
atgggcaacatcttcgccaacctgttcaagggcctgttcggcaagaaggagatgagaatcctgatggtgggcctggacgccgccggcaagaccaccatcctgtacaagctgaagctgggcgagatcgtgaccaccatccccaccatcggcttcaacgtggagaccgtggagtacaagaacatcagcttcaccgtgtgggacgtgggcggccaggacaagatcagacccctgtggagacactacttccagaacacccagggcctgatcttcgtggtggacagcaacgacagagagagagtgaacgaggcccaggacgagctgagagacgccgtgctgctggtgttcgccaacaagcaggacctgcccaacgccatgaacgccgccgagatcaccgacaagctgggcctgcacagcctgagacacagaaactggtacatccaggccacctgcgccaccagcggcgacggcctgtacgagggcctggactggctgagcaaccagctgagaaaccagaagtag

SEQ ID NO: 72159 - DNA, 546 bp, Artificial Sequence
  Description of Artificial Sequence: Synthetic coding sequence
atgggcaacatcttcggcaacctgctgaagagcctgatcggcaagaaggagatgagaatcctgatggtgggcctggacgccgccggcaagaccaccatcctgtacaagctgaagctgggcgagatcgtgaccaccatccccaccatcggcttcaacgtggagaccgtggagtacaagaacatcagcttcaccgtgtgggacgtgggcggccaggacaagatcagacccctgtggagacactacttccagaacacccagggcctgatcttcgtggtggacagcaacgacagagagagagtgaacgaggccagagaggagctgatgagaatgctggccgaggacgagctgagagacgccgtgctgctggtgttcgccaacaagcaggacctgcccaacgccatgaacgccgccgagatcaccgacaagctgggcctgcacagcctgagacacagaaactggtacatccaggccacctgcgccaccagcggcgacggcctgtacgagggcctggactggctggccaaccagctgaagaacaagaagtag

SEQ ID NO: 72160 - DNA, 435 bp, Artificial Sequence
  Description of Artificial Sequence: Synthetic coding sequence
atgggcaacatcttcggcaacctgctgaagagcctgatcggcaagaaggagatgagaatcctgatggtgggcctggacgccgccggcaagaccaccatcctgtacaagctgaagctgggcgagatcgtgaccaccatccccaccatcggcctgatcttcgtggtggacagcaacgacagagagagagtgaacgaggccagagaggagctgatgagaatgctggccgaggacgagctgagagacgccgtgctgctggtgttcgccaacaagcaggacctgcccaacgccatgaacgccgccgagatcaccgacaagctgggcctgcacagcctgagacacagaaactggtacatccaggccacctgcgccaccagcggcgacggcctgtacgagggcctggactggctggccaaccagctgaagaacaagaagtag

SEQ ID NO: 72161 - DNA, 153 bp, Artificial Sequence
  Description of Artificial Sequence: Synthetic coding sequence
atgggcaacatcttcggcaacctgctgaagagcctgatcggcaagaaggagatgagaatcctgatggtgggcctggacgccgccggcaagaccaccatcctgtacaagctgaagctgggcgagatcgtgaccaccatccccaccatcggctag

SEQ ID NO: 72162 - DNA, 309 bp, Artificial Sequence
  Description of Artificial Sequence: Synthetic coding sequence
atgggcaacatcttcggcaacctgctgaagagcctgatcggcaagaaggagatgagaatcctgatggtgggcctggacgccgccggcaagaccaccatcctgtacaagctgaagctgggcgagatcgtgaccaccatccccaccatcggcttcaacgtggagaccgtggagtacaagaacatcagcttcaccgtgtgggacgtgggcggccaggacaagatcagacccctgtggagacactacttccagaacacccagggcctgatcttcgtggtggacagcaacgacagagagagagtgaacgagtag

SEQ ID NO: 72163 - DNA, 546 bp, Artificial Sequence; identical to SEQ ID NO: 72159
  Description of Artificial Sequence: Synthetic coding sequence

SEQ ID NO: 72164 - DNA, 123 bp, Artificial Sequence
  Description of Artificial Sequence: Synthetic coding sequence
atgggcaacatcttcggcaacctgctgaagagcctgatcggcaagaaggagatgagaatcctgatggtgggcctggacgccgccggcaagaccaccatcctgtacaagctgaagctgggctag

SEQ ID NO: 72165 - DNA, 543 bp, Artificial Sequence
  Description of Artificial Sequence: Synthetic coding sequence
atgggcctgaccatcagcagcctgttcagcagactgttcggcaagaagcagatgagaatcctgatggtgggcctggacgccgccggcaagaccaccatcctgtacaagctgaagctgggcgagatcgtgaccaccatccccaccatcggcttcaacgtggagaccgtggagtacaagaacatctgcttcaccgtgtgggacgtgggcggccaggacagaatcagacccctgtggaagcactacttccagaacacccagggcctgatcttcgtggtggacagcaacgacagagagagaatccaggaggtggccgacgagctgcagaagatgctgctggtggacgagctgagagacgccgtgctgctgctgttcgccaacaagcaggacctgcccaacgccatggccatcagcgagatgaccgacaagctgggcctgcagagcctgagaaacagaacctggtacgtgcaggccacctgcgccacccagggcaccggcctgtacgagggcctggactggctgagcaacgagctgagcaagagatag

SEQ ID NO: 72166 - DNA, 384 bp, Artificial Sequence
  Description of Artificial Sequence: Synthetic coding sequence
atgggcctgaccatcagcagcctgttcagcagactgttcggcaagaagcagatgagaatcctgatggtgggcctggacgccgccggcaagaccaccatcctgtacaagctgaagctgggcgagatcgtgaccaccatccccaccatcggcttcaacgtggagaccgtggagtacaagaacatctgcttcaccgtgtgggacgtgggcggccaggacagaatcagacccctgtggaagcactacttccagaacacccagggcctgatcttcgtggtggacagcaacgacagagagagaatccaggaggtggccgacgagctgcagaagatgctgctggtggacgagctgagagacgccgtgctgctgctgttcgccaacaagtag

SEQ ID NO: 72167 - DNA, 69 bp, Artificial Sequence
  Description of Artificial Sequence: Synthetic coding sequence
atgggcctgaccatcagcagcctgttcagcagactgttcggcaagaagcagatgagaatcctgatgtag

SEQ ID NO: 72168 - DNA, 543 bp, Artificial Sequence
  Description of Artificial Sequence: Synthetic coding sequence
atgggcctgaccgtgagcgccctgttcagcagaatcttcggcaagaagcagatgagaatcctgatggtgggcctggacgccgccggcaagaccaccatcctgtacaagctgaagctgggcgagatcgtgaccaccatccccaccatcggcttcaacgtggagaccgtggagtacaagaacatctgcttcaccgtgtgggacgtgggcggccaggacaagatcagacccctgtggagacactacttccagaacacccagggcctgatcttcgtggtggacagcaacgacagagagagagtgcaggagagcgccgacgagctgcagaagatgctgcaggaggacgagctgagagacgccgtgctgctggtgttcgccaacaagcaggacatgcccaacgccatgcccgtgagcgagctgaccgacaagctgggcctgcagcacctgagaagcagaacctggtacgtgcaggccacctgcgccacccagggcaccggcctgtacgacggcctggactggctgagccacgagctgagcaagagatag

SEQ ID NO: 72169 - DNA, 1245 bp, Artificial Sequence
  Description of Artificial Sequence: Synthetic coding sequence
atggccagccccagaaccagaaaggtgctgaaggaggtgagagtgcaggacgagaacaacgtgtgcttcgagtgcggcgccttcaacccccagtgggtgagcgtgacctacggcatctggatctgcctggagtgcagcggcagacacagaggcctgggcgtgcacctgagcttcgtgagaagcgtgaccatggacaagtggaaggacatcgagctggagaagatgaaggccggcggcaacgccaagttcagagagttcctggagagccaggaggactacgacccctgctggagcctgcaggagaagtacaacagcagagccgccgccctgttcagagacaaggtggtggccctggccgagggcagagagtggagcctggagagcagccccgcccagaactggacccccccccagcccagaaccctgcccagcatggtgcacagagtgagcggccagccccagagcgtgaccgccagcagcgacaaggccttcgaggactggctgaacgacgacctgggcagctaccagggcgcccagggcaacagatacgtgggcttcggcaacaccccccccccccagaagaaggaggacgacttcctgaacaacgccatgagcagcctgtacagcggctggagcagcttcaccaccggcgccagcagattcgccagcgccgccaaggagggcgccaccaagttcggcagccaggccagccagaagttctggggccacaagcagcagcccgagcccgccagcgagctgggccacagcctgaacgagaacgtgctgaagcccgcccaggagaaggtgaaggagggcaagatcttcgacgacgtgagcagcggcgtgagccagctggccagcaagggcgtgggcagcaagggctggagagacgtgaccaccttcttcagcggcaaggccgagggccccctggacagccccagcgagggccacagctaccagaacagcggcctggaccacttccagaacagcaacatcgaccagagcttctgggagaccttcggcagcgccgagcccaccaagaccagaaagagccccagcagcgacagctggacctgcgccgacaccagcaccgagagaagaagcagcgacagctgggaggtgtggggcagcgccagcaccaacagaaacagcaacagcgacggcggcgagggcggcgagggcaccaagaaggccgtgccccccgccgtgcccaccgacgacggctgggacaaccagaactggtag

SEQ ID NO: 72170 - DNA, 1212 bp, Artificial Sequence
  Description of Artificial Sequence: Synthetic coding sequence
atggccagccccagaaccagaaaggtgctgaaggaggtgagagtgcaggacgagaacaacgtgtgcttcgagtgcggcgccttcaacccccagtgggtgagcgtgacctacggcatctggatctgcctggagtgcagcggcagacacagaggcctgggcgtgcacctgagcttcgtgagaagcgtgaccatggacaagtggaaggacatcgagctggagaagatgaaggccggcggcaacgccaagttcagagagttcctggagagccaggaggactacgacccctgctggagcctgcaggagaagtacaacagcagagccgccgccctgttcagagacaaggtggtggccctggccgagggcagagagtggagcctggagagcagccccgcccagaactggacccccccccagcccagaaccctgcccagcatggtgcacagagtgagcggccagccccagagcgtgaccgccagcagcgacaaggccttcgaggactggctgaacgacgacctgggcagctaccagggcgcccagggcaacagatacgtgggcttcggcaacaccccccccccccagaagaaggaggacgacttcctgaacaacgccatgagcagcctgtacagcggctggagcagcttcaccaccggcgccagcagattcgccagcgccgccaaggagggcgccaccaagttcggcagccaggccagccagaaggccagcgagctgggccacagcctgaacgagaacgtgctgaagcccgcccaggagaaggtgaaggagggcaagatcttcgacgacgtgagcagcggcgtgagccagctggccagcaagtgccagagaagactgtgctgccaccagagccactgcagcgccggccacctgggcagagccttctgccccgtgagctggcacgaggccctgtgcggccagaccggcagagaggagcaggccagcctgctgccccccaagcacgtggtgggcgccctggaggtgtgcgccagaggctgccccagatgccacgtgccccacacccccggcaccgccgccgagtggcccggcagactgtgcctgagcagagagagcgtggtgagagacggcggcaccagcccccccttcttcagaggcaagcagagagccccctggaccgcccccagaagagccaccgtgatcagaaccgccgtgtggaccaccagcaagaccgccacctag

SEQ ID NO: 72171 - DNA, 1221 bp, Artificial Sequence
  Description of Artificial Sequence: Synthetic coding sequence
atggccagccccagaaccagaaaggtgctgaaggaggtgagagtgcaggacgagaacaacgtgtgcttcgagtgcggcgccttcaacccccagtgggtgagcgtgacctacggcatctggatctgcctggagtgcagcggcagacacagaggcctgggcgtgcacctgagcttcgtgagaagcgtgaccatggacaagtggaaggacatcgagctggagaagatgaaggccggcggcaacgccaagttcagagagttcctggagagccaggaggactacgacccctgctggagcctgcaggagaagtacaacagcagagccgccgccctgttcagagacaaggtggtggccctggccgagggcagagagtggagcctggagagcagccccgcccagaactggacccccccccagcccagaaccctgcccagcatggtgcacagagtgagcggccagccccagagcgtgaccgccagcagcgacaaggccttcgaggactggctgaacgacgacctgggcagctaccagggcgcccagggcaacagatacgtgggcttcggcaacaccccccccccccagaagaaggaggacgacttcctgaacaacgccatgagcagcctgtacagcggctggagcagcttcaccaccggcgccagcagattcgccagcgccgccaaggagggcgccaccaagttcggcagccaggccagccagaaggccagcgagctgggccacagcctgaacgagaacgtgctgaagcccgcccaggagaaggtgaaggagggcaagatcttcgacgacgtgagcagcggcgtgagccagctggccagcaaggtgcagggcgtgggcagcaagggctggagagacgtgaccaccttcttcagcggcaaggccgagggccccctggacagccccagcgagggccacagctaccagaacagcggcctggaccacttccagaacagcaacatcgaccagagcttctgggagaccttcggcagcgccgagcccaccaagaccagaaagagccccagcagcgacagctggacctgcgccgacaccagcaccgagagaagaagcagcgacagctgggaggtgtggggcagcgccagcaccaacagaaacagcaacagcgacggcggcgagggcggcgagggcaccaagaaggccgtgccccccgccgtgcccaccgacgacggctgggacaaccagaactggtag

SEQ ID NO: 72172 - DNA, 882 bp, Artificial Sequence
  Description of Artificial Sequence: Synthetic coding sequence
atgctgagcagcgagagcagctggagcctgagaagaatcaccatcctggccggcccctgcagaagaagcaccaccgccgagcccagacccagcctgggcatcagagtgagcggccagccccagagcgtgaccgccagcagcgacaaggccttcgaggactggctgaacgacgacctgggcagctaccagggcgcccagggcaacagatacgtgggcttcggcaacaccccccccccccagaagaaggaggacgacttcctgaacaacgccatgagcagcctgtacagcggctggagcagcttcaccaccggcgccagcagattcgccagcgccgccaaggagggcgccaccaagttcggcagccaggccagccagaaggccagcgagctgggccacagcctgaacgagaacgtgctgaagcccgcccaggagaaggtgaaggagggcaagatcttcgacgacgtgagcagcggcgtgagccagctggccagcaaggtgcagggcgtgggcagcaagggctggagagacgtgaccaccttcttcagcggcaaggccgagggccccctggacagccccagcgagggccacagctaccagaacagcggcctggaccacttccagaacagcaacatcgaccagagcttctgggagaccttcggcagcgccgagcccaccaagaccagaaagagccccagcagcgacagctggacctgcgccgacaccagcaccgagagaagaagcagcgacagctgggaggtgtggggcagcgccagcaccaacagaaacagcaacagcgacggcggcgagggcggcgagggcaccaagaaggccgtgccccccgccgtgcccaccgacgacggctgggacaaccagaactggtag

SEQ ID NO: 72173 - DNA, 1086 bp, Artificial Sequence
  Description of Artificial Sequence: Synthetic coding sequence
atgagaaccaccttcgtgagaagcgtgaccatggacaagtggaaggacatcgagctggagaagatgaaggccggcggcaacgccaagttcagagagttcctggagagccaggaggactacgacccctgctggagcctgcaggagaagtacaacagcagagccgccgccctgttcagagacaaggtggtggccctggccgagggcagagagtggagcctggagagcagccccgcccagaactggacccccccccagcccagaaccctgcccagcatggtgcacagagtgagcggccagccccagagcgtgaccgccagcagcgacaaggccttcgaggactggctgaacgacgacctgggcagctaccagggcgcccagggcaacagatacgtgggcttcggcaacaccccccccccccagaagaaggaggacgacttcctgaacaacgccatgagcagcctgtacagcggctggagcagcttcaccaccggcgccagcagattcgccagcgccgccaaggagggcgccaccaagttcggcagccaggccagccagaagttctggggccacaagcagcagcccgagcccgccagcgagctgggccacagcctgaacgagaacgtgctgaagcccgcccaggagaaggtgaaggagggcaagatcttcgacgacgtgagcagcggcgtgagccagctggccagcaagggcgtgggcagcaagggctggagagacgtgaccaccttcttcagcggcaaggccgagggccccctggacagccccagcgagggccacagctaccagaacagcggcctggaccacttccagaacagcaacatcgaccagagcttctgggagaccttcggcagcgccgagcccaccaagaccagaaagagccccagcagcgacagctggacctgcgccgacaccagcaccgagagaagaagcagcgacagctgggaggtgtggggcagcgccagcaccaacagaaacagcaacagcgacggcggcgagggcggcgagggcaccaagaaggccgtgccccccgccgtgcccaccgacgacggctgggacaaccagaactggtag

SEQ ID NO: 72174 - DNA, 786 bp, Artificial Sequence
  Description of Artificial Sequence: Synthetic coding sequence
atggccagccccagaaccagaaaggtgctgaaggaggtgagagtgcaggacgagaacaacgtgtgcttcgagtgcggcgccttcaacccccagtgggtgagcgtgacctacggcatctggatctgcctggagtgcagcggcagacacagaggcctgggcgtgcacctgagcttcgtgagaagcgtgaccatggacaagtggaaggacatcgagctggagaagatgaaggccggcggcaacgccaagttcagagagttcctggagagccaggaggactacgacccctgctggagcctgcaggagaagtacaacagcagagccgccgccctgttcagagacaaggtggtggccctggccgagggcagagagtggagcctggagagcagccccgcccagaactggacccccccccagcccagaaccctgcccagcatggtgcacagagtgagcggccagccccagagcgtgaccgccagcagcgacaaggccttcgaggactggctgaacgacgacctgggcagctaccagggcgcccagggcaacagatacgtgggcttcggcaacaccccccccccccagaagaaggaggacgacttcctgaacaacgccatgagcagcctgtacagcggctggagcagcttcaccaccggcgccagcagattcgccagcgccgccaaggagggcgccaccaagttcggcagccaggccagccagaaggccagcgagctgggccacagcctgaacgagaacgtgctgaagcccgcccaggagaaggtgaaggagtag

SEQ ID NO: 72175 - DNA, 240 bp, Artificial Sequence
  Description of Artificial Sequence: Synthetic coding sequence
atggccagccccagaaccagaaaggtgctgaaggaggtgagagtgcaggacgagaacaacgtgtgcttcgagtgcggcgccttcaacccccagtgggtgagcgtgacctacggcatctggatctgcctggagtgcagcggcagacacagaggcctgggcgtgcacctgagcttcgtgagaagcgtgaccatggacaagtggaaggacatcgagctggagaagatgaaggccggcggctag

SEQ ID NO: 72176 - DNA, 369 bp, Artificial Sequence
  Description of Artificial Sequence: Synthetic coding sequence
atggccagccccagaaccagaaaggtgctgaaggaggtgagagtgcaggacgagaacaacgtgtgcttcgagtgcggcgccttcaacccccagtgggtgagcgtgacctacggcatctggatctgcctggagtgcagcggcagacacagaggcctgggcgtgcacctgagcttcgtgagaagcgtgaccatggacaagtggaaggacatcgagctggagaagatgaaggccggcggcaacgccaagttcagagagttcctggagagccaggaggactacgacccctgctggagcctgcaggagaagtacaacagcagagccgccgccctgttcagagacaaggtggtggccctggccgagggcagatag

SEQ ID NO: 72177 - DNA, 759 bp, Artificial Sequence
  Description of Artificial Sequence: Synthetic coding sequence
atggtggccagcatgagactggcctaccaggagctgcagatcgacagaaagaaggaggagaagaagctgcagaacctggagggcaagaagagagagcaggccgagagactgggcatgggcctggtgagcagaagcagcgtgagccacagcgtgctgagcgagatgcaggtgatcgagcaggagacccccgtgagcgccaagagcagcagaagccagctggacctgttcgacgacgtgggcaccttcgccagcggcccccccaagtacaaggacaaccccttcagcctgggcgagagcttcggcagcagatgggacaccgacgccgcctggggcatggacagagtggaggagaaggagcccgaggtgaccatcagcagcatcagacccatcagcgagagagccaccaacagaagagaggtggagagcagaagcagcggcctggagagcagcgaggccagacagaagttcgccggcgccaaggccatcagcagcgacatgttcttcggcagagaggtggacgccgagtacgaggccagaagcagactgcagcagctgagcggcagcagcgccatcagcagcagcgacctgttcggcgacatggacggcgcccacggcgccggcagcgtgagcctgggcaacgtgctgcccaccgccgacatcgcccagttcaagcagggcgtgaagagcgtggccggcaagatggccgtgctggccaacggcgtgatgaacagcctgcaggacagatacggcagctactag

SEQ ID NO: 72178 - DNA, 1245 bp, Artificial Sequence
  Description of Artificial Sequence: Synthetic coding sequence
atgcaggtgggcggcaacgccaacgccaccgccttcttcagacagcacggctgcaccgccaacgacgccaacaccaagtacaacagcagagccgcccagatgtacagagagaagatcagacagctgggcagcgccgccctggccagacacggcaccgacccccccgcctgggacgcccccgccaccgagcccagcggcacccagcagcccgcccccagcaccgagagcagcggcctggcccagcccgagcacggccccaacaccgacctgctgggcaccagccccaaggccagcctggagctgaagagcagcatcatcggcaagaagaagcccgccgccgccaagaagggcctgggcgccaagaagggcctgggcgcccagaaggtgagcagccagagcttcagcgagatcgagagacaggcccaggtggccgagaagctgagagagcagcaggccgccgacgccaagaagcaggccgaggagagcatggtggccagcatgagactggcctaccaggagctgcagatcgacagaaagaaggaggagaagaagctgcagaacctggagggcaagaagagagagcaggccgagagactgggcatgggcctggtgagcagaagcagcgtgagccacagcgtgctgagcgagatgcaggtgatcgagcaggagacccccgtgagcgccaagagcagcagaagccagctggacctgttcgacgacgtgggcaccttcgccagcggcccccccaagtacaaggacaaccccttcagcctgggcgagagcttcggcagcagatgggacaccgacgccgcctggggcatggacagagtggaggagaaggagcccgaggtgaccatcagcagcatcagacccatcagcgagagagccaccaacagaagagaggtggagagcagaagcagcggcctggagagcagcgaggccagacagaagttcgccggcgccaaggccatcagcagcgacatgttcttcggcagagaggtggacgccgagtacgaggccagaagcagactgcagcagctgagcggcagcagcgccatcagcagcagcgacctgttcggcgacatggacggcgcccacggcgccggcagcgtgagcctgggcaacgtgctgcccaccgccgacatcgcccagttcaagcagggcgtgaagagcgtggccggcaagatggccgtgctggccaacggcgtgatgaacagcctgcaggacagatacggcagctactag

SEQ ID NO: 72179 - DNA, 1158 bp, Artificial Sequence
  Description of Artificial Sequence: Synthetic coding sequence
atggccgccgagcccaacaagaccgagatccagaccctgttcaagagactgagagccgtgcccaccaacaaggcctgcttcgactgcggcgccaagaaccccagctgggccagcatcacctacggcgtgttcctgtgcatcgactgcagcggcgtgcacagaagcctgggcgtgcacctgagcttcatcagaagcaccgagctggacagcaactggaactggttccagctgagatgcatgcaggtgggcggcaacgccaacgccctgggcgccaagaagggcctgggcgcccagaaggtgagcagccagagcttcagcgagatcgagagacaggcccaggtggccgagaagctgagagagcagcaggccgccgacgccaagaagcaggccgaggagagcatggtggccagcatgagactggcctaccaggagctgcagatcgacagaaagaaggaggagaagaagctgcagaacctggagggcaagaagagagagcaggccgagagactgggcatgggcctggtgagcagaagcagcgtgagccacagcgtgctgagcgagatgcaggtgatcgagcaggagacccccgtgagcgccaagagcagcagaagccagctggacctgttcgacgacgtgggcaccttcgccagcggcccccccaagtacaaggacaaccccttcagcctgggcgagagcttcggcagcagatgggacaccgacgccgcctggggcatggacagagtggaggagaaggagcccgaggtgaccatcagcagcatcagacccatcagcgagagagccaccaacagaagagaggtggagagcagaagcagcggcctggagagcagcgaggccagacagaagttcgccggcgccaaggccatcagcagcgacatgttcttcggcagagaggtggacgccgagtacgaggccagaagcagactgcagcagctgagcggcagcagcgccatcagcagcagcgacctgttcggcgacatggacggcgcccacggcgccggcagcgtgagcctgggcaacgtgctgcccaccgccgacatcgcccagttcaagcagggcgtgaagagcgtggccggcaagatggccgtgctggccaacggcgtgatgaacagcctgcaggacagatacggcagctactag

SEQ ID NO: 72180 - DNA, 1566 bp, Artificial Sequence
  Description of Artificial Sequence: Synthetic coding sequence
atggccgccgagcccaacaagaccgagatccagaccctgttcaagagactgagagccgtgcccaccaacaaggcctgcttcgactgcggcgccaagaaccccagctgggccagcatcacctacggcgtgttcctgtgcatcgactgcagcggcgtgcacagaagcctgggcgtgcacctgagcttcatcagaagcaccgagctggacagcaactggaactggttccagctgagatgcatgcaggtgggcggcaacgccaacgccaccgccttcttcagacagcacggctgcaccgccaacgacgccaacaccaagtacaacagcagagccgcccagatgtacagagagaagatcagacagctgggcagcgccgccctggccagacacggcaccgacctgtggatcgacaacatgagcagcgccgtgcccaaccacagccccgagaagaaggacagcgacttcttcaccgagcacacccagccccccgcctgggacgcccccgccaccgagcccagcggcacccagcagcccgcccccagcaccgagagcagcggcctggcccagcccgagcacggccccaacaccgacctgctgggcaccagccccaaggccagcctggagctgaagagcagcatcatcggcaagaagaagcccgccgccgccaagaagggcctgggcgccaagaagggcctgggcgcccagaaggtgagcagccagagcttcagcgagatcgagagacaggcccaggtggccgagaagctgagagagcagcaggccgccgacgccaagaagcaggccgaggagagcatggtggccagcatgagactggcctaccaggagctgcagatcgacagaaagaaggaggagaagaagctgcagaacctggagggcaagaagagagagcaggccgagagactgggcatgggcctggtgagcagaagcagcgtgagccacagcgtgctgagcgagatgcaggtgatcgagcaggagacccccgtgagcgccaagagcagcagaagccagctggacctgttcgacgacgtgggcaccttcgccagcggcccccccaagtacaaggacaaccccttcagcctgggcgagagcttcggcagcagatgggacaccgacgccgcctggggcatggacagagtggaggagaaggagcccgaggtgaccatcagcagcatcagacccatcagcgagagagccaccaacagaagagaggtggagagcagaagcagcggcctggagagcagcgaggccagacagaagttcgccggcgccaaggccatcagcagcgacatgttcttcggcagagaggtggacgccgagtacgaggccagaagcagactgcagcagctgagcggcagcagcgccatcagcagcagcgacctgttcggcgacatggacggcgcccacggcgccggcagcgtgagcctgggcaacgtgctgcccaccgccgacatcgcccagttcaagcagggcgtgaagagcgtggccggcaagatggccgtgctggccaacggcgtgatgaacagcctgcaggacagatacggcagctactag

SEQ ID NO: 72181 - DNA, 1551 bp, Artificial Sequence
  Description of Artificial Sequence: Synthetic coding sequence
atgggcgaccccagcaagcaggacatcctgaccatcttcaagagactgagaagcgtgcccaccaacaaggtgtgcttcgactgcggcgccaagaaccccagctgggccagcatcacctacggcgtgttcctgtgcatcgactgcagcggcagccacagaagcctgggcgtgcacctgagcttcatcagaagcaccgagctggacagcaactggagctggttccagctgagatgcatgcaggtgggcggcaacgccagcgccagcagcttcttccaccagcacggctgcagcaccaacgacaccaacgccaagtacaacagcagagccgcccagctgtacagagagaagatcaagagcctggccagccaggccaccagaaagcacggcaccgacctgtggctggacagctgcgtggtgccccccctgagccccccccccaaggaggaggacttcttcgccagccacgtgagccccgaggtgagcgacaccgcctgggccagcgccatcgccgagcccagcagcctgaccagcagacccgtggagaccaccctggagaacaacgagggcggccaggagcagggccccagcgtggagggcctgaacgtgcccaccaaggccaccctggaggtgagcagcatcatcaagaagaagcccaaccaggccaagaagggcctgggcgccaagaagggcagcctgggcgcccagaagctggccaacacctgcttcaacgagatcgagaagcaggcccaggccgccgacaagatgaaggagcaggaggacctggccaaggtggtgagcaaggaggagagcatcgtgagcagcctgagactggcctacaaggacctggagatccagatgaagaaggacgagaagatgaacatcagcggcaagaagaacgtggacagcgacagactgggcatgggcttcggcaactgcagaagcgtgatcagccacagcgtgaccagcgacatgcagaccatcgagcaggagagccccatcatggccaagcccagaaagaagtacaacgacgacagcgacgacagctacttcaccagcagcagcagctacttcgacgagcccgtggagctgagaagcagcagcttcagcagctgggacgacagcagcgacagctactggaagaaggagaccagcaaggacaccgagaccgtgctgaagaccaccggctacagcgacagacccaccgccagaagaaagcccgactacgagcccgtggagaacaccgacgaggcccagaagaagttcggcaacgtgaaggccatcagcagcgacatgtacttcggcagacagagccaggccgactacgagaccagagccagactggagagactgagcgccagcagcagcatcagcagcgccgacctgttcgaggagcccagaaagcagcccgccggcaactacagcctgagcagcgtgctgcccaacgcccccgacatggcccagttcaagcagggcgtgagaagcgtggccggcaagctgagcgtgttcgccaacggcgtggtgaccagcatccaggacagatacggcagctag

SEQ ID NO: 72182 - DNA, 1335 bp, Artificial Sequence
  Description of Artificial Sequence: Synthetic coding sequence
atgggcgaccccagcaagcaggacatcctgaccatcttcaagagactgagaagcgtgcccaccaacaaggtgtgcttcgactgcggcgccaagaaccccagctgggccagcatcacctacggcgtgttcctgtgcatcgactgcagcggcagccacagaagcctgggcgtgcacctgagcttcatcagaagcaccgagctggacagcaactggagctggttccagctgagatgcatgcaggtgggcggcaacgccagcgccgtgagcgacaccgcctgggccagcgccatcgccgagcccagcagcctgaccagcagacccgtggagaccaccctggagaacaacgagggcggccaggagcagggccccagcgtggagggcctgaacgtgcccaccaaggccaccctggaggtgagcagcatcatcaagaagaagcccaaccaggccaagaagggcctgggcgccaagaagggcagcctgggcgcccagaagctggccaacacctgcttcaacgagatcgagaagcaggcccaggccgccgacaagatgaaggagcaggaggacctggccaaggtggtgagcaaggaggagagcatcgtgagcagcctgagactggcctacaaggacctggagatccagatgaagaaggacgagaagatgaacatcagcggcaagaagaacgtggacagcgacagactgggcatgggcttcggcaactgcagaagcgtgatcagccacagcgtgaccagcgacatgcagaccatcgagcaggagagccccatcatggccaagcccagaaagaagtacaacgacgacagcgacgacagctacttcaccagcagcagcagctacttcgacgagcccgtggagctgagaagcagcagcttcagcagctgggacgacagcagcgacagctactggaagaaggagaccagcaaggacaccgagaccgtgctgaagaccaccggctacagcgacagacccaccgccagaagaaagcccgactacgagcccgtggagaacaccgacgaggcccagaagaagttcggcaacgtgaaggccatcagcagcgacatgtacttcggcagacagagccaggccgactacgagaccagagccagactggagagactgagcgccagcagcagcatcagcagcgccgacctgttcgaggagcccagaaagcagcccgccggcaactacagcctgagcagcgtgctgcccaacgcccccgacatggcccagttcaagcagggcgtgagaagcgtggccggcaagctgagcgtgttcgccaacggcgtggtgaccagcatccaggacagatacggcagctag

SEQ ID NO: 72183 - DNA, 1419 bp, Artificial Sequence
  Description of Artificial Sequence: Synthetic coding sequence
atgggcgaccccagcaagcaggacatcctgaccatcttcaagagactgagaagcgtgcccaccaacaaggtgtgcttcgactgcggcgccaagaaccccagctgggccagcatcacctacggcgtgttcctgtgcatcgactgcagcggcagccacagaagcctgggcgtgcacctgagcttcatcagaagcaccgagctggacagcaactggagctggttccagctgagatgcatgcaggtgggcggcaacgccagcgccctgtggctggacagctgcgtggtgccccccctgagccccccccccaaggaggaggacttcttcgccagccacgtgagccccgaggtgagcgacaccgcctgggccagcgccatcgccgagcccagcagcctgaccagcagacccgtggagaccaccctggagaacaacgagggcggccaggagcagggccccagcgtggagggcctgaacgtgcccaccaaggccaccctggaggtgagcagcatcatcaagaagaagcccaaccaggccaagaagggcctgggcgccaagaagggcagcctgggcgcccagaagctggccaacacctgcttcaacgagatcgagaagcaggcccaggccgccgacaagatgaaggagcaggaggacctggccaaggtggtgagcaaggaggagagcatcgtgagcagcctgagactggcctacaaggacctggagatccagatgaagaaggacgagaagatgaacatcagcggcaagaagaacgtggacagcgacagactgggcatgggcttcggcaactgcagaagcgtgatcagccacagcgtgaccagcgacatgcagaccatcgagcaggagagccccatcatggccaagcccagaaagaagtacaacgacgacagcgacgacagctacttcaccagcagcagcagctacttcgacgagcccgtggagctgagaagcagcagcttcagcagctgggacgacagcagcgacagctactggaagaaggagaccagcaaggacaccgagaccgtgctgaagaccaccggctacagcgacagacccaccgccagaagaaagcccgactacgagcccgtggagaacaccgacgaggcccagaagaagttcggcaacgtgaaggccatcagcagcgacatgtacttcggcagacagagccaggccgactacgagaccagagccagactggagagactgagcgccagcagcagcatcagcagcgccgacctgttcgaggagcccagaaagcagcccgccggcaactacagcctgagcagcgtgctgcccaacgcccccgacatggcccagttcaagcagggcgtgagaagcgtggccggcaagctgagcgtgttcgccaacggcgtggtgaccagcatccaggacagatacggcagctag

SEQ ID NO: 72184 - DNA, 822 bp, Artificial Sequence
  Description of Artificial Sequence: Synthetic coding sequence
tgactggccctgttccaggtgagcgacaccgcctgggccagcgccatcgccgagcccagcagcctgaccagcagacccgtggagaccaccctggagaacaacgagggcggccaggagcagggccccagcgtggagggcctgaacgtgcccaccaaggccaccctggaggtgagcagcatcatcaagaagaagcccaaccaggccaagaagggcctgggcgccaagaagggcagcctgggcgcccagaagctggccaacacctgcttcaacgagatcgagaagcaggcccaggccgccgacaagatgaaggagcaggaggacctggccaaggtggtgagcaaggaggagagcatcgtgagcagcctgagactggcctacaaggacctggagatccagatgaagaaggacgagaagatgaacatcagcggcaagaagaacgtggacagcgacagactgggcatgggcttcggcaactgcagaagcgtgatcagccacagcgtgaccagcgacatgcagaccatcgagcaggagagccccatcatggccaagcccagaaagaagtacaacgacgacagcgacgacagctacttcaccagcagcagcagacccaccgccagaagaaagcccgactacgagcccgtggagaacaccgacgaggcccagaagaagttcggcaacgtgaaggccatcagcagcgacatgtacttcggcagacagagccaggccgactacgagaccagagccagactggagagactgagcgccagcagcagcatcagcagcgccgacctgttcgaggagcccagaaagcagcccgcctag

SEQ ID NO: 72185 - DNA, 459 bp, Artificial Sequence
  Description of Artificial Sequence: Synthetic coding sequence
atgggcgaccccagcaagcaggacatcctgaccatcttcaagagactgagaagcgtgcccaccaacaaggtgtgcttcgactgcggcgccaagaaccccagctgggccagcatcacctacggcgtgttcctgtgcatcgactgcagcggcagccacagaagcctgggcgtgcacctgagcttcatcagaagcaccgagctggacagcaactggagctggttccagctgagatgcatgcaggtgggcggcaacgccagcgccgtgagcgacaccgcctgggccagcgccatcgccgagcccagcagcctgaccagcagacccgtggagaccaccctggagaacaacgagggcggccaggagcagggccccagcgtggagggcctgaacgtgcccaccaaggccaccctggaggtgagcagcatcatcaagaagaagcccaaccaggccaagaagggctag

SEQ ID NO: 72186 - DNA, 5550 bp, Artificial Sequence
  Description of Artificial Sequence: Synthetic coding sequence
atgtacgagggcaagaagaccaagaacatgttcctgaccagagccctggagaagatcctggccgacaaggaggtgaagaaggcccaccacagccagctgagaaaggcctgcgaggtggccctggaggagatcaaggccgagaccgagaagcagagccccccccacggcgaggccaaggccggcagcagcaccctgccccccgtgaagagcaagaccaacttcatcgaggccgacaagtacttcctgcccttcgagctggcctgccagagcaagtgccccagaatcgtgagcaccagcctggactgcctgcagaagctgatcgcctacggccacctgaccggcaacgcccccgacagcaccacccccggcaagaagctgatcgacagaatcatcgagaccatctgcggctgcttccagggcccccagaccgacgagggcgtgcagctgcagatcatcaaggccctgctgaccgccgtgaccagccagcacatcgagatccacgagggcaccgtgctgcaggccgtgagaacctgctacaacatctacctggccagcaagaacctgatcaaccagaccaccgccaaggccaccctgacccagatgctgaacgtgatcttcgccagaatggagaaccaggccctgcaggaggccaagcagatggagaaggagagacacagacagcaccaccacctgctgcagagccccgtgagccaccacgagcccgagagcccccagctgagatacctgcccccccagaccgtggaccacatcagccaggagcacgagggcgacctggacctgcacaccaacgacgtggacaagagcctgcaggacgacaccgagcccgagaacggcagcgacatcagcagcgccgagaacgagcagaccgaggccgaccaggccaccgccgccgagaccctgagcaagaacgaggtgctgtacgacggcgagaaccacgactgcgaggagaagccccaggacatcgtgcagaacatcgtggaggagatggtgaacatcgtggtgggcgacatgggcgagggcaccaccatcaacgccagcgccgacggcaacatcggcaccatcgaggacggcagcgacagcgagaacatccaggccaacggcatccccggcacccccatcagcgtggcctacacccccagcctgcccgacgacagactgagcgtgagcagcaacgacacccaggagagcggcaacagcagcggccccagccccggcgccaagttcagccacatcctgcagaaggacgccttcctggtgttcagaagcctgtgcaagctgagcatgaagcccctgagcgacggcccccccgaccccaagagccacgagctgagaagcaagatcctgagcctgcagctgctgctgagcatcctgcagaacgccggccccatcttcagaaccaacgagatgttcatcaacgccatcaagcagtacctgtgcgtggccctgagcaagaacggcgtgagcagcgtgcccgaggtgttcgagctgagcctgagcatcttcctgaccctgctgagcaacttcaagacccacctgaagatgcagatcgaggtgttcttcaaggagatcttcctgtacatcctggagaccagcaccagcagcttcgaccacaagtggatggtgatccagaccctgaccagaatctgcgccgacgcccagagcgtggtggacatctacgtgaactacgactgcgacctgaacgccgccaacatcttcgagagactggtgaacgacctgagcaagatcgcccagggcagaggcagccaggagctgggcatgagcaacgtgcaggagctgagcctgagaaagaagggcctggagtgcctggtgagcatcctgaagtgcatggtggagtggagcaaggaccagtacgtgaaccccaacagccagaccaccctgggccaggagaagcccagcgagcaggagatgagcgagatcaagcaccccgagaccatcaacagatacggcagcctgaacagcctggagagcaccagcagcagcggcatcggcagctacagcacccagatgagcggcaccgacaaccccgagcagttcgaggtgctgaagcagcagaaggagatcatcgagcagggcatcgacctgttcaacaagaagcccaagagaggcatccagtacctgcaggagcagggcatgctgggcaccacccccgaggacatcgcccagttcctgcaccaggaggagagactggacagcacccaggtgggcgagttcctgggcgacaacgacaagttcaacaaggaggtgatgtacgcctacgtggaccagcacgacttcagcggcaaggacttcgtgagcgccctgagaatgttcctggagggcttcagactgcccggcgaggcccagaagatcgacagactgatggagaagttcgccgccagatacctggagtgcaaccagggccagaccctgttcgccagcgccgacaccgcctacgtgctggcctacagcatcatcatgctgaccaccgacctgcacagcccccaggtgaagaacaagatgaccaaggagcagtacatcaagatgaacagaggcatcaacgacagcaaggacctgcccgaggagtacctgagcgccatctacaacgagatcgccggcaagaagatcagcatgaaggagaccaaggagctgaccatccccaccaagagcagcaagcagaacgtggccagcgagaagcagagaagactgctgtacaacctggagatggagcagatggccaagaccgccaaggccctgatggaggccgtgagccacgtgcaggcccccttcaccagcgccacccacctggagcacgtgagacccatgttcaagctggcctggacccccttcctggccgccttcagcgtgggcctgcaggactgcgacgacaccgaggtggccagcctgtgcctggagggcatcagatgcgccatcagaatcgcctgcatcttcagcatccagctggagagagacgcctacgtgcaggccctggccagattcaccctgctgaccgtgagcagcggcatcaccgagatgaagcagaagaacatcgacaccatcaagaccctgatcaccgtggcccacaccgacggcaactacctgggcaacagctggcacgagatcctgaagtgcatcagccagctggagctggcccagctgatcggcaccggcgtgaagcccagatacatcagcggcaccgtgagaggcagagagggcagcctgaccggcaccaaggaccaggcccccgacgagttcgtgggcctgggcctggtgggcggcaacgtggactggaagcagatcgccagcatccaggagagcatcggcgagaccagcagccagagcgtggtggtggccgtggacagaatcttcaccggcagcaccagactggacggcaacgccatcgtggacttcgtgagatggctgtgcgccgtgagcatggacgagctgctgagcaccacccaccccagaatgttcagcctgcagaagatcgtggagatcagctactacaacatgggcagaatcagactgcagtggagcagaatctgggaggtgatcggcgaccacttcaacaaggtgggctgcaaccccaacgaggacgtggccatcttcgccgtggacagcctgagacagctgagcatgaagttcctggagaagggcgagctggccaacttcagattccagaaggacttcctgagacccttcgagcacatcatgaagagaaacagaagccccaccatcagagacatggtggtgagatgcatcgcccagatggtgaacagccaggccgccaacatcagaagcggctggaagaacatcttcagcgtgttccacctggccgccagcgaccaggacgagagcatcgtggagctggccttccagaccaccggccacatcgtgaccctggtgttcgagaagcacttccccgccaccatcgacagcttccaggacgccgtgaagtgcctgagcgagttcgcctgcaacgccgccttccccgacaccagcatggaggccatcagactgatcagacactgcgccaagtacgtgagcgacagaccccaggccttcaaggagtacaccagcgacgacatgaacgtggcccccgaggacagagtgtgggtgagaggctggttccccatcctgttcgagctgagctgcatcatcaacagatgcaagctggacgtgagaaccagaggcctgaccgtgatgttcgagatcatgaagacctacggccacacctacgagaagcactggtggcaggacctgttcagaatcgtgttcagaatcttcgacaacatgaagctgcccgagcagcagaccgagaaggccgagtggatgaccaccacctgcaaccacgccctgtacgccatctgcgacgtgttcacccagtacctggaggtgctgagcgacgtgctgctggacgacatcttcgcccagctgtactggtgcgtgcagcaggacaacgagcagctggccagaagcggcaccaactgcctggagaacgtggtgatcctgaacggcgagaagttcaccctggagatctgggacaagacctgcaactgcaccctggacatcttcaagaccaccatcccccacgccctgctgacctggagacccaacagcggcgagaccgccccccccccccccagccccgtgagcgagaagcccctggacaccatcagccagaagagcgtggacatccacgacagcatccagcccagaagcgtggacaacagaccccaggcccccctggtgagcgccagcgccgtgaacgaggaggtgagcaagatcaagagcaccgccaagttccccgagcagaagctgttcgccgccctgctgatcaagtgcgtggtgcagctggagctgatccagaccatcgacaacatcgtgttcttccccgccaccagcaagaaggaggacgccgagaacctggccgccgcccagagagacgccgtggacttcgacgtgagagtggacacccaggaccagggcatgtacagattcctgaccagccagcagctgttcaagctgctggactgcctgctggagagccacagattcgccaaggccttcaacagcaacaacgagcagagaaccgccctgtggaaggccggcttcaagggcaagagcaagcccaacctgctgaagcaggagaccagcagcctggcctgcggcctgagaatcctgttcagaatgtacatggacgagagcagagtgagcgcctgggaggaggtgcagcagagactgctgaacgtgtgcagcgaggccctgagctacttcctgaccctgaccagcgagagccacagagaggcctggaccaacctgctgctgctgttcctgaccaaggtgctgaagatcagcgacaacagattcaaggcccacgccagcttctactaccccctgctgtgcgagatcatgcagttcgacctgatccccgagctgagagccgtgctgagaagattcttcctgagaatcggcgtggtgttccagatcagccagccccccgagcaggagctgggcatcaacaagcagtag

SEQ ID NO: 72187 - DNA, 5358 bp, Artificial Sequence
  Description of Artificial Sequence: Synthetic coding sequence
atgcaggagagccagaccaagagcatgttcgtgagcagagccctggagaagatcctggccgacaaggaggtgaagagaccccagcacagccagctgagaagagcctgccaggtggccctggacgagatcaaggccgagatcgagaagcagagactgggcaccgccgccccccccaaggccaacttcatcgaggccgacaagtacttcctgcccttcgagctggcctgccagagcaagagccccagagtggtgagcaccagcctggactgcctgcagaagctgatcgcctacggccacatcaccggcaacgcccccgacagcggcgcccccggcaagagactgatcgacagaatcgtggagaccatctgcagctgcttccagggcccccagaccgacgagggcgtgcagctgcagatcatcaaggccctgctgaccgccgtgaccagcccccacatcgagatccacgagggcaccatcctgcagaccgtgagaacctgctacaacatctacctggccagcaagaacctgatcaaccagaccaccgccaaggccaccctgacccagatgctgaacgtgatcttcaccagaatggagaaccaggtgctgcaggaggccagagagctggagaagcccatccagagcaagccccagagccccgtgatccaggccgccgccgtgagccccaagttcgtgagactgaagcacagccaggcccagagcaagcccaccacccccgagaagaccgacctgaccaacggcgagcacgccagaagcgacagcggcaaggtgagcaccgagaacggcgacgcccccagagagagaggcagcagcctgagcggcaccgacgacggcgcccaggaggtggtgaaggacatcctggaggacgtggtgaccagcgccatcaaggaggccgccgagaagcacggcctgaccgagcccgagagagtgctgggcgagctggagtgccaggagtgcgccatcccccccggcgtggacgagaacagccagaccaacggcatcgccgacgacagacagagcctgagcagcgccgacaacctggagagcgacgcccagggccaccaggtggccgccagattcagccacgtgctgcagaaggacgccttcctggtgttcagaagcctgtgcaagctgagcatgaagcccctgggcgagggcccccccgaccccaagagccacgagctgagaagcaaggtggtgagcctgcagctgctgctgagcgtgctgcagaacgccggccccgtgttcagaacccacgagatgttcatcaacgccatcaagcagtacctgtgcgtggccctgagcaagaacggcgtgagcagcgtgcccgacgtgttcgagctgagcctggccatcttcctgaccctgctgagcaacttcaagatgcacctgaagatgcagatcgaggtgttcttcaaggagatcttcctgaacatcctggagaccagcaccagcagcttcgagcacagatggatggtgatccagaccctgaccagaatctgcgccgacgcccagtgcgtggtggacatctacgtgaactacgactgcgacctgaacgccgccaacatcttcgagagactggtgaacgacctgagcaagatcgcccagggcagaagcggccacgagctgggcatgacccccctgcaggagctgagcctgagaaagaagggcctggagtgcctggtgagcatcctgaagtgcatggtggagtggagcaaggacctgtacgtgaaccccaaccaccagaccagcctgggccaggagagactgaccgaccaggagatcggcgacggcaagggcctggacatggccagaagatgcagcgtgaccagcatggagagcaccgtgagcagcggcacccagaccaccgtgcaggacgaccccgagcagttcgaggtgatcaagcagcagaaggagatcatcgagcacggcatcgagctgttcaacaagaagcccaagagaggcatccagttcctgcaggagcagggcatgctgggcaccagcgtggaggacatcgcccagttcctgcaccaggaggagagactggacagcacccaggtgggcgacttcctgggcgacagcgccagattcaacaaggaggtgatgtacgcctacgtggaccagctggacttctgcgagaaggagttcgtgagcgccctgagaaccttcctggagggcttcagactgcccggcgaggcccagaagatcgacagactgatggagaagttcgccgccagatacatcgagtgcaaccagggccagaccctgttcgccagcgccgacaccgcctacgtgctggcctacagcatcatcatgctgaccaccgacctgcacagcccccaggtgaagaacaagatgaccaaggagcagtacatcaagatgaacagaggcatcaacgacagcaaggacctgcccgaggagtacctgagcagcatctacgaggagatcgagggcaagaagatcgccatgaaggagaccaaggagctgaccatcgccaccaagagcaccaagcagaacgtggccagcgagaagcagagaagactgctgtacaacctggagatggagcagatggccaagaccgccaaggccctgatggaggccgtgagccacgccaaggcccccttcaccagcgccacccacctggaccacgtgagacccatgttcaagctggtgtggacccccctgctggccgcctacagcatcggcctgcagaactgcgacgacaccgaggtggccagcctgtgcctggagggcatcagatgcgccatcagaatcgcctgcatcttcggcatgcagctggagagagacgcctacgtgcaggccctggccagattcagcctgctgaccgccagcagcagcatcaccgagatgaagcagaagaacatcgacaccatcaagaccctgatcaccgtggcccacaccgacggcaactacctgggcaacagctggcacgagatcctgaagtgcatcagccagctggagctggcccagctgatcggcaccggcgtgaagaccagatacctgagcggcagcggcagagagagagagggcagcctgaagggccacaccctggccggcgaggagttcatgggcctgggcctgggcaacctggtgagcggcggcgtggacaagagacagatggccagcttccaggagagcgtgggcgagaccagcagccagagcgtggtggtggccgtggacagaatcttcaccggcagcaccagactggacggcaacgccatcgtggacttcgtgagatggctgtgcgccgtgagcatggacgagctggccagcccccaccaccccagaatgttcagcctgcagaagatcgtggagatcagctactacaacatgaacagaatcagactgcagtggagcagaatctggcacgtgatcggcgaccacttcaacaaggtgggctgcaaccccaacgaggacgtggccatcttcgccgtggacagcctgagacagctgagcatgaagttcctggagaagggcgagctggccaacttcagattccagaaggacttcctgagacccttcgagcacatcatgaagaagaacagaagccccaccatcagagacatggccatcagatgcatcgcccagatggtgaacagccaggccgccaacatcagaagcggctggaagaacatcttcgccgtgttccaccaggccgccagcgaccacgacggcaacatcgtggagctggccttccagaccacctgccacatcgtgaccaccatcttccagcaccacttccccgccgccatcgacagcttccaggacgccgtgaagtgcctgagcgagttcgcctgcaacgccgccttccccgacaccagcatggaggccatcagactgatcagattctgcggcaagtacgtgagcgagagacccagagtgctgcaggagtacaccagcgacgacatgaacgtggcccccggcgacagagtgtgggtgagaggctggttccccatcctgttcgagctgagctgcatcatcaacagatgcaagctggacgtgagaaccagaggcctgaccgtgatgttcgagatcatgaagagctacggccacaccttcgagaagcactggtggcaggacctgttcagaatcgtgttcagaatcttcgacaacatgaagctgcccgagcagctgagcgagaagagcgagtggatgaccaccacctgcaaccacgccctgtacgccatctgcgacgtgttcacccagttctacgaggccctgaacgaggtgctgctgagcgacgtgttcgcccagctgcagtggtgcgtgaagcaggacaacgagcagctggccagaagcggcaccaactgcctggagaacctggtgatcagcaacggcgagaagttcagccccgaggtgtgggacgagacctgcaactgcatgctggacatcttcaagaccaccatcccccacgtgctgctgacctggagacccgtgggcatggaggaggacagcagcgagaagcacctggacgtggacctggacagacagagcctgagcagcatcgacaagaaccccagcgagagaggccagagccagctgagcaaccccaccgacgacagctggaagggcagaccctacgccaaccagaagctgttcgccagcctgctgatcaagtgcgtggtgcagctggagctgatccagaccatcgacaacatcgtgttctaccccgccaccagcaagaaggaggacgccgagcacatggtggccgcccagcaggacaccctggacgccgacatccacatcgagaccgaggaccagggcatgtacaagtacatgagcagccagcacctgttcaagctgctggactgcctgcaggagagccacagcttcagcaaggccttcaacagcaactacgagcagagaaccgtgctgtggagagccggcttcaagggcaagagcaagcccaacctgctgaagcaggagaccagcagcctggcctgctgcctgagaatcctgttcagaatgtacgtggacgagaacagaagagacagctgggaggagatccagcagagactgctgaccgtgtgcagcgaggccctggcctacttcatcaccgtgaacagcgagagccacagagaggcctggaccagcctgctgctgctgctgctgaccaagaccctgaagatcaacgacgagaagttcaaggcccacgccagcatgtactacccctacctgtgcgagatcatgcagttcgacctgatccccgagctgagagccgtgctgagaaagttcttcctgagaatcggcgtggtgtacaagatctggatccccgaggagcccagccaggtgcccgccgccctgagccccgtgtggtag

SEQ ID NO: 72188 - DNA, 2499 bp, Artificial Sequence
  Description of Artificial Sequence: Synthetic coding sequence
atgcaggagagccagaccaagagcatgttcgtgagcagagccctggagaagatcctggccgacaaggaggtgaagagaccccagcacagccagctgagaagagcctgccaggtggccctggacgagatcaaggccgagatcgagaagcagagactgggcaccgccgccccccccaaggccaacttcatcgaggccgacaagtacttcctgcccttcgagctggcctgccagagcaagagccccagagtggtgagcaccagcctggactgcctgcagaagctgatcgcctacggccacatcaccggcaacgcccccgacagcggcgcccccggcaagagactgatcgacagaatcgtggagaccatctgcagctgcttccagggcccccagaccgacgagggcgtgcagctgcagatcatcaaggccctgctgaccgccgtgaccagcccccacatcgagatccacgagggcaccatcctgcagaccgtgagaacctgctacaacatctacctggccagcaagaacctgatcaaccagaccaccgccaaggccaccctgacccagatgctgaacgtgatcttcaccagaatggagaaccaggtgctgcaggaggccagagagctggagaagcccatccagagcaagccccagagccccgtgatccaggccgccgccgtgagccccaagttcgtgagactgaagcacagccaggcccagagcaagcccaccacccccgagaagaccgacctgaccaacggcgagcacgccagaagcgacagcggcaaggtgagcaccgagaacggcgacgcccccagagagagaggcagcagcctgagcggcaccgacgacggcgcccaggaggtggtgaaggacatcctggaggacgtggtgaccagcgccatcaaggaggccgccgagaagcacggcctgaccgagcccgagagagtgctgggcgagctggagtgccaggagtgcgccatcccccccggcgtggacgagaacagccagaccaacggcatcgccgacgacagacagagcctgagcagcgccgacaacctggagagcgacgcccagggccaccaggtggccgccagattcagccacgtgctgcagaaggacgccttcctggtgttcagaagcctgtgcaagctgagcatgaagcccctgggcgagggcccccccgaccccaagagccacgagctgagaagcaaggtggtgagcctgcagctgctgctgagcgtgctgcagaacgccggccccgtgttcagaacccacgagatgttcatcaacgccatcaagcagtacctgtgcgtggccctgagcaagaacggcgtgagcagcgtgcccgacgtgttcgagctgagcctggccatcttcctgaccctgctgagcaacttcaagatgcacctgaagatgcagatcgaggtgttcttcaaggagatcttcctgaacatcctggagaccagcaccagcagcttcgagcacagatggatggtgatccagaccctgaccagaatctgcgccgacgcccagtgcgtggtggacatctacgtgaactacgactgcgacctgaacgccgccaacatcttcgagagactggtgaacgacctgagcaagatcgcccagggcagaagcggccacgagctgggcatgacccccctgcaggagctgagcctgagaaagaagggcctggagtgcctggtgagcatcctgaagtgcatggtggagtggagcaaggacctgtacgtgaaccccaaccaccagaccagcctgggccaggagagactgaccgaccaggagatcggcgacggcaagggcctggacatggccagaagatgcagcgtgaccagcatggagagcaccgtgagcagcggcacccagaccaccgtgcaggacgaccccgagcagttcgaggtgatcaagcagcagaaggagatcatcgagcacggcatcgagctgttcaacaagaagcccaagagaggcatccagttcctgcaggagcagggcatgctgggcaccagcgtggaggacatcgcccagttcctgcaccaggaggagagactggacagcacccaggtgggcgacttcctgggcgacagcgccagattcaacaaggaggtgatgtacgcctacgtggaccagctggacttctgcgagaaggagttcgtgagcgccctgagaaccttcctggagggcttcagactgcccggcgaggcccagaagatcgacagactgatggagaagttcgccgccagatacatcgagtgcaaccagggccagaccctgttcgccagcgccgacaccgcctacgtgctggcctacagcatcatcatgctgaccaccgacctgcacagcccccaggtgaagaacaagatgaccaaggagcagtacatcaagatgaacagaggcatcaacgacagcaaggacctgcccgaggagtacctgagcagcatctacgaggagatcgagggcaagaagatcgccatcaagaagaactag

SEQ ID NO: 72189 - DNA, 591 bp, Artificial Sequence
  Description of Artificial Sequence: Synthetic coding sequence
atgggcagcgtgaacagcagaggccacaaggccgaggcccaggtggtgatgatgggcctggacagcgccggcaagaccaccctgctgtacaagctgaagggccaccagctggtggagaccctgcccaccgtgggcttcaacgtggagcccctgaaggcccccggccacgtgagcctgaccctgtgggacgtgggcggccaggcccccctgagagccagctggaaggactacctggagggcaccgacatcctggtgtacgtgctggacagcaccgacgaggccagactgcccgagagcgccgccgagctgaccgaggtgctgaacgaccccaacatggccggcgtgcccttcctggtgctggccaacaagcaggaggcccccgacgccctgcccctgctgaagatcagaaacagactgagcctggagagattccaggaccactgctgggagctgagaggctgcagcgccctgaccggcgagggcctgcccgaggccctgcagagcctgtggagcctgctgaagagcagaagctgcatgtgcctgcaggccagagcccacggcgccgagagaggcgacagcaagagaagctag

SEQ ID NO: 72190 - DNA, 966 bp, Artificial Sequence
  Description of Artificial Sequence: Synthetic coding sequence
atgttcagcctgatggccagctgctgcggctggttcaagagatggagagagcccgtgagactggccaacaagcaggacaaggagggcgccctgggcgaggccgacgtgatcgagtgcctgagcctggagaagctggtgaacgagcacaagtgcctgtgccagatcgagccctgcagcgccatcagcggctacggcaagaagatcgacaagagcatcaagaagggcctgtactggctgctgcacgtgatcgccagagacttcgacgccctgaacgagagaatccagaaggagaccaccgagcagagagccctggaggagcaggagaagcaggagagagccgagagagtgagaaagctgagagaggagagaaagcagaacgagcaggagcaggccgagctggacggcaccagcggcctggccgagctggaccccgagcccaccaaccccttccagcccatcgccagcgtgatcatcgagaacgagggcaagctggagagagagaagaagaaccagaagatggagaaggacagcgacggctgccacctgaagcacaagatggagcacgagcagatcgagacccagggccaggtgaaccacaacggccagaagaacaacgagttcggcctggtggagaactacaaggaggccctgacccagcagctgaagaacgaggacgagaccgacagacccagcctggagagcgccaacggcaagaagaagaccaagaagctgagaatgaagagaaaccacagagtggagcccctgaacatcgacgactgcgcccccgagagccccacccccccccccccccccccccccgtgggctggggcacccccaaggtgaccagactgcccaagctggagcccctgggcgagacccaccacaacgacttctacagaaagcccctgccccccctggccgtgccccagagacccaacagcgacgcccacgacgtgatcagctag

SEQ ID NO: 72191 - DNA, 1287 bp, Artificial Sequence
  Description of Artificial Sequence: Synthetic coding sequence
atgttcagcctgatggccagctgctgcggctggttcaagagatggagagagcccgtgagaaaggtgaccctgctgatggtgggcctggacaacgccggcaagaccgccaccgccaagggcatccagggcgagtaccccgaggacgtggcccccaccgtgggcttcagcaagatcaacctgagacagggcaagttcgaggtgaccatcttcgacctgggcggcggcatcagaatcagaggcatctggaagaactactacgccgagagctacggcgtgatcttcgtggtggacagcagcgacgaggagagaatggaggagaccaaggaggccatgagcgagatgctgagacaccccagaatcagcggcaagcccatcctggtgctggccaacaagcaggacaaggagggcgccctgggcgaggccgacgtgatcgagtgcctgagcctggagaagctggtgaacgagcacaagtgcctgtgccagatcgagccctgcagcgccatcagcggctacggcaagaagatcgacaagagcatcaagaagggcctgtactggctgctgcacgtgatcgccagagacttcgacgccctgaacgagagaatccagaaggagaccaccgagcagagagccctggaggagcaggagaagcaggagagagccgagagagtgagaaagctgagagaggagagaaagcagaacgagcaggagcaggccgagctggacggcaccagcggcctggccgagctggaccccgagcccaccaaccccttccagcccatcgccagcgtgatcatcgagaacgagggcaagctggagagagagaagaagaaccagaagatggagaaggacagcgacggctgccacctgaagcacaagatggagcacgagcagatcgagacccagggccaggtgaaccacaacggccagaagaacaacgagttcggcctggtggagaactacaaggaggccctgacccagcagctgaagaacgaggacgagaccgacagacccagcctggagagcgccaacggcaagaagaagaccaagaagctgagaatgaagagaaaccacagagtggagcccctgaacatcgacgactgcgcccccgagagccccacccccccccccccccccccccccgtgggctggggcacccccaaggtgaccagactgcccaagctggagcccctgggcgagacccaccacaacgacttctacagaaagcccctgccccccctggccgtgccccagagacccaacagcgacgcccacgacgtgatcagctag

SEQ ID NO: 72192 - DNA, 1287 bp, Artificial Sequence; identical to SEQ ID NO: 72191
  Description of Artificial Sequence: Synthetic coding sequence

SEQ ID NO: 72193 - DNA, 978 bp, Artificial Sequence
  Description of Artificial Sequence: Synthetic coding sequence
atggaggagaccaaggaggccatgagcgagatgctgagacaccccagaatcagcggcaagcccatcctggtgctggccaacaagcaggacaaggagggcgccctgggcgaggccgacgtgatcgagtgcctgagcctggagaagctggtgaacgagcacaagtgcctgtgccagatcgagccctgcagcgccatcagcggctacggcaagaagatcgacaagagcatcaagaagggcctgtactggctgctgcacgtgatcgccagagacttcgacgccctgaacgagagaatccagaaggagaccaccgagcagagagccctggaggagcaggagaagcaggagagagccgagagagtgagaaagctgagagaggagagaaagcagaacgagcaggagcaggccgagctggacggcaccagcggcctggccgagctggaccccgagcccaccaaccccttccagcccatcgccagcgtgatcatcgagaacgagggcaagctggagagagagaagaagaaccagaagatggagaaggacagcgacggctgccacctgaagcacaagatggagcacgagcagatcgagacccagggccaggtgaaccacaacggccagaagaacaacgagttcggcctggtggagaactacaaggaggccctgacccagcagctgaagaacgaggacgagaccgacagacccagcctggagagcgccaacggcaagaagaagaccaagaagctgagaatgaagagaaaccacagagtggagcccctgaacatcgacgactgcgcccccgagagccccacccccccccccccccccccccccgtgggctggggcacccccaaggtgaccagactgcccaagctggagcccctgggcgagacccaccacaacgacttctacagaaagcccctgccccccctggccgtgccccagagacccaacagcgacgcccacgacgtgatcagctag

SEQ ID NO: 72194 - DNA, 450 bp, Artificial Sequence
  Description of Artificial Sequence: Synthetic coding sequence
atggagaaggacagcgacggctgccacctgaagcacaagatggagcacgagcagatcgagacccagggccaggtgaaccacaacggccagaagaacaacgagttcggcctggtggagaactacaaggaggccctgacccagcagctgaagaacgaggacgagaccgacagacccagcctggagagcgccaacggcaagaagaagaccaagaagctgagaatgaagagaaaccacagagtggagcccctgaacatcgacgactgcgcccccgagagccccacccccccccccccccccccccccgtgggctggggcacccccaaggtgaccagactgcccaagctggagcccctgggcgagacccaccacaacgacttctacagaaagcccctgccccccctggccgtgccccagagacccaacagcgacgcccacgacgtgatcagctag

SEQ ID NO: 72195 - DNA, 579 bp, Artificial Sequence
  Description of Artificial Sequence: Synthetic coding sequence
atgggcagcctgggcagcaagaacccccagaccaagcaggcccaggtgctgctgctgggcctggacagcgccggcaagagcaccctgctgtacaagctgaagctggccaaggacatcaccaccatccccaccatcggcttcaacgtggagatgatcgagctggagagaaacctgagcctgaccgtgtgggacgtgggcggccaggagaagatgagaaccgtgtggggctgctactgcgagaacaccgacggcctggtgtacgtggtggacagcaccgacaagcagagactggaggagagccagagacagttcgagcacatcctgaagaacgagcacatcaagaacgtgcccgtggtgctgctggccaacaagcaggacatgcccggcgccctgaccgccgaggacatcaccagaatgttcaaggtgaagaagctgtgcagcgacagaaactggtacgtgcagccctgctgcgccctgaccggcgagggcctggcccagggcttcagaaagctgaccggcttcgtgaagagccacatgaagagcagaggcgacaccctggccttcttcaagcagaactag

SEQ ID NO: 72196 - DNA, 555 bp, Artificial Sequence
  Description of Artificial Sequence: Synthetic coding sequence
atgggcctgctgaccatcctgaagaagatgaagcagaaggagagagagctgagactgctgatgctgggcctggacaacgccggcaagaccaccatcctgaagaagttcaacggcgaggacatcgacaccatcagccccaccctgggcttcaacatcaagaccctggagcacagaggcttcaagctgaacatctgggacgtgggcggccagaagagcctgagaagctactggagaaactacttcgagagcaccgacggcctgatctgggtggtggacagcgccgacagacagagaatgcaggactgccagagagagctgcagagcctgctggtggaggagagactggccggcgccaccctgctgatcttcgccaacaagcaggacctgcccggcgccctgagcagcaacgccatcagagaggtgctggagctggacagcatcagaagccaccactggtgcatccagggctgcagcgccgtgaccggcgagaacctgctgcccggcatcgactggctgctggacgacatcagcagcagaatcttcaccgccgactag

SEQ ID NO: 72197 - DNA, 555 bp, Artificial Sequence; identical to SEQ ID NO: 72196
  Description of Artificial Sequence: Synthetic coding sequence

SEQ ID NO: 72198 - DNA, 474 bp, Artificial Sequence
  Description of Artificial Sequence: Synthetic coding sequence
atgggcctgctgaccatcctgaagaagatgaagcagaaggagagagagctgagactgctgatgctgggcctggacaacgccggcaagaccaccatcctgaagaagttcaacggcgaggacatcgacaccatcagccccaccctgggcttcaacatcaagaccctggagcacagaggcttcaagctgaacatctgggacgtgggcggccagaagagcctgagaagctactggagaaactacttcgagagcaccgacggcctgatctgggtggtggacagcgccgacagacagagaatgcaggactgccagagagagctgcagagcctgctggtggaggaggtgctggagctggacagcatcagaagccaccactggtgcatccagggctgcagcgccgtgaccggcgagaacctgctgcccggcatcgactggctgctggacgacatcagcagcagaatcttcaccgccgactag

SEQ ID NO: 72199 - DNA, 549 bp, Artificial Sequence
  Description of Artificial Sequence: Synthetic coding sequence
atgggcctgctgagcatcctgagaaagctgaagagcgcccccgaccaggaggtgagaatcctgctgctgggcctggacaacgccggcaagaccaccctgctgaagcagctggccagcgaggacatcagccacatcacccccacccagggcttcaacatcaagagcgtgcagagccagggcttcaagctgaacgtgtgggacatcggcggccagagaaagatcagaccctactggaagaactacttcgagaacaccgacatcctgatctacgtgatcgacagcgccgacagaaagagattcgaggagaccggccaggagctggccgagctgctggaggaggagaagctgagctgcgtgcccgtgctgatcttcgccaacaagcaggacctgctgaccgccgcccccgccagcgagatcgccgagggcctgaacctgcacaccatcagagacagagtgtggcagatccagagctgcagcgccctgaccggcgagggcgtgcaggacggcatgaactgggtgtgcaagaacgtgaacgccaagaagaagtag

SEQ ID NO: 72200 - DNA, 606 bp, Artificial Sequence
  Description of Artificial Sequence: Synthetic coding sequence
atgggcaaccacctgaccgagatggcccccaccgccagcagcttcctgccccacttccaggccctgcacgtggtggtgatcggcctggacagcgccggcaagaccagcctgctgtacagactgaagttcaaggagttcgtgcagagcgtgcccaccaagggcttcaacaccgagaagatcagagtgcccctgggcggcagcagaggcatcaccttccaggtgtgggacgtgggcggccaggagaagctgagacccctgtggagaagctacaccagaagaaccgacggcctggtgttcgtggtggacgccgccgaggccgagagactggaggaggccaaggtggagctgcacagaatcagcagagccagcgacaaccagggcgtgcccgtgctggtgctggccaacaagcaggaccagcccggcgccctgagcgccgccgaggtggagaagagactggccgtgagagagctggccgccgccaccctgacccacgtgcagggctgcagcgccgtggacggcctgggcctgcagcagggcctggagagactgtacgagatgatcctgaagagaaagaaggccgccagaggcggcaagaagagaagatag

SEQ ID NO: 72201 - DNA, 561 bp, Artificial Sequence
  Description of Artificial Sequence: Synthetic coding sequence
atgggcctgctggacagactgagcgtgctgctgggcctgaagaagaaggaggtgcacgtgctgtgcctgggcctggacaacagcggcaagaccaccatcatcaacaagctgaagcccagcaacgcccagagccagaacatcctgcccaccatcggcttcagcatcgagaagttcaagagcagcagcctgagcttcaccgtgttcgacatgagcggccagggcagatacagaaacctgtgggagcactactacaaggagggccaggccatcatcttcgtgatcgacagcagcgacagactgagaatggtggtggccaaggaggagctggacaccctgctgaaccaccccgacatcaagcacagaagaatccccatcctgttcttcgccaacaagatggacctgagagacgccgtgaccagcgtgaaggtgagccagctgctgtgcctggagaacatcaaggacaagccctggcacatctgcgccagcgacgccatcaagggcgagggcctgcaggagggcgtggactggctgcaggaccagatccagaccgtgaagacctag

SEQ ID NO: 72202 - DNA, 561 bp, Artificial Sequence; identical to SEQ ID NO: 72201
  Description of Artificial Sequence: Synthetic coding sequence

SEQ ID NO: 72203 - DNA, 366 bp, Artificial Sequence
  Description of Artificial Sequence: Synthetic coding sequence
atgggcctgctggacagactgagcgtgctgctgggcctgaagaagaaggaggtgcacgtgctgtgcctgggcctggacaacagcggcaagaccaccatcatcaacaagctgaagcccagcaacgcccagagccagaacatcctgcccaccatcggcttcagcatcgagaagttcaagagcagcagcctgagcttcaccgtgttcgacatgagcggccagggcagatacagaaacctgtgggagcactactacaaggagggccaggccatcatcttcgtgatcgacagcagcgacagactgagaatggtggtggccaaggaggagctggacaccctgctgaaccaccccgacatcaagcacagatag

SEQ ID NO: 72204 - DNA, 561 bp, Artificial Sequence; identical to SEQ ID NO: 72201
  Description of Artificial Sequence: Synthetic coding sequence

SEQ ID NO: 72205 - DNA, 561 bp, Artificial Sequence; identical to SEQ ID NO: 72201
  Description of Artificial Sequence: Synthetic coding sequence

SEQ ID NO: 72206 - DNA, 564 bp, Artificial Sequence
  Description of Artificial Sequence: Synthetic coding sequence
ctgagacccacctggaaggccctgagccaccccgcctggcccgaggagaagaacaagcagatcctggtgctgggcctggacggcgccggcaagaccagcgtgctgcacagcctggccagcaacagagtgcagcacagcgtggcccccacccagggcttccacgccgtgtgcatcaacaccgaggacagccagatggagttcctggagatcggcggcagcaagcccttcagaagctactgggagatgtacctgagcaagggcctgctgctgatcttcgtggtggacagcgccgaccacagcagactgcccgaggccaagaagtacctgcaccagctgatcgccgccaaccccgtgctgcccctggtggtgttcgccaacaagcaggacctggaggccgcctaccacatcaccgacatccacgaggccctggccctgagcgaggtgggcaacgacagaaagatgttcctgttcggcacctacctgaccaagaacggcagcgagatccccagcaccatgcaggacgccaaggacctgatcgcccagctggccgccgacgtgcagtag

SEQ ID NO: 72207 - DNA, 1083 bp, Artificial Sequence
  Description of Artificial Sequence: Synthetic coding sequence
atggagagagccggccccgccggcgaggagggcggcgccagagagggcagactgctgcccagagcccccggcgcctgggtgctgagagcctgcgccgagagagccgccctggaggtgggcgccgccagcgccgacaccggcgtgagaggctgcggcgccagaggccccgcccccctgctggccagcgccggcggcggcagagccagagacggcacctggggcgtgagaaccaagggcagcggcgccgccctgcccagcagacccgccagcagagccgcccccagacccgaggccagcagcccccccctgcccctggagaaggccagaggcggcctgagcggcccccagggcggcagagccagaggcgccatggcccacgtgggcagcagaaagagaagcagaagcagaagcagaagcagaggcagaggcagcgagaagagaaagaagaagagcagaaaggacaccagcagaaactgcagcgccagcaccagccagggcagaaaggccagcaccgcccccggcgccgaggccagccccagcccctgcatcaccgagagaagcaagcagaaggccagaagaagaaccagaagcagcagcagcagcagcagcagcagcagcagcagcagcagcagcagcagcagcagcagcagcagcagcagcagcgacggcagaaagaagagaggcaagtacaaggacaagagaagaaagaagaagaagaagagaaagaagctgaagaagaagggcaaggagaaggccgaggcccagcaggtggaggccctgcccggccccagcctggaccagtggcacagaagcgccggcgaggaggaggacggccccgtgctgaccgacgagcagaagagcagaatccaggccatgaagcccatgaccaaggaggagtgggacgccagacagagcatcatcagaaaggtggtggaccccgagaccggcagaaccagactgatcaagggcgacggcgaggtgctggaggagatcgtgaccaaggagagacacagagagatcaacaagcaggccaccagaggcgactgcctggccttccagatgagagccggcctgctgccctag

SEQ ID NO: 72208 - DNA, 1017 bp, Artificial Sequence
  Description of Artificial Sequence: Synthetic coding sequence
atggagagagccggccccgccggcgaggagggcggcgccagagagggcagactgctgcccagagcccccggcgcctgggtgctgagagcctgcgccgagagagccgccctggaggtgggcgccgccagcgccgacaccggcgtgagaggctgcggcgccagaggccccgcccccctgctggccagcgccggcggcggcagagccagagacggcacctggggcgtgagaaccaagggcagcggcgccgccctgcccagcagacccgccagcagagccgcccccagacccgaggccagcagcccccccctgcccctggagaaggccagaggcggcctgagcggcccccagggcggcagagccagaggcgccatggcccacgtgggcagcagaaagagaagcagaagcagaagcagaagcagaggcagaggcagcgagaagagaaagaagaagagcagaaaggacaccagcagaaactgcagcgccagcaccagccaggagagaagcaagcagaaggccagaagaagaaccagaagcagcagcagcagcagcagcagcagcagcagcagcagcagcagcagcagcagcagcagcagcagcagcagcagcgacggcagaaagaagagaggcaagtacaaggacaagagaagaaagaagaagaagaagagaaagaagctgaagaagaagggcaaggagaaggccgaggcccagcaggtggaggccctgcccggccccagcctggaccagtggcacagaagcgccggcgaggaggaggacggccccgtgctgaccgacgagcagaagagcagaatccaggccatgaagcccatgaccaaggaggagtgggacgccagacagagcatcatcagaaaggtggtggaccccgagaccggcagaaccagactgatcaagggcgacggcgaggtgctggaggagatcgtgaccaaggagagacacagagagatcaacaaggtgggcgtggcccccctgcccgccatcagaccccagctgtgcctgtag

SEQ ID NO: 72209 - DNA, 1059 bp, Artificial Sequence
  Description of Artificial Sequence: Synthetic coding sequence
atggagagagccggccccgccggcgaggagggcggcgccagagagggcagactgctgcccagagcccccggcgcctgggtgctgagagcctgcgccgagagagccgccctggaggtgggcgccgccagcgccgacaccggcgtgagaggctgcggcgccagaggccccgcccccctgctggccagcgccggcggcggcagagccagagacggcacctggggcgtgagaaccaagggcagcggcgccgccctgcccagcagacccgccagcagagccgcccccagacccgaggccagcagcccccccctgcccctggagaaggccagaggcggcctgagcggcccccagggcggcagagccagaggcgccatggcccacgtgggcagcagaaagagaagcagaagcagaagcagaagcagaggcagaggcagcgagaagagaaagaagaagagcagaaaggacaccagcagaaactgcagcgccagcaccagccagggcagaaaggccagcaccgcccccggcgccgaggagagaagcaagcagaaggccagaagaagaaccagaagcagcagcagcagcagcagcagcagcagcagcagcagcagcagcagcagcagcagcagcagcagcagcagcagcgacggcagaaagaagagaggcaagtacaaggacaagagaagaaagaagaagaagaagagaaagaagctgaagaagaagggcaaggagaaggccgaggcccagcaggtggaggccctgcccggccccagcctggaccagtggcacagaagcgccggcgaggaggaggacggccccgtgctgaccgacgagcagaagagcagaatccaggccatgaagcccatgaccaaggaggagtgggacgccagacagagcatcatcagaaaggtggtggaccccgagaccggcagaaccagactgatcaagggcgacggcgaggtgctggaggagatcgtgaccaaggagagacacagagagatcaacaagcaggccaccagaggcgactgcctggccttccagatgagagccggcctgctgccctag

SEQ ID NO: 72210 - DNA, 1026 bp, Artificial Sequence
  Description of Artificial Sequence: Synthetic coding sequence
atggagagagccggccccgccggcgaggagggcggcgccagagagggcagactgctgcccagagcccccggcgcctgggtgctgagagcctgcgccgagagagccgccctggaggtgggcgccgccagcgccgacaccggcgtgagaggctgcggcgccagaggccccgcccccctgctggccagcgccggcggcggcagagccagagacggcacctggggcgtgagaaccaagggcagcggcgccgccctgcccagcagacccgccagcagagccgcccccagacccgaggccagcagcccccccctgcccctggagaaggccagaggcggcctgagcggcccccagggcggcagagccagaggcgccatggcccacgtgggcagcagaaagagaagcagaagcagaagcagaagcagaggcagaggcagcgagaagagaaagaagaagagcagaaaggacaccagcagaaactgcagcgccagcaccagccaggagagaagcaagcagaaggccagaagaagaaccagaagcagcagcagcagcagcagcagcagcagcagcagcagcagcagcagcagcagcagcagcagcagcagcagcagcgacggcagaaagaagagaggcaagtacaaggacaagagaagaaagaagaagaagaagagaaagaagctgaagaagaagggcaaggagaaggccgaggcccagcaggtggaggccctgcccggccccagcctggaccagtggcacagaagcgccggcgaggaggaggacggccccgtgctgaccgacgagcagaagagcagaatccaggccatgaagcccatgaccaaggaggagtgggacgccagacagagcatcatcagaaaggtggtggaccccgagaccggcagaaccagactgatcaagggcgacggcgaggtgctggaggagatcgtgaccaaggagagacacagagagatcaacaagcaggccaccagaggcgactgcctggccttccagatgagagccggcctgctgccctag

SEQ ID NO: 72211 - DNA, 567 bp, Artificial Sequence
  Description of Artificial Sequence: Synthetic coding sequence
atggacgtgaacatcgcccccctgagagcctgggacgacttcttccccggcagcgacagattcgccagacccgacttcagagacatcagcaagtggaacaacagagtggtgagcaacctgctgtactaccagaccaactacctggtggtggccgccatgatgatcagcatcgtgggcttcctgagccccttcaacatgatcctgggcggcatcgtggtggtgctggtgttcaccggcttcgtgtgggccgcccacaacaaggacgtgctgagaagaatgaagaagagataccccaccaccttcgtgatggtggtgatgctggccagctacttcctgatcagcatgttcggcggcgtgatggtgttcgtgttcggcatcaccttccccctgctgctgatgttcatccacgccagcctgagactgagaaacctgaagaacaagctggagaacaagatggagggcatcggcctgaagagaacccccatgggcatcgtgctggacgccctggagcagcaggaggagggcatcaacagactgaccgactacatcagcaaggtgaaggagtag

SEQ ID NO: 72212 - DNA, 411 bp, Artificial Sequence
  Description of Artificial Sequence: Synthetic coding sequence
atggacgtgaacatcgcccccctgagagcctgggacgacttcttccccggcagcgacagattcgccagacccgacttcagagacatcagcaagtggaacaacagagtggtgagcaacctgctgtactaccagaccaactacctggtggtggccgccatgatgatcagcatcgtgggcttcctgagccccttcaacatgatcctgggcggcatcgtggtggtgctggtgttcaccggcttcgtgtgggccgcccacgacgtgagatacggcggccacgtgggcgagctgttcccctacctgcacgtgtggagaagccacggcctgtgcgtgtggcactacttcagcttcgccgtggacgtgtacccctgcatcgtggagaccagcgagccccaggagcagaccggcgagtag

SEQ ID NO: 72213 - DNA, 819 bp, Artificial Sequence
  Description of Artificial Sequence: Synthetic coding sequence
atggtgagatgctacgtggagatcgtggagaagctgcccgagagaagacccgaccccgccaccatcgagggctgcgcccagctgaagcccaacaactacctgctggcctggcacacccccttcaacgagaagggcagcggcttcggcgccgccaccaaggccatgtgcatcggcctgagatactggaagcccgagagactggagaccctgatcgaggtgagcgtggagtgcggcagaatgacccacaaccaccccaccggcttcctgggcagcctgtgcaccgccctgttcgtgagcttcgccgcccagggcaagcccctggtgcagtggggcagagacatgctgagagccgtgcccctggccgaggagtactgcagaaagaccatcagacacaccgccgagtaccaggagcactggttctacttcgaggccaagtggcagttctacctggaggagagaaagatcagcaaggacagcgagaacaaggccatcttccccgacaactacgacgccgaggagagagagaagacctacagaaagtggagcagcgagggcagaggcggcagaagaggccacgacgcccccatgatcgcctacgacgccctgctggccgccggcaacagctggaccgagctgtgccacagagccatgttccacggcggcgagagcgccgccaccggcaccatcgccggctgcctgttcggcctgctgtacggcctggacctggtgcccaagggcctgtaccaggacctggaggacaaggagaagctggaggacctgggcgccgccctgtacagactgagcaccgaggagaagtag

SEQ ID NO: 72214 - DNA, 1065 bp, Artificial Sequence
  Description of Artificial Sequence: Synthetic coding sequence
atggagaagttcaaggccgccatgctgctgggcagcgtgggcgacgccctgggctacagaaacgtgtgcaaggagaacagcaccgtgggcatgaagatccaggaggagctgcagagaagcggcggcctggaccacctggtgctgagccccggcgagtggcccgtgagcgacaacaccatcatgcacatcgccaccgccgaggccctgaccaccgactactggtgcctggacgacctgtacagagagatggtgagatgctacgtggagatcgtggagaagctgcccgagagaagacccgaccccgccaccatcgagggctgcgcccagctgaagcccaacaactacctgctggcctggcacacccccttcaacgagaagggcagcggcttcggcgccgccaccaaggccatgtgcatcggcctgagatactggaagcccgagagactggagaccctgatcgaggtgagcgtggagtgcggcagaatgacccacaaccaccccaccggcttcctgggcagcctgtgcaccgccctgttcgtgagcttcgccgcccagggcaagcccctggtgcagtggggcagagacatgctgagagccgtgcccctggccgaggagtactgcagaaagaccatcagacacaccgccgagtaccaggagcactggttctacttcgaggccaagtggcagttctacctggaggagagaaagatcagcaaggacagcgagaacaaggccatcttccccgacaactacgacgccgaggagagagagaagacctacagaaagtggagcagcgagggcagaggcggcagaagaggccacgacgcccccatgatcgcctacgacgccctgctggccgccggcaacagctggaccgagctgtgccacagagccatgttccacggcggcgagagcgccgccaccggcaccatcgccggctgcctgttcggcctgctgtacggcctggacctggtgcccaagggcctgtaccaggacctggaggacaaggagaagctggaggacctgggcgccgccctgtacagactgagcaccgaggagaagtag

SEQ ID NO: 72215 - DNA, 531 bp, Artificial Sequence
  Description of Artificial Sequence: Synthetic coding sequence
atggtgagatgctacgtggagatcgtggagaagctgcccgagagaagacccgaccccgccaccatcgagggctgcgcccagctgaagcccaacaactacctgctggcctggcacacccccttcaacgagaagggcagcggcttcggcgccgccaccaaggccatgtgcatcggcctgagatactggaagcccgagagactggagaccctgatcgaggtgagcgtggagtgcggcagaatgacccacaaccaccccaccggcttcctgggcagcctgtgcaccgccctgttcgtgagcttcgccgcccagggcaagcccctggtgcagtggggcagagacatgctgagagccgtgcccctggccgaggagtactgcagaaagaccatcagacacaccgccgagtaccaggagcactggttctacttcgaggccaagtggcagttctacctggaggagagaaagatcagcaaggacagcgagaacaaggccatcttccccgacaactacgacgccgaggagagagagaagtag

SEQ ID NO: 72216 - DNA, 1092 bp, Artificial Sequence
  Description of Artificial Sequence: Synthetic coding sequence
atggccgccgccgccatggccgccgccgccggcggcggcgccggcgccgccagaagcctgagcagattcagaggctgcctggccggcgccctgctgggcgactgcgtgggcagcttctacgaggcccacgacaccgtggacctgaccagcgtgctgagacacgtgcagagcctggagcccgaccccggcacccccggcagcgagagaaccgaggccctgtactacaccgacgacaccgccatggccagagccctggtgcagagcctgctggccaaggaggccttcgacgaggtggacatggcccacagattcgcccaggagtacaagaaggaccccgacagaggctacggcgccggcgtggtgaccgtgttcaagaagctgctgaaccccaagtgcagagacgtgttcgagcccgccagagcccagttcaacggcaagggcagctacggcaacggcggcgccatgagagtggccggcatcagcctggcctacagcagcgtgcaggacgtgcagaagttcgccagactgagcgcccagctgacccacgccagcagcctgggctacaacggcgccatcctgcaggccctggccgtgcacctggccctgcagggcgagagcagcagcgagcacttcctgaagcagctgctgggccacatggaggacctggagggcgacgcccagagcgtgctggacgccagagagctgggcatggaggagagaccctacagcagcagactgaagaagatcggcgagctgctggaccaggccagcgtgaccagagaggaggtggtgagcgagctgggcaacggcatcgccgccttcgagagcgtgcccaccgccatctactgcttcctgagatgcatggagcccgaccccgagatccccagcgccttcaacagcctgcagagaaccctgatctacagcatcagcctgggcggcgacaccgacaccatcgccaccatggccggcgccatcgccggcgcctactacggcatggaccaggtgcccgagagctggcagcagagctgcgagggctacgaggagaccgacatcctggcccagagcctgcacagagtgttccagaagagctag

SEQ ID NO: 72217 - DNA, 852 bp, Artificial Sequence
  Description of Artificial Sequence: Synthetic coding sequence
atggccagagccctggtgcagagcctgctggccaaggaggccttcgacgaggtggacatggcccacagattcgcccaggagtacaagaaggaccccgacagaggctacggcgccggcgtggtgaccgtgttcaagaagctgctgaaccccaagtgcagagacgtgttcgagcccgccagagcccagttcaacggcaagggcagctacggcaacggcggcgccatgagagtggccggcatcagcctggcctacagcagcgtgcaggacgtgcagaagttcgccagactgagcgcccagctgacccacgccagcagcctgggctacaacggcgccatcctgcaggccctggccgtgcacctggccctgcagggcgagagcagcagcgagcacttcctgaagcagctgctgggccacatggaggacctggagggcgacgcccagagcgtgctggacgccagagagctgggcatggaggagagaccctacagcagcagactgaagaagatcggcgagctgctggaccaggccagcgtgaccagagaggaggtggtgagcgagctgggcaacggcatcgccgccttcgagagcgtgcccaccgccatctactgcttcctgagatgcatggagcccgaccccgagatccccagcgccttcaacagcctgcagagaaccctgatctacagcatcagcctgggcggcgacaccgacaccatcgccaccatggccggcgccatcgccggcgcctactacggcatggaccaggtgcccgagagctggcagcagagctgcgagggctacgaggagaccgacatcctggcccagagcctgcacagagtgttccagaagagctag

SEQ ID NO: 72218 - DNA, 630 bp, Artificial Sequence
  Description of Artificial Sequence: Synthetic coding sequence
atgagagtggccggcatcagcctggcctacagcagcgtgcaggacgtgcagaagttcgccagactgagcgcccagctgacccacgccagcagcctgggctacaacggcgccatcctgcaggccctggccgtgcacctggccctgcagggcgagagcagcagcgagcacttcctgaagcagctgctgggccacatggaggacctggagggcgacgcccagagcgtgctggacgccagagagctgggcatggaggagagaccctacagcagcagactgaagaagatcggcgagctgctggaccaggccagcgtgaccagagaggaggtggtgagcgagctgggcaacggcatcgccgccttcgagagcgtgcccaccgccatctactgcttcctgagatgcatggagcccgaccccgagatccccagcgccttcaacagcctgcagagaaccctgatctacagcatcagcctgggcggcgacaccgacaccatcgccaccatggccggcgccatcgccggcgcctactacggcatggaccaggtgcccgagagctggcagcagagctgcgagggctacgaggagaccgacatcctggcccagagcctgcacagagtgttccagaagagctag

SEQ ID NO: 72219 - DNA, 984 bp, Artificial Sequence
  Description of Artificial Sequence: Synthetic coding sequence
atgcagatgcccgccatgatgagcctgctgctggtgagcgtgggcctgatggaggccctgcaggcccagagccaccccatcaccagaagagacctgttcagccaggagatccagctggacatggccctggccagcttcgacgaccagtacgccggctgcgccgccgccatgaccgccgccctgcccgacctgaaccacaccgagttccaggccaaccaggtgtacgccgacagctggaccctggccagcagccagtggcaggagagacaggccagatggcccgagtggagcctgagccccaccagacccagccccccccccctgggcttcagagacgagcacggcgtggccctgctggcctacaccgccaacagccccctgcacaaggagttcaacgccgccgtgagagaggccggcagaagcagagcccactacctgcaccacttcagcttcaagaccctgcacttcctgctgaccgaggccctgcagctgctgggcagcggccagagaccccccagatgccaccaggtgttcagaggcgtgcacggcctgagattcagacccgccggccccagagccaccgtgagactgggcggcttcgccagcgccagcctgaagcacgtggccgcccagcagttcggcgaggacaccttcttcggcatctggacctgcctgggcgcccccatcaagggctacagcttcttccccggcgaggaggaggtgctgatcccccccttcgagaccttccaggtgatcaacgccagcagactggcccagggccccgccagaatctacctgagagccctgggcaagcacagcacctacaactgcgagtacatcaaggacaagaagtgcaagagcggcccctgccacctggacaacagcgccatgggccagagccccctgagcgccgtgtggagcctgctgctgctgctgtggttcctggtggtgagagccttccccgacggccccggcctgctgtag

SEQ ID NO: 72220 - DNA, 1104 bp, Artificial Sequence
  Description of Artificial Sequence: Synthetic coding sequence
atgaagaccggccacttcgagatcgtgaccatgctgctggccaccatgatcctggtggacatcttccaggtgaaggccgaggtgctggacatggccgacaacgccttcgacgacgagtacctgaagtgcaccgacagaatggagatcaagtacgtgccccagctgctgaaggaggagaaggccagccaccagcagctggacaccgtgtgggagaacgccaaggccaagtgggccgccagaaagacccagatcttcctgcccatgaacttcaaggacaaccacggcatcgccctgatggcctacatcagcgaggcccaggagcagacccccttctaccacctgttcagcgaggccgtgaagatggccggccagagcagagaggactacatctacggcttccagttcaaggccttccacttctacctgaccagagccctgcagctgctgagaaagccctgcgaggccagcagcaagaccgtggtgtacagaaccagccagggcaccagcttcaccttcggcggcctgaaccaggccagattcggccacttcaccctggcctacagcgccaagccccaggccgccaacgaccagctgaccgtgctgagcatctacacctgcctgggcgtggacatcgagaacttcctggacaaggagagcgagagaatcaccctgatccccctgaacgaggtgttccaggtgagccaggagggcgccggcaacaacctgatcctgcagagcatcaacaagacctgcagccactacgagtgcgccttcctgggcggcctgaagaccgagaactgcatcgagaacctggagtacttccagcccatctacgtgtacaaccccggcgagaagaaccagaagctggaggaccacagcgagaagaactggaagctggaggaccacggcgagaagaaccagaagctggaggaccacggcgtgaagatcctggagcccacccagatccccgcccccggccccgtgcccgtgcccggccccaagagccaccccagcgccagcagcggcaagctgctgctgccccagttcggcatggtgatcatcctgatcagcgtgagcgccatcaacctgttcgtggccctgtag

SEQ ID NO: 72221 - DNA, 1137 bp, Artificial Sequence
  Description of Artificial Sequence: Synthetic coding sequence
atgaagaccggccacttcgagatcgtgaccatgctgctggccaccatgatcctggtggacatcttccaggtgaaggccgaggtgctggacatggccgacaacgccttcgacgacgagtacctgaagtgcaccgacagaatggagatcaagtacgtgccccagctgctgaaggaggagaaggccagccaccagcagctggacaccgtgtgggagaacgccaaggccaagtgggccgccagaaagacccagatcttcctgcccatgaacttcaaggacaaccacggcatcgccctgatggcctacatcagcgaggcccaggagcagacccccttctaccacctgttcagcgaggccgtgaagatggccggccagagcagagaggactacatctacggcttccagttcaaggccttccacttctacctgaccagagccctgcagctgctgagaaagccctgcgaggccagcagcaagaccgtggtgtacagaaccagccagggcaccagcttcaccttcggcggcctgaaccaggccagattcggccacttcaccctggcctacagcgccaagccccaggccgccaacgaccagctgaccgtgctgagcatctacacctgcctgggcgtggacatcgagaacttcctggacaaggagagcgagagaatcaccctgatccccctgaacgaggtgttccaggtgagccaggagggcgccggcaacaacctgatcctgcagagcatcaacaagacctgcagccactacgagtgcgccttcctgggcggcctgaagaccgagaactgcatcgagaacctggagtacttccagcccatctacgtgtacaaccccggcgagaagaaccagaagctggaggaccacagcgagaagaactggaagctggaggaccacggcgagaagaaccagaagctggaggaccacggcgtgaagatcctggagcccacccagatccccgaggacaagagccagggcaacatcaacaaccccacccccggccccgtgcccgtgcccggccccaagagccaccccagcgccagcagcggcaagctgctgctgccccagttcggcatggtgatcatcctgatcagcgtgagcgccatcaacctgttcgtggccctgtag

SEQ ID NO: 72222 - DNA, 1170 bp, Artificial Sequence
  Description of Artificial Sequence: Synthetic coding sequence
atgaagaccggccacttcgagatcgtgaccatgctgctggccaccatgatcctggtggacatcttccaggtgaaggccgaggtgctggacatggccgacaacgccttcgacgacgagtacctgaagtgcaccgacagaatggagatcaagtacgtgccccagctgctgaaggaggagaaggccagccaccagcagctggacaccgtgtgggagaacgccaaggccaagtgggccgccagaaagacccagatcttcctgcccatgaacttcaaggacaaccacggcatcgccctgatggcctacatcagcgaggcccaggagcagacccccttctaccacctgttcagcgaggccgtgaagatggccggccagagcagagaggactacatctacggcttccagttcaaggccttccacttctacctgaccagagccctgcagctgctgagaaagccctgcgaggccagcagcaagaccgtggtgtacagaaccagccagggcaccagcttcaccttcggcggcctgaaccaggccagattcggccacttcaccctggcctacagcgccaagccccaggccgccaacgaccagctgaccgtgctgagcatctacacctgcctgggcgtggacatcgagaacttcctggacaaggagagcgagagaatcaccctgatccccctgaacgaggtgttccaggtgagccaggagggcgccggcaacaacctgatcctgcagagcatcaacaagacctgcagccactacgagtgcgccttcctgggcggcctgaagaccgagaactgcatcgagaacctggagtacttccagcccatctacgtgtacaaccccggcgagaagaaccagaagctggaggaccacagcgagaagaactggaagctggaggaccacggcgagaagaaccagaagctggaggaccacggcgtgaagatcctggagcccacccagatccccggcatgaagatccccgagcccttccccctgcccgaggacaagagccagggcaacatcaacaaccccacccccggccccgtgcccgtgcccggccccaagagccaccccagcgccagcagcggcaagctgctgctgccccagttcggcatggtgatcatcctgatcagcgtgagcgccatcaacctgttcgtggccctgtag

SEQ ID NO: 72223 - DNA, 390 bp, Artificial Sequence
  Description of Artificial Sequence: Synthetic coding sequence
atgaagaccggccacttcgagatcgtgaccatgctgctggccaccatgatcctggtggacatcttccaggtgaaggccgaggtgctggacatggccgacaacgccttcgacgacgagtacctgaagtgcaccgacagaatggagatcaagtacgtgccccagctgctgaaggaggagaaggccagccaccagcagctggacaccgtgtgggagaacgccaaggccaagtgggccgccagaaagacccagatcttcctgcccatgaacttcaaggacaaccacggcatcgccctgatggcctacatcagcgaggcccaggagcagacccccttctaccacctgttcagcgaggccgtgaagatggccggccagagcagagaggactactag

SEQ ID NO: 72224 - DNA, 528 bp, Artificial Sequence
  Description of Artificial Sequence: Synthetic coding sequence
atgaagaccggccacttcgagatcgtgaccatgctgctggccaccatgatcctggtggacatcttccaggtgaaggccgaggtgctggacatggccgacaacgccttcgacgacgagtacctgaagtgcaccgacagaatggagatcaagtacgtgccccagctgctgaaggaggagaaggccagccaccagcagctggacaccgtgtgggagaacgccaaggccaagtgggccgccagaaagacccagatcttcctgcccatgaacttcaaggacaaccacggcatcgccctgatggcctacatcagcgaggcccaggagcagacccccttctaccacctgttcagcgaggccgtgaagatggccggccagagcagagaggactacatctacggcttccagttcaaggccttccacttctacctgaccagagccctgcagctgctgagaaagccctgcgaggccagcagcaagaccgtggtgtacagaaccagccagggcaccagcttcaccttcggcggcctgtag

SEQ ID NO: 72225 - DNA, 609 bp, Artificial Sequence
  Description of Artificial Sequence: Synthetic coding sequence
atgaagaccggccacttcgagatcgtgaccatgctgctggccaccatgatcctggtggacatcttccaggtgaaggccgaggtgctggacatggccgacaacgccttcgacgacgagtacctgaagtgcaccgacagaatggagatcaagtacgtgccccagctgctgaaggaggagaaggccagccaccagcagctggacaccgtgtgggagaacgccaaggccaagtgggccgccagaaagacccagatcttcctgcccatgaacttcaaggacaaccacggcatcgccctgatggcctacatcagcgaggcccaggagcagacccccttctaccacctgttcagcgaggccgtgaagatggccggccagagcagagaggactacatctacggcttccagttcaaggccttccacttctacctgaccagagccctgcagctgctgagaaagccctgcgaggccagcagcaagaccgtggtgtacagaaccagccagggcaccagcttcaccttcggcggcctgaaccaggccagattcggccacttcaccctggcctacagcgccaagccccaggccgccaacgaccagctgaccgtgctgagctag

SEQ ID NO: 72226 - DNA, 324 bp, Artificial Sequence
  Description of Artificial Sequence: Synthetic coding sequence
atgaagaccggccacttcgagatcgtgaccatgctgctggccaccatgatcctggtggacatcttccaggtgaaggccgaggtgctggacatggccgacaacgccttcgacgacgagtacctgaagtgcaccgacagaatggagatcaagtacgtgccccagctgctgaaggaggagaaggccagccaccagcagctggacaccgtgtgggagaacgccaaggccaagtgggccgccagaaagacccagatcttcctgcccatgaacttcaaggacaaccacggcatcgccctgatggcctacatcagcgaggcccaggagtag

SEQ ID NO: 72227 - DNA, 456 bp, Artificial Sequence
  Description of Artificial Sequence: Synthetic coding sequence
atgagcggcagaggcaagcagggcggcaaggtgagagccaaggccaagagcagaagcagcagagccggcctgcagttccccgtgggcagagtgcacagactgctgagaaagggcaactacgccgagagagtgggcgccggcgcccccgtgtacctggccgccgtgctggagtacctgaccgccgagatcctggagctggccggcaacgccgccagagacaacaagaagaccagaatcatccccagacacctgcagctggccatcagaaacgacgaggagctgaacaagctgctgggcaaggtgaccatcgcccagggcggcgtgctgcccaacatccaggccgtgctgctgcccatctgcgagcacagcggccccagcagcggcaagatccccagcgacagagccgagctgggcgccggcagcgtgtgcggccacatcttccagaaggtggagtag

SEQ ID NO: 72228 - DNA, 177 bp, Artificial Sequence
  Description of Artificial Sequence: Synthetic coding sequence
atgggccccctgatcaacagatgcaagaagatcctgctgcccaccaccgtgccccccgccaccatgagaatctggctgctgggcggcctgctgcccttcctgctgctgctgagcggcctgcagagacccaccgagggcagcgagctgcccgccagaaacgccagcctgatcctgtag

SEQ ID NO: 72229 - DNA, 876 bp, Artificial Sequence
  Description of Artificial Sequence: Synthetic coding sequence
atggccctggccgccctgatgatcgccctgggcagcctgggcctgcacacctggcaggcccaggccgtgcccatcctgcccctgggcctggcccccgacaccttcgacgacacctacgtgggctgcgccgaggagatggaggagaaggccgcccccctgctgaaggaggagatggcccaccacgccctgctgagagagagctgggaggccgcccaggagacctgggaggacaagagaagaggcctgaccctgccccccggcttcaaggcccagaacggcatcgccatcatggtgtacaccaacagcagcaacaccctgtactgggagctgaaccaggccgtgagaaccggcggcggcagcagagagctgtacatgagacacttccccttcaaggccctgcacttctacctgatcagagccctgcagctgctgagaggcagcggcggctgcagcagaggccccggcgaggtggtgttcagaggcgtgggcagcctgagattcgagcccaagagactgggcgacagcgtgagactgggccagttcgccagcagcagcctggacaaggccgtggcccacagattcggcaacgccaccctgttcagcctgaccacctgcttcggcgcccccatccaggccttcagcgtgttccccaaggagagagaggtgctgatccccccccacgaggtgttcctggtgaccagattcagccaggacggcgcccagagcctggtgaccctgtggagctacaaccagacctgcagccacttcaactgcgcctacctgggcggcgagaagagaagaggctgcgtgagcgcccccggcgccctgggcaccggcgacctgcacatgaccaagagacacctgcagcagccctag

SEQ ID NO: 72230 - DNA, 720 bp, Artificial Sequence
  Description of Artificial Sequence: Synthetic coding sequence
atggccctggccgccctgatgatcgccctgggcagcctgggcctgcacacctggcaggcccaggccgtgcccatcctgcccctgggcctggcccccgacaccttcgacgacacctacgtgggctgcgccgaggagatggaggagaaggccgcccccctgctgaaggaggagatggcccaccacgccctgctgagagagagctgggaggccgcccaggagacctgggaggacaagagaagaggcctgaccctgccccccggcttcaaggcccagaacggcatcgccatcatggtgtacaccaacagcagcaacaccctgtactgggagctgaaccaggccgtgagaaccggcggcggcagcagagagctgtacatgagacacttccccttcaaggccctgcacttctacctgatcagagccctgcagctgctgagaggcagcggcggctgcagcagaggccccggcgaggtggtgttcagaggcgtgggcagcctgagattcgagcccaagagactgggcgacagcgtgagactgggccagttcgccagcagcagcctggacaaggccgtggcccacagattcggcgagaagagaagaggctgcgtgagcgcccccggcgtgcagctgggcagccagagcgagggcgccagcagcctgcccccctggaagaccctgctgctggcccccggcgagttccagctgagcggcgtgggcccctag

SEQ ID NO: 72231 - DNA, 876 bp, Artificial Sequence; identical to SEQ ID NO: 72229
  Description of Artificial Sequence: Synthetic coding sequence

SEQ ID NO: 72232 - DNA, 1401 bp, Artificial Sequence
  Description of Artificial Sequence: Synthetic coding sequence
atggtgttcctgagcggcaacgccagcgacagcagcaactgcacccagccccccgcccccgtgaacatcagcaaggccatcctgctgggcgtgatcctgggcggcctgatcctgttcggcgtgctgggcaacatcctggtgatcctgagcgtggcctgccacagacacctgcacagcgtgacccactactacatcgtgaacctggccgtggccgacctgctgctgaccagcaccgtgctgcccttcagcgccatcttcgaggtgctgggctactgggccttcggcagagtgttctgcaacatctgggccgccgtggacgtgctgtgctgcaccgccagcatcatgggcctgtgcatcatcagcatcgacagatacatcggcgtgagctaccccctgagataccccaccatcgtgacccagagaagaggcctgatggccctgctgtgcgtgtgggccctgagcctggtgatcagcatcggccccctgttcggctggagacagcccgcccccgaggacgagaccatctgccagatcaacgaggagcccggctacgtgctgttcagcgccctgggcagcttctacctgcccctggccatcatcctggtgatgtactgcagagtgtacgtggtggccaagagagagagcagaggcctgaagagcggcctgaagaccgacaagagcgacagcgagcaggtgaccctgagaatccacagaaagaacgcccccgccggcggcagcggcatggccagcgccaagaccaagacccacttcagcgtgagactgctgaagttcagcagagagaagaaggccgccaagaccctgggcatcgtggtgggctgcttcgtgctgtgctggctgcccttcttcctggtgatgcccatcggcagcttcttccccgacttcaagcccagcgagaccgtgttcaagatcgtgttctggctgggctacctgaacagctgcatcaaccccatcatctacccctgcagcagccaggagttcaagaaggccttccagaacgtgctgagaatccagtgcctgtgcagaaagcagagcagcaagcacgccctgggctacaccctgcacccccccagccaggccgtggagggccagcacaaggacatggtgagaatccccgtgggcagcagagagaccttctacagaatcagcaagaccgacggcgtgtgcgagtggaagttcttcagcagcatgcccagaggcagcgccagaatcaccgtgagcaaggaccagagcagctgcaccaccgccagagtgagaagcaagagcttcctgcaggtgtgctgctgcgtgggccccagcacccccagcctggacaagaaccaccaggtgcccaccatcaaggtgcacaccatcagcctgagcgagaacggcgaggaggtgtag

SEQ ID NO: 72233 - DNA, 1368 bp, Artificial Sequence
  Description of Artificial Sequence: Synthetic coding sequence
atggtgttcctgagcggcaacgccagcgacagcagcaactgcacccagccccccgcccccgtgaacatcagcaaggccatcctgctgggcgtgatcctgggcggcctgatcctgttcggcgtgctgggcaacatcctggtgatcctgagcgtggcctgccacagacacctgcacagcgtgacccactactacatcgtgaacctggccgtggccgacctgctgctgaccagcaccgtgctgcccttcagcgccatcttcgaggtgctgggctactgggccttcggcagagtgttctgcaacatctgggccgccgtggacgtgctgtgctgcaccgccagcatcatgggcctgtgcatcatcagcatcgacagatacatcggcgtgagctaccccctgagataccccaccatcgtgacccagagaagaggcctgatggccctgctgtgcgtgtgggccctgagcctggtgatcagcatcggccccctgttcggctggagacagcccgcccccgaggacgagaccatctgccagatcaacgaggagcccggctacgtgctgttcagcgccctgggcagcttctacctgcccctggccatcatcctggtgatgtactgcagagtgtacgtggtggccaagagagagagcagaggcctgaagagcggcctgaagaccgacaagagcgacagcgagcaggtgaccctgagaatccacagaaagaacgcccccgccggcggcagcggcatggccagcgccaagaccaagacccacttcagcgtgagactgctgaagttcagcagagagaagaaggccgccaagaccctgggcatcgtggtgggctgcttcgtgctgtgctggctgcccttcttcctggtgatgcccatcggcagcttcttccccgacttcaagcccagcgagaccgtgttcaagatcgtgttctggctgggctacctgaacagctgcatcaaccccatcatctacccctgcagcagccaggagttcaagaaggccttccagaacgtgctgagaatccagtgcctgtgcagaaagcagagcagcaagcacgccctgggctacaccctgcacccccccagccaggccgtggagggccagcacaaggacatggtgagaatccccgtgggcagcagagagaccttctacagaatcagcaagaccgacggcgtgtgcgagtggaagttcttcagcagcatgcccagaggcagcgccagaatcaccgtgagcaaggaccagagcagctgcaccaccgccagaagaggcatggactgcagatacttcaccaagaactgcagagagcacatcaagcacgtgaacttcatgatgcccccctggagaaagggcagcgagtgctag

SEQ ID NO: 72234 - DNA, 975 bp, Artificial Sequence
  Description of Artificial Sequence: Synthetic coding sequence
atggtgttcctgagcggcaacgccagcgacagcagcaactgcacccagccccccgcccccgtgaacatcagcaaggccatcctgctgggcgtgatcctgggcggcctgatcctgttcggcgtgctgggcaacatcctggtgatcctgagcgtggcctgccacagacacctgcacagcgtgacccactactacatcgtgaacctggccgtggccgacctgctgctgaccagcaccgtgctgcccttcagcgccatcttcgaggtgctgggctactgggccttcggcagagtgttctgcaacatctgggccgccgtggacgtgctgtgctgcaccgccagcatcatgggcctgtgcatcatcagcatcgacagatacatcggcgtgagctaccccctgagataccccaccatcgtgacccagagaagaggcctgatggccctgctgtgcgtgtgggccctgagcctggtgatcagcatcggccccctgttcggctggagacagcccgcccccgaggacgagaccatctgccagatcaacgaggagcccggctacgtgctgttcagcgccctgggcagcttctacctgcccctggccatcatcctggtgatgtactgcagagtgtacgtggtggccaagagagagagcagaggcctgaagagcggcctgaagaccgacaagagcgacagcgagcaggtgaccctgagaatccacagaaagaacgcccccgccggcggcagcggcatggccagcgccaagaccaagacccacttcagcgtgagactgctgaagttcagcagagagaagaaggccgccaagaccctgggcatcgtggtgggctgcttcgtgctgtgctggctgcccttcttcctggtgatgcccatcggcacctacatcctgaagtacgacgtgctgttctggagaaagggcctgagcgtgtgcaccagactgagagagagaaaggagatcaagaactag

SEQ ID NO: 72235 - DNA, 1029 bp, Artificial Sequence
  Description of Artificial Sequence: Synthetic coding sequence
atggtgttcctgagcggcaacgccagcgacagcagcaactgcacccagccccccgcccccgtgaacatcagcaaggccatcctgctgggcgtgatcctgggcggcctgatcctgttcggcgtgctgggcaacatcctggtgatcctgagcgtggcctgccacagacacctgcacagcgtgacccactactacatcgtgaacctggccgtggccgacctgctgctgaccagcaccgtgctgcccttcagcgccatcttcgaggtgctgggctactgggccttcggcagagtgttctgcaacatctgggccgccgtggacgtgctgtgctgcaccgccagcatcatgggcctgtgcatcatcagcatcgacagatacatcggcgtgagctaccccctgagataccccaccatcgtgacccagagaagaggcctgatggccctgctgtgcgtgtgggccctgagcctggtgatcagcatcggccccctgttcggctggagacagcccgcccccgaggacgagaccatctgccagatcaacgaggagcccggctacgtgctgttcagcgccctgggcagcttctacctgcccctggccatcatcctggtgatgtactgcagagtgtacgtggtggccaagagagagagcagaggcctgaagagcggcctgaagaccgacaagagcgacagcgagcaggtgaccctgagaatccacagaaagaacgcccccgccggcggcagcggcatggccagcgccaagaccaagacccacttcagcgtgagactgctgaagttcagcagagagaagaaggccgccaagaccctgggcatcgtggtgggctgcttcgtgctgtgctggctgcccttcttcctggtgatgcccatcgacgaggagaccgaggcccaggagggcaagaacgacagccccagcttcaagcagcccgtgcaccacgccgccgtgctgggcctggaggtgatggagaaggagaacctggagggcgtgagcagaaaggacacctgcggcgtgtggtag

SEQ ID NO: 72236 - DNA, 1401 bp, Artificial Sequence; identical to SEQ ID NO: 72232
  Description of Artificial Sequence: Synthetic coding sequence

SEQ ID NO: 72237 - DNA, 1119 bp, Artificial Sequence
  Description of Artificial Sequence: Synthetic coding sequence
atggtgttcctgagcggcaacgccagcgacagcagcaactgcacccagccccccgcccccgtgaacatcagcaaggccatcctgctgggcgtgatcctgggcggcctgatcctgttcggcgtgctgggcaacatcctggtgatcctgagcgtggcctgccacagacacctgcacagcgtgacccactactacatcgtgaacctggccgtggccgacctgctgctgaccagcaccgtgctgcccttcagcgccatcttcgaggtgctgggctactgggccttcggcagagtgttctgcaacatctgggccgccgtggacgtgctgtgctgcaccgccagcatcatgggcctgtgcatcatcagcatcgacagatacatcggcgtgagctaccccctgagataccccaccatcgtgacccagagaagaggcctgatggccctgctgtgcgtgtgggccctgagcctggtgatcagcatcggccccctgttcggctggagacagcccgcccccgaggacgagaccatctgccagatcaacgaggagcccggctacgtgctgttcagcgccctgggcagcttctacctgcccctggccatcatcctggtgatgtactgcagagtgtacgtggtggccaagagagagagcagaggcctgaagagcggcctgaagaccgacaagagcgacagcgagcaggtgaccctgagaatccacagaaagaacgcccccgccggcggcagcggcatggccagcgccaagaccaagacccacttcagcgtgagactgctgaagttcagcagagagaagaaggccgccaagaccctgggcatcgtggtgggctgcttcgtgctgtgctggctgcccttcttcctggtgatgcccatcggcacccacacccacgacatgaagcccgccagcagacccagactgctgagcctgctgcccaaggagggcgagcacgagacccaccactggagctgcgaccccctgagcctggagagcacccccggcgcccaggagccctgcctgaccctgggcttcaccagcctgagcagcatccacctgaccaaggcccagatccagcacgtgaccgtgaccgacaccggcaagaccgtgacctag

SEQ ID NO: 72238 - DNA, 1290 bp, Artificial Sequence
  Description of Artificial Sequence: Synthetic coding sequence
atggtgttcctgagcggcaacgccagcgacagcagcaactgcacccagccccccgcccccgtgaacatcagcaaggccatcctgctgggcgtgatcctgggcggcctgatcctgttcggcgtgctgggcaacatcctggtgatcctgagcgtggcctgccacagacacctgcacagcgtgacccactactacatcgtgaacctggccgtggccgacctgctgctgaccagcaccgtgctgcccttcagcgccatcttcgaggtgctgggctactgggccttcggcagagtgttctgcaacatctgggccgccgtggacgtgctgtgctgcaccgccagcatcatgggcctgtgcatcatcagcatcgacagatacatcggcgtgagctaccccctgagataccccaccatcgtgacccagagaagaggcctgatggccctgctgtgcgtgtgggccctgagcctggtgatcagcatcggccccctgttcggctggagacagcccgcccccgaggacgagaccatctgccagatcaacgaggagcccggctacgtgctgttcagcgccctgggcagcttctacctgcccctggccatcatcctggtgatgtactgcagagtgtacgtggtggccaagagagagagcagaggcctgaagagcggcctgaagaccgacaagagcgacagcgagcaggtgaccctgagaatccacagaaagaacgcccccgccggcggcagcggcatggccagcgccaagaccaagacccacttcagcgtgagactgctgaagttcagcagagagaagaaggccgccaagaccctgggcatcgtggtgggctgcttcgtgctgtgctggctgcccttcttcctggtgatgcccatcggcagcttcttccccgacttcaagcccagcgagaccgtgttcaagatcgtgttctggctgggctacctgaacagctgcatcaaccccatcatctacccctgcagcagccaggagttcaagaaggccttccagaacgtgctgagaatccagtgcctgtgcagaaagcagagcagcaagcacgccctgggctacaccctgcacccccccagccaggccgtggagggccagcacaaggacatggtgagaatccccgtgggcagcagagagaccttctacagaatcagcaagaccgacggcgtgtgcgagtggaagttcttcagcagcatgcccagaggcagcgccagaatcaccgtgagcaaggaccagagcagctgcaccaccgccagaggccacacccccatgacctag

SEQ ID NO: 72239 - DNA, 1428 bp, Artificial Sequence
  Description of Artificial Sequence: Synthetic coding sequence
atggtgttcctgagcggcaacgccagcgacagcagcaactgcacccagccccccgcccccgtgaacatcagcaaggccatcctgctgggcgtgatcctgggcggcctgatcctgttcggcgtgctgggcaacatcctggtgatcctgagcgtggcctgccacagacacctgcacagcgtgacccactactacatcgtgaacctggccgtggccgacctgctgctgaccagcaccgtgctgcccttcagcgccatcttcgaggtgctgggctactgggccttcggcagagtgttctgcaacatctgggccgccgtggacgtgctgtgctgcaccgccagcatcatgggcctgtgcatcatcagcatcgacagatacatcggcgtgagctaccccctgagataccccaccatcgtgacccagagaagaggcctgatggccctgctgtgcgtgtgggccctgagcctggtgatcagcatcggccccctgttcggctggagacagcccgcccccgaggacgagaccatctgccagatcaacgaggagcccggctacgtgctgttcagcgccctgggcagcttctacctgcccctggccatcatcctggtgatgtactgcagagtgtacgtggtggccaagagagagagcagaggcctgaagagcggcctgaagaccgacaagagcgacagcgagcaggtgaccctgagaatccacagaaagaacgcccccgccggcggcagcggcatggccagcgccaagaccaagacccacttcagcgtgagactgctgaagttcagcagagagaagaaggccgccaagaccctgggcatcgtggtgggctgcttcgtgctgtgctggctgcccttcttcctggtgatgcccatcggcagcttcttccccgacttcaagcccagcgagaccgtgttcaagatcgtgttctggctgggctacctgaacagctgcatcaaccccatcatctacccctgcagcagccaggagttcaagaaggccttccagaacgtgctgagaatccagtgcctgtgcagaaagcagagcagcaagcacgccctgggctacaccctgcacccccccagccaggccgtggagggccagcacaaggacatggtgagaatccccgtgggcagcagagagaccttctacagaatcagcaagaccgacggcgtgtgcgagtggaagttcttcagcagcatgcccagaggcagcgccagaatcaccgtgagcaaggaccagagcagctgcaccaccgccagaaccaagagcagaagcgtgaccagactggagtgcagcggcatgatcctggcccactgcaacctgagactgcccggcagcagagacagccccgccagcgccagccaggccgccggcaccaccggcatgtgccaccaggccgacgccaccagacccagctag

SEQ ID NO: 72240 - DNA, 1113 bp, Artificial Sequence
  Description of Artificial Sequence: Synthetic coding sequence
atggtgttcctgagcggcaacgccagcgacagcagcaactgcacccagccccccgcccccgtgaacatcagcaaggccatcctgctgggcgtgatcctgggcggcctgatcctgttcggcgtgctgggcaacatcctggtgatcctgagcgtggcctgccacagacacctgcacagcgtgacccactactacatcgtgaacctggccgtggccgacctgctgctgaccagcaccgtgctgcccttcagcgccatcttcgaggtgctgggctactgggccttcggcagagtgttctgcaacatctgggccgccgtggacgtgctgtgctgcaccgccagcatcatgggcctgtgcatcatcagcatcgacagatacatcggcgtgagctaccccctgagataccccaccatcgtgacccagagaagaggcctgatggccctgctgtgcgtgtgggccctgagcctggtgatcagcatcggccccctgttcggctggagacagcccgcccccgaggacgagaccatctgccagatcaacgaggagcccggctacgtgctgttcagcgccctgggcagcttctacctgcccctggccatcatcctggtgatgtactgcagagtgtacgtggtggccaagagagagagcagaggcctgaagagcggcctgaagaccgacaagagcgacagcgagcaggtgaccctgagaatccacagaaagaacgcccccgccggcggcagcggcatggccagcgccaagaccaagacccacttcagcgtgagactgctgaagttcagcagagagaagaaggccgccaagaccctgggcatcgtggtgggctgcttcgtgctgtgctggctgcccttcttcctggtgatgcccatcgacgaggtgagcctgtgccaccaggccggcgtgcagtggcacgacctgggcagcctgcagccccccccccccggcttcaagagattcagctgcctgagcctgcccagcagctgggactacagagacgtgccccccggcagaagacaccaggcccagctgatcttcgtgttcctggtggagaccggcttccaccacgtgggccaggacgacctggacctgctgaccagctag

SEQ ID NO: 72241 - DNA, 1284 bp, Artificial Sequence
  Description of Artificial Sequence: Synthetic coding sequence
atggtgttcctgagcggcaacgccagcgacagcagcaactgcacccagccccccgcccccgtgaacatcagcaaggccatcctgctgggcgtgatcctgggcggcctgatcctgttcggcgtgctgggcaacatcctggtgatcctgagcgtggcctgccacagacacctgcacagcgtgacccactactacatcgtgaacctggccgtggccgacctgctgctgaccagcaccgtgctgcccttcagcgccatcttcgaggtgctgggctactgggccttcggcagagtgttctgcaacatctgggccgccgtggacgtgctgtgctgcaccgccagcatcatgggcctgtgcatcatcagcatcgacagatacatcggcgtgagctaccccctgagataccccaccatcgtgacccagagaagaggcctgatggccctgctgtgcgtgtgggccctgagcctggtgatcagcatcggccccctgttcggctggagacagcccgcccccgaggacgagaccatctgccagatcaacgaggagcccggctacgtgctgttcagcgccctgggcagcttctacctgcccctggccatcatcctggtgatgtactgcagagtgtacgtggtggccaagagagagagcagaggcctgaagagcggcctgaagaccgacaagagcgacagcgagcaggtgaccctgagaatccacagaaagaacgcccccgccggcggcagcggcatggccagcgccaagaccaagacccacttcagcgtgagactgctgaagttcagcagagagaagaaggccgccaagaccctgggcatcgtggtgggctgcttcgtgctgtgctggctgcccttcttcctggtgatgcccatcggcagcttcttccccgacttcaagcccagcgagaccgtgttcaagatcgtgttctggctgggctacctgaacagctgcatcaaccccatcatctacccctgcagcagccaggagttcaagaaggccttccagaacgtgctgagaatccagtgcctgtgcagaaagcagagcagcaagcacgccctgggctacaccctgcacccccccagccaggccgtggagggccagcacaaggacatggtgagaatccccgtgggcagcagagagaccttctacagaatcagcaagaccgacggcgtgtgcgagtggaagttcttcagcagcatgcccagaggcagcgccagaatcaccgtgagcaaggaccagagcagctgcaccaccgccagaagcagcggcttctag

SEQ ID NO: 72242 - DNA, 1563 bp, Artificial Sequence
  Description of Artificial Sequence: Synthetic coding sequence
atgaaccccgacctggacaccggccacaacaccagcgcccccgcccactggggcgagctgaagaacgccaacttcaccggccccaaccagaccagcagcaacagcaccctgccccagctggacatcaccagagccatcagcgtgggcctggtgctgggcgccttcatcctgttcgccatcgtgggcaacatcctggtgatcctgagcgtggcctgcaacagacacctgagaacccccaccaactacttcatcgtgaacctggccatggccgacctgctgctgagcttcaccgtgctgcccttcagcgccgccctggaggtgctgggctactgggtgctgggcagaatcttctgcgacatctgggccgccgtggacgtgctgtgctgcaccgccagcatcctgagcctgtgcgccatcagcatcgacagatacatcggcgtgagatacagcctgcagtaccccaccctggtgaccagaagaaaggccatcctggccctgctgagcgtgtgggtgctgagcaccgtgatcagcatcggccccctgctgggctggaaggagcccgcccccaacgacgacaaggagtgcggcgtgaccgaggagcccttctacgccctgttcagcagcctgggcagcttctacatccccctggccgtgatcctggtgatgtactgcagagtgtacatcgtggccaagagaaccaccaagaacctggaggccggcgtgatgaaggagatgagcaacagcaaggagctgaccctgagaatccacagcaagaacttccacgaggacaccctgagcagcaccaaggccaagggccacaaccccagaagcagcatcgccgtgaagctgttcaagttcagcagagagaagaaggccgccaagaccctgggcatcgtggtgggcatgttcatcctgtgctggctgcccttcttcatcgccctgcccctgggcagcctgttcagcaccctgaagccccccgacgccgtgttcaaggtggtgttctggctgggctacttcaacagctgcctgaaccccatcatctacccctgcagcagcaaggagttcaagagagccttcgtgagaatcctgggctgccagtgcagaggcagaggcagaagaagaagaagaagaagaagaagactgggcggctgcgcctacacctacagaccctggaccagaggcggcagcctggagagaagccagagcagaaaggacagcctggacgacagcggcagctgcctgagcggcagccagagaaccctgcccagcgccagccccagccccggctacctgggcagaggcgcccccccccccgtggagctgtgcgccttccccgagtggaaggcccccggcgccctgctgagcctgcccgcccccgagccccccggcagaagaggcagacacgacagcggccccctgttcaccttcaagctgctgaccgagcccgagagccccggcaccgacggcggcgccagcaacggcggctgcgaggccgccgccgacgtggccaacggccagcccggcttcaagagcaacatgcccctggcccccggccagttctag

SEQ ID NO: 72243 - DNA, 1719 bp, Artificial Sequence
  Description of Artificial Sequence: Synthetic coding sequence
atgaccttcagagacctgctgagcgtgagcttcgagggccccagacccgacagcagcgccggcggcagcagcgccggcggcggcggcggcagcgccggcggcgccgcccccagcgagggccccgccgtgggcggcgtgcccggcggcgccggcggcggcggcggcgtggtgggcgccggcagcggcgaggacaacagaagcagcgccggcgagcccggcagcgccggcgccggcggcgacgtgaacggcaccgccgccgtgggcggcctggtggtgagcgcccagggcgtgggcgtgggcgtgttcctggccgccttcatcctgatggccgtggccggcaacctgctggtgatcctgagcgtggcctgcaacagacacctgcagaccgtgaccaactacttcatcgtgaacctggccgtggccgacctgctgctgagcgccaccgtgctgcccttcagcgccaccatggaggtgctgggcttctgggccttcggcagagccttctgcgacgtgtgggccgccgtggacgtgctgtgctgcaccgccagcatcctgagcctgtgcaccatcagcgtggacagatacgtgggcgtgagacacagcctgaagtaccccgccatcatgaccgagagaaaggccgccgccatcctggccctgctgtgggtggtggccctggtggtgagcgtgggccccctgctgggctggaaggagcccgtgccccccgacgagagattctgcggcatcaccgaggaggccggctacgccgtgttcagcagcgtgtgcagcttctacctgcccatggccgtgatcgtggtgatgtactgcagagtgtacgtggtggccagaagcaccaccagaagcctggaggccggcgtgaagagagagagaggcaaggccagcgaggtggtgctgagaatccactgcagaggcgccgccaccggcgccgacggcgcccacggcatgagaagcgccaagggccacaccttcagaagcagcctgagcgtgagactgctgaagttcagcagagagaagaaggccgccaagaccctggccatcgtggtgggcgtgttcgtgctgtgctggttccccttcttcttcgtgctgcccctgggcagcctgttcccccagctgaagcccagcgagggcgtgttcaaggtgatcttctggctgggctacttcaacagctgcgtgaaccccctgatctacccctgcagcagcagagagttcaagagagccttcctgagactgctgagatgccagtgcagaagaagaagaagaagaagacccctgtggagagtgtacggccaccactggagagccagcaccagcggcctgagacaggactgcgcccccagcagcggcgacgccccccccggcgcccccctggccctgaccgccctgcccgaccccgaccccgagccccccggcacccccgagatgcaggcccccgtggccagcagaagaaagccccccagcgccttcagagagtggagactgctgggccccttcagaagacccaccacccagctgagagccaaggtgagcagcctgagccacaagatcagagccggcggcgcccagagagccgaggccgcctgcgcccagagaagcgaggtggaggccgtgagcctgggcgtgccccacgaggtggccgagggcgccacctgccaggcctacgagctggccgactacagcaacctgagagagaccgacatctag

SEQ ID NO: 72244 - DNA, 1344 bp, Artificial Sequence
  Description of Artificial Sequence: Synthetic coding sequence
atggaccaccaggacccctacagcgtgcaggccaccgccgccatcgccgccgccatcaccttcctgatcctgttcaccatcttcggcaacgccctggtgatcctggccgtgctgaccagcagaagcctgagagccccccagaacctgttcctggtgagcctggccgccgccgacatcctggtggccaccctgatcatccccttcagcctggccaacgagctgctgggctactggtacttcagaagaacctggtgcgaggtgtacctggccctggacgtgctgttctgcaccagcagcatcgtgcacctgtgcgccatcagcctggacagatactgggccgtgagcagagccctggagtacaacagcaagagaacccccagaagaatcaagtgcatcatcctgaccgtgtggctgatcgccgccgtgatcagcctgccccccctgatctacaagggcgaccagggcccccagcccagaggcagaccccagtgcaagctgaaccaggaggcctggtacatcctggccagcagcatcggcagcttcttcgccccctgcctgatcatgatcctggtgtacctgagaatctacctgatcgccaagagaagcaacagaagaggccccagagccaagggcggccccggccagggcgagagcaagcagcccagacccgaccacggcggcgccctggccagcgccaagctgcccgccctggccagcgtggccagcgccagagaggtgaacggccacagcaagagcaccggcgagaaggaggagggcgagacccccgaggacaccggcaccagagccctgccccccagctgggccgccctgcccaacagcggccagggccagaaggagggcgtgtgcggcgccagccccgaggacgaggccgaggaggaggaggaggaggaggaggagtgcgagccccaggccgtgcccgtgagccccgccagcgcctgcagcccccccctgcagcagccccagggcagcagagtgctggccaccctgagaggccaggtgctgctgggcagaggcgtgggcgccatcggcggccagtggtggagaagaagagcccagctgaccagagagaagagattcaccttcgtgctggccgtggtgatcggcgtgttcgtgctgtgctggttccccttcttcttcagctacagcctgggcgccatctgccccaagcactgcaaggtgccccacggcctgttccagttcttcttctggatcggctactgcaacagcagcctgaaccccgtgatctacaccatcttcaaccaggacttcagaagagccttcagaagaatcctgtgcagaccctggacccagaccgcctggtag

SEQ ID NO: 72245 - DNA, 1389 bp, Artificial Sequence
  Description of Artificial Sequence: Synthetic coding sequence
atggccagccccgccctggccgccgccctggccgtggccgccgccgccggccccaacgccagcggcgccggcgagagaggcagcggcggcgtggccaacgccagcggcgccagctggggcccccccagaggccagtacagcgccggcgccgtggccggcctggccgccgtggtgggcttcctgatcgtgttcaccgtggtgggcaacgtgctggtggtgatcgccgtgctgaccagcagagccctgagagccccccagaacctgttcctggtgagcctggccagcgccgacatcctggtggccaccctggtgatgcccttcagcctggccaacgagctgatggcctactggtacttcggccaggtgtggtgcggcgtgtacctggccctggacgtgctgttctgcaccagcagcatcgtgcacctgtgcgccatcagcctggacagatactggagcgtgacccaggccgtggagtacaacctgaagagaacccccagaagagtgaaggccaccatcgtggccgtgtggctgatcagcgccgtgatcagcttcccccccctggtgagcctgtacagacagcccgacggcgccgcctacccccagtgcggcctgaacgacgagacctggtacatcctgagcagctgcatcggcagcttcttcgccccctgcctgatcatgggcctggtgtacgccagaatctacagagtggccaagctgagaaccagaaccctgagcgagaagagagcccccgtgggccccgacggcgccagccccaccaccgagaacggcctgggcgccgccgccggcgccggcgagaacggccactgcgcccccccccccgccgacgtggagcccgacgagagcagcgccgccgccgagagaagaagaagaagaggcgccctgagaagaggcggcagaagaagagccggcgccgagggcggcgccggcggcgccgacggccagggcgccggccccggcgccgccgagagcggcgccctgaccgccagcagaagccccggccccggcggcagactgagcagagccagcagcagaagcgtggagttcttcctgagcagaagaagaagagccagaagcagcgtgtgcagaagaaaggtggcccaggccagagagaagagattcaccttcgtgctggccgtggtgatgggcgtgttcgtgctgtgctggttccccttcttcttcagctacagcctgtacggcatctgcagagaggcctgccaggtgcccggccccctgttcaagttcttcttctggatcggctactgcaacagcagcctgaaccccgtgatctacaccgtgttcaaccaggacttcagaagaagcttcaagcacatcctgttcagaagaagaagaagaggcttcagacagtag

SEQ ID NO: 72246 - DNA, 2070 bp, Artificial Sequence
  Description of Artificial Sequence: Synthetic coding sequence
atggccgacctggaggccgtgctggccgacgtgagctacctgatggccatggagaagagcaaggccacccccgccgccagagccagcaagaagatcctgctgcccgagcccagcatcagaagcgtgatgcagaagtacctggaggacagaggcgaggtgaccttcgagaagatcttcagccagaagctgggctacctgctgttcagagacttctgcctgaaccacctggaggaggccagacccctggtggagttctacgaggagatcaagaagtacgagaagctggagaccgaggaggagagagtggccagaagcagagagatcttcgacagctacatcatgaaggagctgctggcctgcagccaccccttcagcaagagcgccaccgagcacgtgcagggccacctgggcaagaagcaggtgccccccgacctgttccagccctacatcgaggagatctgccagaacctgagaggcgacgtgttccagaagttcatcgagagcgacaagttcaccagattctgccagtggaagaacgtggagctgaacatccacctgaccatgaacgacttcagcgtgcacagaatcatcggcagaggcggcttcggcgaggtgtacggctgcagaaaggccgacaccggcaagatgtacgccatgaagtgcctggacaagaagagaatcaagatgaagcagggcgagaccctggccctgaacgagagaatcatgctgagcctggtgagcaccggcgactgccccttcatcgtgtgcatgagctacgccttccacacccccgacaagctgagcttcatcctggacctgatgaacggcggcgacctgcactaccacctgagccagcacggcgtgttcagcgaggccgacatgagattctacgccgccgagatcatcctgggcctggagcacatgcacaacagattcgtggtgtacagagacctgaagcccgccaacatcctgctggacgagcacggccacgtgagaatcagcgacctgggcctggcctgcgacttcagcaagaagaagccccacgccagcgtgggcacccacggctacatggcccccgaggtgctgcagaagggcgtggcctacgacagcagcgccgactggttcagcctgggctgcatgctgttcaagctgctgagaggccacagccccttcagacagcacaagaccaaggacaagcacgagatcgacagaatgaccctgaccatggccgtggagctgcccgacagcttcagccccgagctgagaagcctgctggagggcctgctgcagagagacgtgaacagaagactgggctgcctgggcagaggcgcccaggaggtgaaggagagccccttcttcagaagcctggactggcagatggtgttcctgcagaagtaccccccccccctgatcccccccagaggcgaggtgaacgccgccgacgccttcgacatcggcagcttcgacgaggaggacaccaagggcatcaagctgctggacagcgaccaggagctgtacagaaacttccccctgaccatcagcgagagatggcagcaggaggtggccgagaccgtgttcgacaccatcaacgccgagaccgacagactggaggccagaaagaaggccaagaacaagcagctgggccacgaggaggactacgccctgggcaaggactgcatcatgcacggctacatgagcaagatgggcaaccccttcctgacccagtggcagagaagatacttctacctgttccccaacagactggagtggagaggcgagggcgaggccccccagagcctgctgaccatggaggagatccagagcgtggaggagacccagatcaaggagagaaagtgcctgctgctgaagatcagaggcggcaagcagttcatcctgcagtgcgacagcgaccccgagctggtgcagtggaagaaggagctgagagacgcctacagagaggcccagcagctggtgcagagagtgcccaagatgaagaacaagcccagaagccccgtggtggagctgagcaaggtgcccctggtgcagagaggcagcgccaacggcctgtag

SEQ ID NO: 72247 - DNA, 2067 bp, Artificial Sequence
  Description of Artificial Sequence: Synthetic coding sequence
atggccgacctggaggccgtgctggccgacgtgagctacctgatggccatggagaagagcaaggccacccccgccgccagagccagcaagagaatcgtgctgcccgagcccagcatcagaagcgtgatgcagaagtacctggccgagagaaacgagatcaccttcgacaagatcttcaaccagaagatcggcttcctgctgttcaaggacttctgcctgaacgagatcaacgaggccgtgccccaggtgaagttctacgaggagatcaaggagtacgagaagctggacaacgaggaggacagactgtgcagaagcagacagatctacgacgcctacatcatgaaggagctgctgagctgcagccaccccttcagcaagcaggccgtggagcacgtgcagagccacctgagcaagaagcaggtgaccagcaccctgttccagccctacatcgaggagatctgcgagagcctgagaggcgacatcttccagaagttcatggagagcgacaagttcaccagattctgccagtggaagaacgtggagctgaacatccacctgaccatgaacgagttcagcgtgcacagaatcatcggcagaggcggcttcggcgaggtgtacggctgcagaaaggccgacaccggcaagatgtacgccatgaagtgcctggacaagaagagaatcaagatgaagcagggcgagaccctggccctgaacgagagaatcatgctgagcctggtgagcaccggcgactgccccttcatcgtgtgcatgacctacgccttccacacccccgacaagctgtgcttcatcctggacctgatgaacggcggcgacctgcactaccacctgagccagcacggcgtgttcagcgagaaggagatgagattctacgccaccgagatcatcctgggcctggagcacatgcacaacagattcgtggtgtacagagacctgaagcccgccaacatcctgctggacgagcacggccacgccagaatcagcgacctgggcctggcctgcgacttcagcaagaagaagccccacgccagcgtgggcacccacggctacatggcccccgaggtgctgcagaagggcaccgcctacgacagcagcgccgactggttcagcctgggctgcatgctgttcaagctgctgagaggccacagccccttcagacagcacaagaccaaggacaagcacgagatcgacagaatgaccctgaccgtgaacgtggagctgcccgacaccttcagccccgagctgaagagcctgctggagggcctgctgcagagagacgtgagcaagagactgggctgccacggcggcggcagccaggaggtgaaggagcacagcttcttcaagggcgtggactggcagcacgtgtacctgcagaagtaccccccccccctgatcccccccagaggcgaggtgaacgccgccgacgccttcgacatcggcagcttcgacgaggaggacaccaagggcatcaagctgctggactgcgaccaggagctgtacaagaacttccccctggtgatcagcgagagatggcagcaggaggtgaccgagaccgtgtacgaggccgtgaacgccgacaccgacaagatcgaggccagaaagagagccaagaacaagcagctgggccacgaggaggactacgccctgggcaaggactgcatcatgcacggctacatgctgaagctgggcaaccccttcctgacccagtggcagagaagatacttctacctgttccccaacagactggagtggagaggcgagggcgagagcagacagaacctgctgaccatggagcagatcctgagcgtggaggagacccagatcaaggacaagaagtgcatcctgttcagaatcaagggcggcaagcagttcgtgctgcagtgcgagagcgaccccgagttcgtgcagtggaagaaggagctgaacgagaccttcaaggaggcccagagactgctgagaagagcccccaagttcctgaacaagcccagaagcggcaccgtggagctgcccaagcccagcctgtgccacagaaacagcaacggcctgtag

SEQ ID NO: 72248 - DNA, 1164 bp, Artificial Sequence
  Description of Artificial Sequence: Synthetic coding sequence
atggccgacctggaggccgtgctggccgacgtgagctacctgatggccatggagaagagcaaggccacccccgccgccagagccagcaagagaatcgtgctgcccgagcccagcatcagaagcgtgatgcagaagtacctggccgagagaaacgagatcaccttcgacaagatcttcaaccagaagatcggcttcctgctgttcaaggacttctgcctgaacgagatcaacgaggccgtgccccaggtgaagttctacgaggagatcaaggagtacgagaagctggacaacgaggaggacagactgtgcagaagcagacagatctacgacgcctacatcatgaaggagctgctgagctgcagccaccccttcagcaagcaggccgtggagcacgtgcagagccacctgagcaagaagcaggtgaccagcaccctgttccagccctacatcgaggagatctgcgagagcctgagaggcgacatcttccagaagttcatggagagcgacaagttcaccagattctgccagtggaagaacgtggagctgaacatccacctgaccatgaacgagttcagcgtgcacagaatcatcggcagaggcggcttcggcgaggtgtacggctgcagaaaggccgacaccggcaagatgtacgccatgaagtgcctggacaagaagagaatcaagatgaagcagggcgagaccctggccctgaacgagagaatcatgctgagcctggtgagcaccggcgactgccccttcatcgtgtgcatgacctacgccttccacacccccgacaagctgtgcttcatcctggacctgatgaacggcggcgacctgcactaccacctgagccagcacggcgtgttcagcgagaaggagatgagattctacgccaccgagatcatcctgggcctggagcacatgcacaacagattcgtggtgtacagagacctgaagcccgccaacatcctgctggacgagcacggccacgccagaatcagcgacctgggcctggcctgcgacttcagcaagaagaagccccacgccagcgtgggcacccacggctacatggcccccgaggtgctgcagaagggcaccgcctacgacagcagcgccgactggttcagcctgggctgcatgctgttcaagctgctgagaggctag

SEQ ID NO: 72249 - DNA, 1434 bp, Artificial Sequence
  Description of Artificial Sequence: Synthetic coding sequence
atgggcgccggcgtgctggtgctgggcgccagcgagcccggcaacctgagcagcgccgcccccctgcccgacggcgccgccaccgccgccagactgctggtgcccgccagcccccccgccagcctgctgccccccgccagcgagagccccgagcccctgagccagcagtggaccgccggcatgggcctgctgatggccctgatcgtgctgctgatcgtggccggcaacgtgctggtgatcgtggccatcgccaagacccccagactgcagaccctgaccaacctgttcatcatgagcctggccagcgccgacctggtgatgggcctgctggtggtgcccttcggcgccaccatcgtggtgtggggcagatgggagtacggcagcttcttctgcgagctgtggaccagcgtggacgtgctgtgcgtgaccgccagcatcgagaccctgtgcgtgatcgccctggacagatacctggccatcaccagccccttcagataccagagcctgctgaccagagccagagccagaggcctggtgtgcaccgtgtgggccatcagcgccctggtgagcttcctgcccatcctgatgcactggtggagagccgagagcgacgaggccagaagatgctacaacgaccccaagtgctgcgacttcgtgaccaacagagcctacgccatcgccagcagcgtggtgagcttctacgtgcccctgtgcatcatggccttcgtgtacctgagagtgttcagagaggcccagaagcaggtgaagaagatcgacagctgcgagagaagattcctgggcggccccgccagaccccccagccccagccccagccccgtgcccgcccccgcccccccccccggcccccccagacccgccgccgccgccgccaccgcccccctggccaacggcagagccggcaagagaagacccagcagactggtggccctgagagagcagaaggccctgaagaccctgggcatcatcatgggcgtgttcaccctgtgctggctgcccttcttcctggccaacgtggtgaaggccttccacagagagctggtgcccgacagactgttcgtgttcttcaactggctgggctacgccaacagcgccttcaaccccatcatctactgcagaagccccgacttcagaaaggccttccagggcctgctgtgctgcgccagaagagccgccagaagaagacacgccacccacggcgacagacccagagccagcggctgcctggccagacccggccccccccccagccccggcgccgccagcgacgacgacgacgacgacgtggtgggcgccaccccccccgccagactgctggagccctgggccggctgcaacggcggcgccgccgccgacagcgacagcagcctggacgagccctgcagacccggcttcgccagcgagagcaaggtgtag

SEQ ID NO: 72250 - DNA, 1242 bp, Artificial Sequence
  Description of Artificial Sequence: Synthetic coding sequence
atgggccagcccggcaacggcagcgccttcctgctggcccccaacggcagccacgcccccgaccacgacgtgacccaggagagagacgaggtgtgggtggtgggcatgggcatcgtgatgagcctgatcgtgctggccatcgtgttcggcaacgtgctggtgatcaccgccatcgccaagttcgagagactgcagaccgtgaccaactacttcatcaccagcctggcctgcgccgacctggtgatgggcctggccgtggtgcccttcggcgccgcccacatcctgatgaagatgtggaccttcggcaacttctggtgcgagttctggaccagcatcgacgtgctgtgcgtgaccgccagcatcgagaccctgtgcgtgatcgccgtggacagatacttcgccatcaccagccccttcaagtaccagagcctgctgaccaagaacaaggccagagtgatcatcctgatggtgtggatcgtgagcggcctgaccagcttcctgcccatccagatgcactggtacagagccacccaccaggaggccatcaactgctacgccaacgagacctgctgcgacttcttcaccaaccaggcctacgccatcgccagcagcatcgtgagcttctacgtgcccctggtgatcatggtgttcgtgtacagcagagtgttccaggaggccaagagacagctgcagaagatcgacaagagcgagggcagattccacgtgcagaacctgagccaggtggagcaggacggcagaaccggccacggcctgagaagaagcagcaagttctgcctgaaggagcacaaggccctgaagaccctgggcatcatcatgggcaccttcaccctgtgctggctgcccttcttcatcgtgaacatcgtgcacgtgatccaggacaacctgatcagaaaggaggtgtacatcctgctgaactggatcggctacgtgaacagcggcttcaaccccctgatctactgcagaagccccgacttcagaatcgccttccaggagctgctgtgcctgagaagaagcagcctgaaggcctacggcaacggctacagcagcaacggcaacaccggcgagcagagcggctaccacgtggagcaggagaaggagaacaagctgctgtgcgaggacctgcccggcaccgaggacttcgtgggccaccagggcaccgtgcccagcgacaacatcgacagccagggcagaaactgcagcaccaacgacagcctgctgtag

SEQ ID NO: 72251 - DNA, 1227 bp, Artificial Sequence
  Description of Artificial Sequence: Synthetic coding sequence
atggccccctggccccacgagaacagcagcctggccccctggcccgacctgcccaccctggcccccaacaccgccaacaccagcggcctgcccggcgtgccctgggaggccgccctggccggcgccctgctggccctggccgtgctggccaccgtgggcggcaacctgctggtgatcgtggccatcgcctggacccccagactgcagaccatgaccaacgtgttcgtgaccagcctggccgccgccgacctggtgatgggcctgctggtggtgccccccgccgccaccctggccctgaccggccactggcccctgggcgccaccggctgcgagctgtggaccagcgtggacgtgctgtgcgtgaccgccagcatcgagaccctgtgcgccctggccgtggacagatacctggccgtgaccaaccccctgagatacggcgccctggtgaccaagagatgcgccagaaccgccgtggtgctggtgtgggtggtgagcgccgccgtgagcttcgcccccatcatgagccagtggtggagagtgggcgccgacgccgaggcccagagatgccacagcaaccccagatgctgcgccttcgccagcaacatgccctacgtgctgctgagcagcagcgtgagcttctacctgcccctgctggtgatgctgttcgtgtacgccagagtgttcgtggtggccaccagacagctgagactgctgagaggcgagctgggcagattcccccccgaggagagcccccccgcccccagcagaagcctggcccccgcccccgtgggcacctgcgccccccccgagggcgtgcccgcctgcggcagaagacccgccagactgctgcccctgagagagcacagagccctgtgcaccctgggcctgatcatgggcaccttcaccctgtgctggctgcccttcttcctggccaacgtgctgagagccctgggcggccccagcctggtgcccggccccgccttcctggccctgaactggctgggctacgccaacagcgccttcaaccccctgatctactgcagaagccccgacttcagaagcgccttcagaagactgctgtgcagatgcggcagaagactgccccccgagccctgcgccgccgccagacccgccctgttccccagcggcgtgcccgccgccagaagcagccccgcccagcccagactgtgccagagactggacggcgccagctggggcgtgagctag

SEQ ID NO: 72252 - DNA, 1044 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacggcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcgagcccggcgaggagggccccaccgccggcgagggcttcgacaaggtgagagaggccgaggacagcccccagcacatgtag

SEQ ID NO: 72253 - DNA, 702 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacggcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtggtggaggagagcagaagaagcagaaagagaccctgcgagcaggaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacactag

SEQ ID NO: 72254 - DNA, 402 bp, Artificial Sequence
  Description of Artificial Sequence: Synthetic coding sequence
atgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcgagcccggcgaggagggccccaccgccggcagcgtgggcggcagcggcctgggcaccctggccctggccctgggcatcctgggcggcctgggcaccgccgccctgctgatcggcgtgatcctgtggcagagaagacagagaagaggcgaggagagaaaggcccccgagaaccaggaggaggaggaggagagagccgagctgaaccagagcgaggagcccgaggccggcgagagcagcaccggcggcccctag

SEQ ID NO: 72255 - DNA, 366 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacggcagcctgttcctgcccgccgtgggcatccaggacgagggcatcttcagatgccaggccatgaacagaaacggcaaggagaccaagagcaactggtggtggagccagaaggtggagcagtag

SEQ ID NO: 72256 - DNA, 1029 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgggcggcggcccctgggacagcgtggccagagtgctgcccaacggcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacgtgagcgacctggagagaggcgccggcagaaccagaagaggcggcgccaactgcagactgtgcggcagaatcagagccggcaacagcagccccggccccggcgaccccggcagacccggcgacagcagacccgcccactggggccacctggtggccaaggccgccacccccagaagaggcgaggagggccccagaaagcccggcggcagaggcggcgcctgcagaaccgagagcgtgggcggcacctag

SEQ ID NO: 72257 - DNA, 885 bp, Artificial Sequence
  Description of Artificial Sequence: Synthetic coding sequence
atgaacagaaacggcaaggagaccaagagcaactacagagtgagagtgtaccagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcggcagcgtgggcggcagcggcctgggcaccctggccctggccctgggcatcctgggcggcctgggcaccgccgccctgctgatcggcgtgatcctgtggcagagaagacagagaagaggcgaggagagaaaggcccccgagaaccaggaggaggaggaggagagagccgagctgaaccagagcgaggagcccgaggccggcgagagcagcaccggcggcccctag

SEQ ID NO: 72258 - DNA, 1308 bp, Artificial Sequence
  Description of Artificial Sequence: Synthetic coding sequence
atgggcgccggcgagagagtgcaggccccccccagagccgaggccaccgccggcagaggcgccgacagagccagaaccctggagggcagcagaatggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacggcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcgagcccggcgaggagggccccaccgccggcagcgtgggcggcagcggcctgggcaccctggccctggccctgggcatcctgggcggcctgggcaccgccgccctgctgatcggcgtgatcctgtggcagagaagacagagaagaggcgaggagagaaaggcccccgagaaccaggaggaggaggaggagagagccgagctgaaccagagcgaggagcccgaggccggcgagagcagcaccggcggcccctag

SEQ ID NO: 72259 - DNA, 1215 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacggcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcgagcccggcgaggagggccccaccgccggcagcgtgggcggcagcggcctgggcaccctggccctggccctgggcatcctgggcggcctgggcaccgccgccctgctgatcggcgtgatcctgtggcagagaagacagagaagaggcgaggagagaaaggcccccgagaaccaggaggaggaggaggagagagccgagctgaaccagagcgaggagcccgaggccggcgagagcagcaccggcggcccctag

SEQ ID NO: 72260 - DNA, 1044 bp, Artificial Sequence; identical to SEQ ID NO: 72252
  Description of Artificial Sequence: Synthetic coding sequence

SEQ ID NO: 72261 - DNA, 1029 bp, Artificial Sequence; identical to SEQ ID NO: 72256
  Description of Artificial Sequence: Synthetic coding sequence

SEQ ID NO: 72262 - DNA, 1029 bp, Artificial Sequence; identical to SEQ ID NO: 72256
  Description of Artificial Sequence: Synthetic coding sequence

SEQ ID NO: 72263 - DNA, 702 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtggtggaggagagcagaagaagcagaaagagaccctgcgagcaggaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacactag

SEQ ID NO: 72264 - DNA, 705 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacggcagcctgttcctgcccgccgtgggcatccaggacgagggcatcttcagatgccaggccatgaacagaaacggcaaggagaccaagagcaactacagaagcctgagaaccttcaccatcaccgccagcgactggatcttcccccccagcgagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagatag

SEQ ID NO: 72265 - DNA, 705 bp, Artificial Sequence; identical to SEQ ID NO: 72264
  Description of Artificial Sequence: Synthetic coding sequence

SEQ ID NO: 72266 - DNA, 702 bp, Artificial Sequence; identical to SEQ ID NO: 72253
  Description of Artificial Sequence: Synthetic coding sequence

SEQ ID NO: 72267 - DNA, 1215 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcgagcccggcgaggagggccccaccgccggcagcgtgggcggcagcggcctgggcaccctggccctggccctgggcatcctgggcggcctgggcaccgccgccctgctgatcggcgtgatcctgtggcagagaagacagagaagaggcgaggagagaaaggcccccgagaaccaggaggaggaggaggagagagccgagctgaaccagagcgaggagcccgaggccggcgagagcagcaccggcggcccctag

SEQ ID NO: 72268 - DNA, 1044 bp, Artificial Sequence; identical to SEQ ID NO: 72252
  Description of Artificial Sequence: Synthetic coding sequence

SEQ ID NO: 72269 - DNA, 702 bp, Artificial Sequence; identical to SEQ ID NO: 72253
  Description of Artificial Sequence: Synthetic coding sequence

SEQ ID NO: 72270 - DNA, 1215 bp, Artificial Sequence; identical to SEQ ID NO: 72259
  Description of Artificial Sequence: Synthetic coding sequence

SEQ ID NO: 72271 - DNA, 705 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagaagcctgagaaccttcaccatcaccgccagcgactggatcttcccccccagcgagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagatag

SEQ ID NO: 72272 - DNA, 1092 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacggcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtggtggaggagagcagaagaagcagaaagagaccctgcgagcaggaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcgagcccggcgaggagggccccaccgccggcgagggcttcgacaaggtgagagaggccgaggacagcccccagcacatgtag

SEQ ID NO: 72273 - DNA, 1029 bp, Artificial Sequence; identical to SEQ ID NO: 72256
  Description of Artificial Sequence: Synthetic coding sequence

SEQ ID NO: 72274 - DNA, 702 bp, Artificial Sequence; identical to SEQ ID NO: 72253
  Description of Artificial Sequence: Synthetic coding sequence

SEQ ID NO: 72275 - DNA, 1029 bp, Artificial Sequence; identical to SEQ ID NO: 72256
  Description of Artificial Sequence: Synthetic coding sequence

SEQ ID NO: 72276 - DNA, 705 bp, Artificial Sequence; identical to SEQ ID NO: 72264
  Description of Artificial Sequence: Synthetic coding sequence

SEQ ID NO: 72277 - DNA, 1215 bp, Artificial Sequence; identical to SEQ ID NO: 72259
  Description of Artificial Sequence: Synthetic coding sequence

SEQ ID NO: 72278 - DNA, 1029 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacgtgagcgacctggagagaggcgccggcagaaccagaagaggcggcgccaactgcagactgtgcggcagaatcagagccggcaacagcagccccggccccggcgaccccggcagacccggcgacagcagacccgcccactggggccacctggtggccaaggccgccacccccagaagaggcgaggagggccccagaaagcccggcggcagaggcggcgcctgcagaaccgagagcgtgggcggcacctag

SEQ ID NO: 72279 - DNA, 1044 bp, Artificial Sequence; identical to SEQ ID NO: 72252
  Description of Artificial Sequence: Synthetic coding sequence

SEQ ID NO: 72280 - DNA, 705 bp, Artificial Sequence; identical to SEQ ID NO: 72264
  Description of Artificial Sequence: Synthetic coding sequence

SEQ ID NO: 72281 - DNA, 1215 bp, Artificial Sequence; identical to SEQ ID NO: 72259
  Description of Artificial Sequence: Synthetic coding sequence

SEQ ID NO: 72282 - DNA, 1044 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcgagcccggcgaggagggccccaccgccggcgagggcttcgacaaggtgagagaggccgaggacagcccccagcacatgtag

SEQ ID NO: 72283 - DNA, 702 bp, Artificial Sequence; identical to SEQ ID NO: 72253
  Description of Artificial Sequence: Synthetic coding sequence

SEQ ID NO: 72284 - DNA, 1044 bp, Artificial Sequence; identical to SEQ ID NO: 72252
  Description of Artificial Sequence: Synthetic coding sequence

SEQ ID NO: 72285 - DNA, 705 bp, Artificial Sequence; identical to SEQ ID NO: 72264
  Description of Artificial Sequence: Synthetic coding sequence

SEQ ID NO: 72286 - DNA, 1215 bp, Artificial Sequence; identical to SEQ ID NO: 72259
  Description of Artificial Sequence: Synthetic coding sequence

SEQ ID NO: 72287 - DNA, 387 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacggcagcctgttcctgcccgccgtgggcatccaggacgagggcatcttcagatgccaggccatgaacagaaacggcaaggagaccaagagcaactacagagtgagagtgtaccagttcgagaacctgcacaactacagcctgtag

SEQ ID NO: 72288 - DNA, 462 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacggcagcctgttcctgcccgccgtgggcatccaggacgagggcatcctgggcggcctgggcaccgccgccctgctgatcggcgtgatcctgtggcagagaagacagagaagaggcgaggagagaaaggcccccgagaaccaggaggaggaggaggagagagccgagctgaaccagagcgaggagcccgaggccggcgagagcagcaccggcggcccctag

SEQ ID NO: 72289 - DNA, 885 bp, Artificial Sequence; identical to SEQ ID NO: 72257
  Description of Artificial Sequence: Synthetic coding sequence

SEQ ID NO: 72290 - DNA, 885 bp, Artificial Sequence; identical to SEQ ID NO: 72257
  Description of Artificial Sequence: Synthetic coding sequence

SEQ ID NO: 72291 - DNA, 366 bp, Artificial Sequence; identical to SEQ ID NO: 72255
  Description of Artificial Sequence: Synthetic coding sequence

SEQ ID NO: 72292 - DNA, 1308 bp, Artificial Sequence; identical to SEQ ID NO: 72258
  Description of Artificial Sequence: Synthetic coding sequence

SEQ ID NO: 72293 - DNA, 1092 bp, Artificial Sequence; identical to SEQ ID NO: 72272
  Description of Artificial Sequence: Synthetic coding sequence

SEQ ID NO: 72294 - DNA, 402 bp, Artificial Sequence; identical to SEQ ID NO: 72254
  Description of Artificial Sequence: Synthetic coding sequence

SEQ ID NO: 72295 - DNA, 387 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagagtgagagtgtaccagttcgagaacctgcacaactacagcctgtag

SEQ ID NO: 72296 - DNA, 462 bp, Artificial Sequence; identical to SEQ ID NO: 72288
  Description of Artificial Sequence: Synthetic coding sequence

SEQ ID NO: 72297 - DNA, 1308 bp, Artificial Sequence; identical to SEQ ID NO: 72258
  Description of Artificial Sequence: Synthetic coding sequence

SEQ ID NO: 72298 - DNA, 366 bp, Artificial Sequence; identical to SEQ ID NO: 72255
  Description of Artificial Sequence: Synthetic coding sequence

SEQ ID NO: 72299 - DNA, 387 bp, Artificial Sequence; identical to SEQ ID NO: 72287
  Description of Artificial Sequence: Synthetic coding sequence

SEQ ID NO: 72300 - DNA, 885 bp, Artificial Sequence; identical to SEQ ID NO: 72257
  Description of Artificial Sequence: Synthetic coding sequence

SEQ ID NO: 72301 - DNA, 366 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactggtggtggagccagaaggtggagcagtag

SEQ ID NO: 72302 - DNA, 462 bp, Artificial Sequence; identical to SEQ ID NO: 72288
  Description of Artificial Sequence: Synthetic coding sequence

SEQ ID NO: 72303 - DNA, 1308 bp, Artificial Sequence; identical to SEQ ID NO: 72258
  Description of Artificial Sequence: Synthetic coding sequence

SEQ ID NO: 72304 - DNA, 366 bp, Artificial Sequence; identical to SEQ ID NO: 72255
  Description of Artificial Sequence: Synthetic coding sequence

SEQ ID NO: 72305 - DNA, 402 bp, Artificial Sequence; identical to SEQ ID NO: 72254
  Description of Artificial Sequence: Synthetic coding sequence

SEQ ID NO: 72306 - DNA, 885 bp, Artificial Sequence; identical to SEQ ID NO: 72257
  Description of Artificial Sequence: Synthetic coding sequence

SEQ ID NO: 72307 - DNA, 402 bp, Artificial Sequence; identical to SEQ ID NO: 72254
  Description of Artificial Sequence: Synthetic coding sequence

SEQ ID NO: 72308 - DNA, 1092 bp, Artificial Sequence; identical to SEQ ID NO: 72272
  Description of Artificial Sequence: Synthetic coding sequence

SEQ ID NO: 72309 - DNA, 1308 bp, Artificial Sequence
  Description of Artificial Sequence: Synthetic coding sequence
atgggcgccggcgagagagtgcaggccccccccagagccgaggccaccgccggcagaggcgccgacagagccagaaccctggagggcagcagaatggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcgagcccggcgaggagggccccaccgccggcagcgtgggcggcagcggcctgggcaccctggccctggccctgggcatcctgggcggcctgggcaccgccgccctgctgatcggcgtgatcctgtggcagagaagacagagaagaggcgaggagagaaaggcccccgagaaccaggaggaggaggaggagagagccgagctgaaccagagcgaggagcccgaggccggcgagagcagcaccggcggcccctag

SEQ ID NO: 72310 - DNA, 387 bp, Artificial Sequence; identical to SEQ ID NO: 72287
  Description of Artificial Sequence: Synthetic coding sequence

SEQ ID NO: 72311 - DNA, 462 bp, Artificial Sequence; identical to SEQ ID NO: 72288
  Description of Artificial Sequence: Synthetic coding sequence

SEQ ID NO: 72312 - DNA, 1092 bp, Artificial Sequence; identical to SEQ ID NO: 72272
  Description of Artificial Sequence: Synthetic coding sequence

SEQ ID NO: 72313 - DNA, 366 bp, Artificial Sequence; identical to SEQ ID NO: 72255
  Description of Artificial Sequence: Synthetic coding sequence

SEQ ID NO: 72314 - DNA, 402 bp, Artificial Sequence; identical to SEQ ID NO: 72254
  Description of Artificial Sequence: Synthetic coding sequence

SEQ ID NO: 72315 - DNA, 387 bp, Artificial Sequence; identical to SEQ ID NO: 72287
  Description of Artificial Sequence: Synthetic coding sequence

SEQ ID NO: 72316 - DNA, 1092 bp, Artificial Sequence; identical to SEQ ID NO: 72272
  Description of Artificial Sequence: Synthetic coding sequence

SEQ ID NO: 72317 - DNA, 1308 bp, Artificial Sequence; identical to SEQ ID NO: 72258
  Description of Artificial Sequence: Synthetic coding sequence

SEQ ID NO: 72318 - DNA, 462 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcctgggcggcctgggcaccgccgccctgctgatcggcgtgatcctgtggcagagaagacagagaagaggcgaggagagaaaggcccccgagaaccaggaggaggaggaggagagagccgagctgaaccagagcgaggagcccgaggccggcgagagcagcaccggcggcccctag

SEQ ID NO: 72319 - DNA, 402 bp, Artificial Sequence; identical to SEQ ID NO: 72254
  Description of Artificial Sequence: Synthetic coding sequence

SEQ ID NO: 72320 - DNA, 885 bp, Artificial Sequence; identical to SEQ ID NO: 72257
  Description of Artificial Sequence: Synthetic coding sequence

SEQ ID NO: 72321 - DNA, 1092 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtggtggaggagagcagaagaagcagaaagagaccctgcgagcaggaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcgagcccggcgaggagggccccaccgccggcgagggcttcgacaaggtgagagaggccgaggacagcccccagcacatgtag

SEQ ID NO: 72322 - DNA, 462 bp, Artificial Sequence; identical to SEQ ID NO: 72288
  Description of Artificial Sequence: Synthetic coding sequence

SEQ ID NO: 72323 - DNA, 387 bp, Artificial Sequence; identical to SEQ ID NO: 72287
  Description of Artificial Sequence: Synthetic coding sequence

SEQ ID NO: 72324 - DNA, 2460 bp, Artificial Sequence
  Description of Artificial Sequence: Synthetic coding sequence
atgcccctgaccagcgccttcagagccgtggacaacgaccccggcatcatcgtgtggagaatcgagaagatggagctggccctggtgcccgtgagcgcccacggcaacttctacgagggcgactgctacgtgatcctgagcaccagaagagtggccagcctgctgagccaggacatccacttctggatcggcaaggacagcagccaggacgagcagagctgcgccgccatctacaccacccagctggacgactacctgggcggcagccccgtgcagcacagagaggtgcagtaccacgagagcgacaccttcagaggctacttcaagcagggcatcatctacaagcagggcggcgtggccagcggcatgaagcacgtggagaccaacacctacgacgtgaagagactgctgcacgtgaagggcaagagaaacatcagagccaccgaggtggagatgagctgggacagcttcaacagaggcgacgtgttcctgctggacctgggcaaggtgatcatccagtggaacggccccgagagcaacagcggcgagagactgaaggccatgctgctggccaaggacatcagagacagagagagaggcggcagagccaagatcggcgtgatcgagggcgacaaggaggccgccagccccgagctgatgaaggtgctgcaggacaccctgggcagaagaagcatcatcaagcccaccgtgcccgacgagatcatcgaccagaagcagaagagcaccatcatgctgtaccacatcagcgacagcgccggccagctggccgtgaccgaggtggccaccagacccctggtgcaggacctgctgaaccacgacgactgctacatcctggaccagagcggcaccaagatctacgtgtggaagggcaagggcgccaccaaggccgagaagcaggccgccatgagcaaggccctgggcttcatcaagatgaagagctaccccagcagcaccaacgtggagaccgtgaacgacggcgccgagagcgccatgttcaagcagctgttccagaagtggagcgtgaaggaccagaccatgggcctgggcaagaccttcagcatcggcaagatcgccaaggtgttccaggacaagttcgacgtgaccctgctgcacaccaagcccgaggtggccgcccaggagagaatggtggacgacggcaacggcaaggtggaggtgtggagaatcgagaacctggagctggtgcccgtggagtaccagtggtacggcttcttctacggcggcgactgctacctggtgctgtacacctacgaggtgaacggcaagccccaccacatcctgtacatctggcagggcagacacgccagccaggacgagctggccgccagcgcctaccaggccgtggaggtggacagacagttcgacggcgccgccgtgcaggtgagagtgagaatgggcaccgagcccagacacttcatggccatcttcaagggcaagctggtgatcttcgagggcggcaccagcagaaagggcaacgccgagcccgacccccccgtgagactgttccagatccacggcaacgacaagagcaacaccaaggccgtggaggtgcccgccttcgccagcagcctgaacagcaacgacgtgttcctgctgagaacccaggccgagcactacctgtggtacggcaagggcagcagcggcgacgagagagccatggccaaggagctggccagcctgctgtgcgacggcagcgagaacaccgtggccgagggccaggagcccgccgagttctgggacctgctgggcggcaagaccccctacgccaacgacaagagactgcagcaggagatcctggacgtgcagagcagactgttcgagtgcagcaacaagaccggccagttcgtggtgaccgagatcaccgacttcacccaggacgacctgaaccccaccgacgtgatgctgctggacacctgggaccaggtgttcctgtggatcggcgccgaggccaacgccaccgagaaggagagcgccctggccaccgcccagcagtacctgcacacccaccccagcggcagagaccccgacacccccatcctgatcatcaagcagggcttcgagccccccatcttcaccggctggttcctggcctgggaccccaacatctggagcgccggcaagacctacgagcagctgaaggaggagctgggcgacgccgccgccatcatgagaatcaccgccgacatgaagaacgccaccctgagcctgaacagcaacgacagcgagcccaagtactaccccatcgccgtgctgctgaagaaccagaaccaggagctgcccgaggacgtgaaccccgccaagaaggagaactacctgagcgagcaggacttcgtgagcgtgttcggcatcaccagaggccagttcgccgccctgcccggctggaagcagctgcagatgaagaaggagaagggcctgttctag

SEQ ID NO: 72325 - DNA, 2439 bp, Artificial Sequence
  Description of Artificial Sequence: Synthetic coding sequence
atgagcagcaccggccaccccggcagctacaagatctggggcgagaagatggagctggccctggtgcccgtgagcgcccacggcaacttctacgagggcgactgctacgtgatcctgagcaccagaagagtggccagcctgctgagccaggacatccacttctggatcggcaaggacagcagccaggacgagcagagctgcgccgccatctacaccacccagctggacgactacctgggcggcagccccgtgcagcacagagaggtgcagtaccacgagagcgacaccttcagaggctacttcaagcagggcatcatctacaagcagggcggcgtggccagcggcatgaagcacgtggagaccaacacctacgacgtgaagagactgctgcacgtgaagggcaagagaaacatcagagccaccgaggtggagatgagctgggacagcttcaacagaggcgacgtgttcctgctggacctgggcaaggtgatcatccagtggaacggccccgagagcaacagcggcgagagactgaaggccatgctgctggccaaggacatcagagacagagagagaggcggcagagccaagatcggcgtgatcgagggcgacaaggaggccgccagccccgagctgatgaaggtgctgcaggacaccctgggcagaagaagcatcatcaagcccaccgtgcccgacgagatcatcgaccagaagcagaagagcaccatcatgctgtaccacatcagcgacagcgccggccagctggccgtgaccgaggtggccaccagacccctggtgcaggacctgctgaaccacgacgactgctacatcctggaccagagcggcaccaagatctacgtgtggaagggcaagggcgccaccaaggccgagaagcaggccgccatgagcaaggccctgggcttcatcaagatgaagagctaccccagcagcaccaacgtggagaccgtgaacgacggcgccgagagcgccatgttcaagcagctgttccagaagtggagcgtgaaggaccagaccatgggcctgggcaagaccttcagcatcggcaagatcgccaaggtgttccaggacaagttcgacgtgaccctgctgcacaccaagcccgaggtggccgcccaggagagaatggtggacgacggcaacggcaaggtggaggtgtggagaatcgagaacctggagctggtgcccgtggagtaccagtggtacggcttcttctacggcggcgactgctacctggtgctgtacacctacgaggtgaacggcaagccccaccacatcctgtacatctggcagggcagacacgccagccaggacgagctggccgccagcgcctaccaggccgtggaggtggacagacagttcgacggcgccgccgtgcaggtgagagtgagaatgggcaccgagcccagacacttcatggccatcttcaagggcaagctggtgatcttcgagggcggcaccagcagaaagggcaacgccgagcccgacccccccgtgagactgttccagatccacggcaacgacaagagcaacaccaaggccgtggaggtgcccgccttcgccagcagcctgaacagcaacgacgtgttcctgctgagaacccaggccgagcactacctgtggtacggcaagggcagcagcggcgacgagagagccatggccaaggagctggccagcctgctgtgcgacggcagcgagaacaccgtggccgagggccaggagcccgccgagttctgggacctgctgggcggcaagaccccctacgccaacgacaagagactgcagcaggagatcctggacgtgcagagcagactgttcgagtgcagcaacaagaccggccagttcgtggtgaccgagatcaccgacttcacccaggacgacctgaaccccaccgacgtgatgctgctggacacctgggaccaggtgttcctgtggatcggcgccgaggccaacgccaccgagaaggagagcgccctggccaccgcccagcagtacctgcacacccaccccagcggcagagaccccgacacccccatcctgatcatcaagcagggcttcgagccccccatcttcaccggctggttcctggcctgggaccccaacatctggagcgccggcaagacctacgagcagctgaaggaggagctgggcgacgccgccgccatcatgagaatcaccgccgacatgaagaacgccaccctgagcctgaacagcaacgacagcgagcccaagtactaccccatcgccgtgctgctgaagaaccagaaccaggagctgcccgaggacgtgaaccccgccaagaaggagaactacctgagcgagcaggacttcgtgagcgtgttcggcatcaccagaggccagttcgccgccctgcccggctggaagcagctgcagatgaagaaggagaagggcctgttctag

SEQ ID NO: 72326 - DNA, 474 bp, Artificial Sequence
  Description of Artificial Sequence: Synthetic coding sequence
atgcccctgaccagcgccttcagagccgtggacaacgaccccggcatcatcgtgtggagaatcgagaagatggagctggccctggtgcccgtgagcgcccacggcaacttctacgagggcgactgctacgtgatcctgagcaccagaagagtggccagcctgctgagccaggacatccacttctggatcggcaaggacagcagccaggacgagcagagctgcgccgccatctacaccacccagctggacgactacctgggcggcagccccgtgcagcacagagaggtgcagtaccacgagagcgacaccttcagaggctacttcaagcagggcatcatctacaagcagggcggcgtggccagcggcatgaagcacgtggagaccaacacctacgacgtgaagagactgctgcacgtgaagggcaagagaaacatcagagccaccgaggtggagatgagctgggacagcttctag

SEQ ID NO: 72327 - DNA, 2859 bp, Artificial Sequence
  Description of Artificial Sequence: Synthetic coding sequence
atgaagttcaagagaagacaccaggccttccccagcttcttcaagatgaaggtgagcctgcccagcgaccccagctgcgtggaggagatcctgagagagagccagcacctgacccccggcttcaccctgcagaagtggaacgaccccaccaccagagccagcaccaagagcgtgagcttcaagagcatgctggaggacgacctgaagctgagcagcgacgaggacgacctggagcccgtgaagaccctgaccacccagtgcaccgccaccgagctgtaccaggccgtggagaaggccaagcccagaaacaaccccgtgaacccccccctggccaccccccagcccccccccgccgtgcaggccagcggcggcagcggcagcagcagcgagagcgagagcagcagcgagagcgacagcgacaccgagagcagcaccaccgacagcgagagcaacgaggcccccagagtggccacccccgagcccgagccccccagcaccaacaagtggcagctggacaagtggctgaacaaggtgaccagccagaacaagagcttcatctgcggccagaacgagacccccatggagaccatcagcctgcccccccccatcatccagcccatggaggtgcagatgaaggtgaagaccaacgccagccaggtgcccgccgagcccaaggagagacccctgctgagcctgatcagagagaaggccagacccagacccacccagaagatccccgagaccaaggccctgaagcacaagctgagcaccaccagcgagaccgtgagccagagaaccatcggcaagaagcagcccaagaaggtggagaagaacaccagcaccgacgagttcacctggcccaagcccaacatcaccagcagcacccccaaggagaaggagagcgtggagctgcacgacccccccagaggcagaaacaaggccaccgcccacaagcccgcccccagaaaggagcccagacccaacatccccctggcccccgagaagaagaagtacagaggccccggcaagatcgtgcccaagagcagagagttcatcgagaccgacagcagcaccagcgacagcaacaccgaccaggaggagaccctgcagatcaaggtgctgcccccctgcatcatcagcggcggcaacaccgccaagagcaaggagatctgcggcgccagcctgaccctgagcaccctgatgagcagcagcggcagcaacaacaacctgagcatcagcaacgaggagcccaccttcagccccatccccgtgatgcagaccgagatcctgagccccctgagagaccacgagaacctgaagaacctgtgggtgaagatcgacctggacctgctgagcagagtgcccggccacagcagcctgcacgccgcccccgccaagcccgaccacaaggagaccgccaccaagcccaagagacagaccgccgtgaccgccgtggagaagcccgcccccaagggcaagagaaagcacaagcccatcgaggtggccgagaagatccccgagaagaagcagagactggaggaggccaccaccatctgcctgctgcccccctgcatcagccccgcccccccccacaagccccccaacaccagagagaacaacagcagcagaagagccaacagaagaaaggaggagaagctgttccccccccccctgagccccctgcccgaggacccccccagaagaagaaacgtgagcggcaacaacggccccttcggccaggacaagaacatcgccatgaccggccagatcaccagcaccaagcccaagagaaccgagggcaagttctgcgccaccttcaagggcatcagcgtgaacgagggcgacacccccaagaaggccagcagcgccaccatcaccgtgaccaacaccgccatcgccaccgccaccgtgaccgccaccgccatcgtgaccaccaccgtgaccgccaccgccaccgccaccgccaccaccaccaccaccaccaccaccatcagcaccatcaccagcaccatcaccaccggcctgatggacagcagccacctggagatgaccagctgggccgccctgcccctgctgagcagcagcagcaccaacgtgagaagacccaagctgaccttcgacgacagcgtgcacaacgccgactactacatgcaggaggccaagaagctgaagcacaaggccgacgccctgttcgagaagttcggcaaggccgtgaactacgccgacgccgccctgagcttcaccgagtgcggcaacgccatggagagagaccccctggaggccaagagcccctacaccatgtacagcgagaccgtggagctgctgagatacgccatgagactgaagaacttcgccagccccctggccagcgacggcgacaagaagctggccgtgctgtgctacagatgcctgagcctgctgtacctgagaatgttcaagctgaagaaggaccacgccatgaagtacagcagaagcctgatggagtacttcaagcagaacgccagcaaggtggcccagatccccagcccctgggtgagcaacggcaagaacacccccagccccgtgagcctgaacaacgtgagccccatcaacgccatgggcaactgcaacaacggccccgtgaccatcccccagagaatccaccacatggccgccagccacgtgaacatcaccagcaacgtgctgagaggctacgagcactgggacatggccgacaagctgaccagagagaacaaggagttcttcggcgacctggacaccctgatgggccccctgacccagcacagcagcatgaccaacctggtgagatacgtgagacagggcctgtgctggctgagaatcgacgcccacctgctgtag

SEQ ID NO: 72328 - DNA, 3837 bp, Artificial Sequence
  Description of Artificial Sequence: Synthetic coding sequence
atggacctgttcgacttcttcagagactgggacctggagcagcagtgccactacgagcaggacagaagcgccctgaagaagagagagtgggagagaagaaaccaggaggtgcagcaggaggacgacctgttcagcagcggcttcgacctgttcggcgagccctacaagaccaacaagggcgacgccctggccaacagagtgcagaacaccctgggcaactacgacgagatgaagaacctgctgaccaaccacagcaaccagaaccacctggtgggcatccccaagaacagcgtgccccagaaccccaacaacaagaacgagcccagcttcttccccgagcagaagaacagaatcatccccccccaccaggacaacacccaccccagcgcccccatgcccccccccagcgtggtgatcctgaacagcaccctgatccacagcaacagaaagagcaagcccgagtggagcagagacagccacaaccccagcaccgtgctggccagccaggccagcggccagcccaacaagatgcagaccctgacccaggaccagagccaggccaagctggaggacttcttcgtgtaccccgccgagcagccccagatcggcgaggtggaggagagcaaccccagcgccaaggaggacagcaaccccaacagcagcggcgaggacgccttcaaggagatcttccagagcaacagccccgaggagagcgagttcgccgtgcaggcccccggcagccccctggtggccagcagcctgctggcccccagcagcggcctgagcgtgcagaacttcccccccggcctgtactgcaagaccagcatgggccagcagaagcccaccgcctacgtgagacccatggacggccaggaccaggcccccgacatcagccccaccctgaagcccagcatcgagttcgagaacagcttcggcaacctgagcttcggcaccctgctggacggcaagcccagcgccgccagcagcaagaccaagctgcccaagttcaccatcctgcagaccagcgaggtgagcctgcccagcgaccccagctgcgtggaggagatcctgagagagagccagcacctgacccccggcttcaccctgcagaagtggaacgaccccaccaccagagccagcaccaagagcgtgagcttcaagagcatgctggaggacgacctgaagctgagcagcgacgaggacgacctggagcccgtgaagaccctgaccacccagtgcaccgccaccgagctgtaccaggccgtggagaaggccaagcccagaaacaaccccgtgaacccccccctggccaccccccagcccccccccgccgtgcaggccagcggcggcagcggcagcagcagcgagagcgagagcagcagcgagagcgacagcgacaccgagagcagcaccaccgacagcgagagcaacgaggcccccagagtggccacccccgagcccgagccccccagcaccaacaagtggcagctggacaagtggctgaacaaggtgaccagccagaacaagagcttcatctgcggccagaacgagacccccatggagaccatcagcctgcccccccccatcatccagcccatggaggtgcagatgaaggtgaagaccaacgccagccaggtgcccgccgagcccaaggagagacccctgctgagcctgatcagagagaaggccagacccagacccacccagaagatccccgagaccaaggccctgaagcacaagctgagcaccaccagcgagaccgtgagccagagaaccatcggcaagaagcagcccaagaaggtggagaagaacaccagcaccgacgagttcacctggcccaagcccaacatcaccagcagcacccccaaggagaaggagagcgtggagctgcacgacccccccagaggcagaaacaaggccaccgcccacaagcccgcccccagaaaggagcccagacccaacatccccctggcccccgagaagaagaagtacagaggccccggcaagatcgtgcccaagagcagagagttcatcgagaccgacagcagcaccagcgacagcaacaccgaccaggaggagaccctgcagatcaaggtgctgcccccctgcatcatcagcggcggcaacaccgccaagagcaaggagatctgcggcgccagcctgaccctgagcaccctgatgagcagcagcggcagcaacaacaacctgagcatcagcaacgaggagcccaccttcagccccatccccgtgatgcagaccgagatcctgagccccctgagagaccacgagaacctgaagaacctgtgggtgaagatcgacctggacctgctgagcagagtgcccggccacagcagcctgcacgccgcccccgccaagcccgaccacaaggagaccgccaccaagcccaagagacagaccgccgtgaccgccgtggagaagcccgcccccaagggcaagagaaagcacaagcccatcgaggtggccgagaagatccccgagaagaagcagagactggaggaggccaccaccatctgcctgctgcccccctgcatcagccccgcccccccccacaagccccccaacaccagagagaacaacagcagcagaagagccaacagaagaaaggaggagaagctgttccccccccccctgagccccctgcccgaggacccccccagaagaagaaacgtgagcggcaacaacggccccttcggccaggacaagaacatcgccatgaccggccagatcaccagcaccaagcccaagagaaccgagggcaagttctgcgccaccttcaagggcatcagcgtgaacgagggcgacacccccaagaaggccagcagcgccaccatcaccgtgaccaacaccgccatcgccaccgccaccgtgaccgccaccgccatcgtgaccaccaccgtgaccgccaccgccaccgccaccgccaccaccaccaccaccaccaccaccatcagcaccatcaccagcaccatcaccaccggcctgatggacagcagccacctggagatgaccagctgggccgccctgcccctgctgagcagcagcagcaccaacgtgagaagacccaagctgaccttcgacgacagcgtgcacaacgccgactactacatgcaggaggccaagaagctgaagcacaaggccgacgccctgttcgagaagttcggcaaggccgtgaactacgccgacgccgccctgagcttcaccgagtgcggcaacgccatggagagagaccccctggaggccaagagcccctacaccatgtacagcgagaccgtggagctgctgagatacgccatgagactgaagaacttcgccagccccctggccagcgacggcgacaagaagctggccgtgctgtgctacagatgcctgagcctgctgtacctgagaatgttcaagctgaagaaggaccacgccatgaagtacagcagaagcctgatggagtacttcaagcagaacgccagcaaggtggcccagatccccagcccctgggtgagcaacggcaagaacacccccagccccgtgagcctgaacaacgtgagccccatcaacgccatgggcaactgcaacaacggccccgtgaccatcccccagagaatccaccacatggccgccagccacgtgaacatcaccagcaacgtgctgagaggctacgagcactgggacatggccgacaagctgaccagagagaacaaggagttcttcggcgacctggacaccctgatgggccccctgacccagcacagcagcatgaccaacctggtgagatacgtgagacagggcctgtgctggctgagaatcgacgcccacctgctgtag

SEQ ID NO: 72329 - DNA, 3831 bp, Artificial Sequence
  Description of Artificial Sequence: Synthetic coding sequence
atggacctgttcgacttcttcagagactgggacctggagcagcagtgccactacgagcaggacagaagcgccctgaagaagagagagtgggagagaagaaaccaggaggtgcagcaggaggacgacctgttcagcagcggcttcgacctgttcggcgagccctacaagaccaacaagggcgacgccctggccaacagagtgcagaacaccctgggcaactacgacgagatgaagaacctgctgaccaaccacagcaaccagaaccacctggtgggcatccccaagaacagcgtgccccagaaccccaacaacaagaacgagcccagcttcttccccgagcagaagaacagaatcatccccccccaccaggacaacacccaccccagcgcccccatgcccccccccagcgtggtgatcctgaacagcaccctgatccacagcaacagaaagagcaagcccgagtggagcagagacagccacaaccccagcaccgtgctggccagccaggccagcggccagcccaacaagatgcagaccctgacccaggaccagagccaggccaagctggaggacttcttcgtgtaccccgccgagcagccccagatcggcgaggtggaggagagcaaccccagcgccaaggaggacagcaaccccaacagcagcggcgaggacgccttcaaggagatcttccagagcaacagccccgaggagagcgagttcgccgtgcaggcccccggcagccccctggtggccagcagcctgctggcccccagcagcggcctgagcgtgcagaacttcccccccggcctgtactgcaagaccagcatgggccagcagaagcccaccgcctacgtgagacccatggacggccaggaccaggcccccgacatcagccccaccctgaagcccagcatcgagttcgagaacagcttcggcaacctgagcttcggcaccctgctggacggcaagcccagcgccgccagcagcaagaccaagctgcccaagttcaccatcctgcagaccagcgaggtgagcctgcccagcgaccccagctgcgtggaggagatcctgagagagagccagcacctgacccccggcttcaccctgcagaagtggaacgaccccaccaccagagccagcaccaagagcgtgagcttcaagagcatgctggaggacgacctgaagctgagcagcgacgaggacgacctggagcccgtgaagaccctgaccacccagtgcaccgccaccgagctgtaccaggccgtggagaaggccaagcccagaaacaaccccgtgaacccccccctggccaccccccagcccccccccgccgtgcaggccagcggcggcagcggcagcagcagcgagagcgagagcagcagcgagagcgacagcgacaccgagagcagcaccaccgacagcgagagcaacgaggcccccagagtggccacccccgagcccgagccccccagcaccaacaagtggcagctggacaagtggctgaacaaggtgaccagccagaacaagagcttcatctgcggccagaacgagacccccatggagaccatcagcctgcccccccccatcatccagcccatggaggtgcagatgaaggtgaagaccaacgccagccaggtgcccgccgagcccaaggagagacccctgctgagcctgatcagagagaaggccagacccagacccacccagaagatccccgagaccaaggccctgaagcacaagctgagcaccaccagcgagaccgtgagccagagaaccatcggcaagaagcagcccaagaaggtggagaagaacaccagcaccgacgagttcacctggcccaagcccaacatcaccagcagcacccccaaggagaaggagagcgtggagctgcacgacccccccagaggcagaaacaaggccaccgcccacaagcccgcccccagaaaggagcccagacccaacatccccctggcccccgagaagaagaagtacagaggccccggcaagatcgtgcccaagagcagagagttcatcgagaccgacagcagcaccagcgacagcaacaccgaccaggaggagaccctgcagatcaaggtgctgcccccctgcatcatcagcggcggcaacaccgccaagagcaaggagatctgcggcgccagcctgaccctgagcaccctgatgagcagcagcggcagcaacaacaacctgagcatcagcaacgaggagcccaccttcagccccatccccgtgatgcagaccgagatcctgagccccctgagagaccacgagaacctgaagaacctgtgggtgaagatcgacctggacctgctgagcagagtgcccggccacagcagcctgcacgccgcccccgccaagcccgaccacaaggagaccgccaccaagcccaagagacagaccgccgtgaccgccgtggagaagcccgcccccaagggcaagagaaagcacaagcccatcgaggtggccgagaagatccccgagaagaagcagagactggaggaggccaccaccatctgcctgctgcccccctgcatcagccccgcccccccccacaagccccccaacaccagagagaacaacagcagcagaagagccaacagaagaaaggaggagaagctgttccccccccccctgagccccctgcccgaggacccccccagaagaagaaacgtgagcggcaacaacggccccttcggccaggacaagaacatcgccatgaccggccagatcaccagcaccaagcccaagagaaccgagggcaagttctgcgccaccttcaagggcatcagcgagggcgacacccccaagaaggccagcagcgccaccatcaccgtgaccaacaccgccatcgccaccgccaccgtgaccgccaccgccatcgtgaccaccaccgtgaccgccaccgccaccgccaccgccaccaccaccaccaccaccaccaccatcagcaccatcaccagcaccatcaccaccggcctgatggacagcagccacctggagatgaccagctgggccgccctgcccctgctgagcagcagcagcaccaacgtgagaagacccaagctgaccttcgacgacagcgtgcacaacgccgactactacatgcaggaggccaagaagctgaagcacaaggccgacgccctgttcgagaagttcggcaaggccgtgaactacgccgacgccgccctgagcttcaccgagtgcggcaacgccatggagagagaccccctggaggccaagagcccctacaccatgtacagcgagaccgtggagctgctgagatacgccatgagactgaagaacttcgccagccccctggccagcgacggcgacaagaagctggccgtgctgtgctacagatgcctgagcctgctgtacctgagaatgttcaagctgaagaaggaccacgccatgaagtacagcagaagcctgatggagtacttcaagcagaacgccagcaaggtggcccagatccccagcccctgggtgagcaacggcaagaacacccccagccccgtgagcctgaacaacgtgagccccatcaacgccatgggcaactgcaacaacggccccgtgaccatcccccagagaatccaccacatggccgccagccacgtgaacatcaccagcaacgtgctgagaggctacgagcactgggacatggccgacaagctgaccagagagaacaaggagttcttcggcgacctggacaccctgatgggccccctgacccagcacagcagcatgaccaacctggtgagatacgtgagacagggcctgtgctggctgagaatcgacgcccacctgctgtag

SEQ ID NO: 72330 - DNA, 1284 bp, Artificial Sequence
  Description of Artificial Sequence: Synthetic coding sequence
atggacctgttcgacttcttcagagactgggacctggagcagcagtgccactacgagcaggacagaagcgccctgaagaagagagagtgggagagaagaaaccaggaggtgcagcaggaggacgacctgttcagcagcggcttcgacctgttcggcgagccctacaagaccaacaagggcgacgccctggccaacagagtgcagaacaccctgggcaactacgacgagatgaagaacctgctgaccaaccacagcaaccagaaccacctggtgggcatccccaagaacagcgtgccccagaaccccaacaacaagaacgagcccagcttcttccccgagcagaagaacagaatcatccccccccaccaggacaacacccaccccagcgcccccatgcccccccccagcgtggtgatcctgaacagcaccctgatccacagcaacagaaagagcaagcccgagtggagcagagacagccacaaccccagcaccgtgctggccagccaggccagcggccagcccaacaagatgcagaccctgacccaggaccagagccaggccaagctggaggacttcttcgtgtaccccgccgagcagccccagatcggcgaggtggaggagagcaaccccagcgccaaggaggacagcaaccccaacagcagcggcgaggacgccttcaaggagatcttccagagcaacagccccgaggagagcgagttcgccgtgcaggcccccggcagccccctggtggccagcagcctgctggcccccagcagcggcctgagcgtgcagaacttcccccccggcctgtactgcaagaccagcatgggccagcagaagcccaccgcctacgtgagacccatggacggccaggaccaggcccccgacatcagccccaccctgaagcccagcatcgagttcgagaacagcttcggcaacctgagcttcggcaccctgctggacggcaagcccagcgccgccagcagcaagaccaagctgcccaagttcaccatcctgcagaccagcgaggtgagcctgcccagcgaccccagctgcgtggaggagatcctgagagagagccagcacctgacccccggcttcaccctgcagaagtggaacgaccccaccaccagagccagcaccaagatgctggaggacgacctgaagctgagcagcgacgaggacgacctggagcccgtgaagaccctgaccacccagtgcaccgccaccgagctgtaccaggccgtggagaaggccaagcccagaaacaaccccgtgaagtag

SEQ ID NO: 72331 - DNA, 3936 bp, Artificial Sequence
  Description of Artificial Sequence: Synthetic coding sequence
atggacctgttcgacttcttcagagactgggacctggagcagcagtgccactacgagcaggacagaagcgccctgaagaagagagagtgggagagaagaaaccaggaggtgcagcaggaggacgacctgttcagcagcggcttcgacctgttcggcgagccctacaaggtggccgagtacaccaacaagggcgacgccctggccaacagagtgcagaacaccctgggcaactacgacgagatgaagaacctgctgaccaaccacagcaaccagaaccacctggtgggcatccccaagaacagcgtgccccagaaccccaacaacaagaacgagcccagcttcttccccgagcagaagaacagaatcatccccccccaccaggacaacacccaccccagcgcccccatgcccccccccagcgtggtgatcctgaacagcaccctgatccacagcaacagaaagagcaagcccgagtggagcagagacagccacaaccccagcaccgtgctggccagccaggccagcggccagcccaacaagatgcagaccctgacccaggaccagagccaggccaagctggaggacttcttcgtgtaccccgccgagcagccccagatcggcgaggtggaggagagcaaccccagcgccaaggaggacagcaaccccaacagcagcggcgaggacgccttcaaggagatcttccagagcaacagccccgaggagagcgagttcgccgtgcaggcccccggcagccccctggtggccagcagcctgctggcccccagcagcggcctgagcgtgcagaacttcccccccggcctgtactgcaagaccagcatgggccagcagaagcccaccgcctacgtgagacccatggacggccaggaccaggcccccgacatcagccccaccctgaagcccagcatcgagttcgagaacagcttcggcaacctgagcttcggcaccctgctggacggcaagcccagcgccgccagcagcaagaccaagctgcccaagttcaccatcctgcagaccagcgaggtgagcctgcccagcgaccccagctgcgtggaggagatcctgagagagatgacccacagctggcccacccccctgaccagcatgcacaccgccggccacagcgagcagagcaccttcagcatccccggccaggagagccagcacctgacccccggcttcaccctgcagaagtggaacgaccccaccaccagagccagcaccaagagcgtgagcttcaagagcatgctggaggacgacctgaagctgagcagcgacgaggacgacctggagcccgtgaagaccctgaccacccagtgcaccgccaccgagctgtaccaggccgtggagaaggccaagcccagaaacaaccccgtgaacccccccctggccaccccccagcccccccccgccgtgcaggccagcggcggcagcggcagcagcagcgagagcgagagcagcagcgagagcgacagcgacaccgagagcagcaccaccgacagcgagagcaacgaggcccccagagtggccacccccgagcccgagccccccagcaccaacaagtggcagctggacaagtggctgaacaaggtgaccagccagaacaagagcttcatctgcggccagaacgagacccccatggagaccatcagcctgcccccccccatcatccagcccatggaggtgcagatgaaggtgaagaccaacgccagccaggtgcccgccgagcccaaggagagacccctgctgagcctgatcagagagaaggccagacccagacccacccagaagatccccgagaccaaggccctgaagcacaagctgagcaccaccagcgagaccgtgagccagagaaccatcggcaagaagcagcccaagaaggtggagaagaacaccagcaccgacgagttcacctggcccaagcccaacatcaccagcagcacccccaaggagaaggagagcgtggagctgcacgacccccccagaggcagaaacaaggccaccgcccacaagcccgcccccagaaaggagcccagacccaacatccccctggcccccgagaagaagaagtacagaggccccggcaagatcgtgcccaagagcagagagttcatcgagaccgacagcagcaccagcgacagcaacaccgaccaggaggagaccctgcagatcaaggtgctgcccccctgcatcatcagcggcggcaacaccgccaagagcaaggagatctgcggcgccagcctgaccctgagcaccctgatgagcagcagcggcagcaacaacaacctgagcatcagcaacgaggagcccaccttcagccccatccccgtgatgcagaccgagatcctgagccccctgagagaccacgagaacctgaagaacctgtgggtgaagatcgacctggacctgctgagcagagtgcccggccacagcagcctgcacgccgcccccgccaagcccgaccacaaggagaccgccaccaagcccaagagacagaccgccgtgaccgccgtggagaagcccgcccccaagggcaagagaaagcacaagcccatcgaggtggccgagaagatccccgagaagaagcagagactggaggaggccaccaccatctgcctgctgcccccctgcatcagccccgcccccccccacaagccccccaacaccagagagaacaacagcagcagaagagccaacagaagaaaggaggagaagctgttccccccccccctgagccccctgcccgaggacccccccagaagaagaaacgtgagcggcaacaacggccccttcggccaggacaagaacatcgccatgaccggccagatcaccagcaccaagcccaagagaaccgagggcaagttctgcgccaccttcaagggcatcagcgtgaacgagggcgacacccccaagaaggccagcagcgccaccatcaccgtgaccaacaccgccatcgccaccgccaccgtgaccgccaccgccatcgtgaccaccaccgtgaccgccaccgccaccgccaccgccaccaccaccaccaccaccaccaccatcagcaccatcaccagcaccatcaccaccggcctgatggacagcagccacctggagatgaccagctgggccgccctgcccctgctgagcagcagcagcaccaacgtgagaagacccaagctgaccttcgacgacagcgtgcacaacgccgactactacatgcaggaggccaagaagctgaagcacaaggccgacgccctgttcgagaagttcggcaaggccgtgaactacgccgacgccgccctgagcttcaccgagtgcggcaacgccatggagagagaccccctggaggccaagagcccctacaccatgtacagcgagaccgtggagctgctgagatacgccatgagactgaagaacttcgccagccccctggccagcgacggcgacaagaagctggccgtgctgtgctacagatgcctgagcctgctgtacctgagaatgttcaagctgaagaaggaccacgccatgaagtacagcagaagcctgatggagtacttcaagcagaacgccagcaaggtggcccagatccccagcccctgggtgagcaacggcaagaacacccccagccccgtgagcctgaacaacgtgagccccatcaacgccatgggcaactgcaacaacggccccgtgaccatcccccagagaatccaccacatggccgccagccacgtgaacatcaccagcaacgtgctgagaggctacgagcactgggacatggccgacaagctgaccagagagaacaaggagttcttcggcgacctggacaccctgatgggccccctgacccagcacagcagcatgaccaacctggtgagatacgtgagacagggcctgtgctggctgagaatcgacgcccacctgctgtag

SEQ ID NO: 72332 - DNA, 1410 bp, Artificial Sequence
  Description of Artificial Sequence: Synthetic coding sequence
atgagcgccctgaccccccccaccgacatgcccacccccaccaccgacaagatcacccaggccgccatggagaccatctacctgtgcaagttcagagtgagcatggacggcgagtggctgtgcctgagagagctggacgacatcagcctgacccccgaccccgagcccacccacgaggaccccaactacctgatggccaacgagagaatgaacctgatgaacatggccaagctgagcatcaagggcctgatcgagagcgccctgaacctgggcagaaccctggacagcgactacgcccccctgcagcagttcttcgtggtgatggagcactgcctgaagcacggcctgaaggccaagaagaccttcctgggccagaacaagagcttctggggccccctggagctggtggagaagctggtgcccgaggccgccgagatcaccgccagcgtgaaggacctgcccggcctgaagacccccgtgggcagaggcagagcctggctgagactggccctgatgcagaagaagctgagcgagtacatgaaggccctgatcaacaagaaggagctgctgagcgagttctacgagcccaacgccctgatgatggaggaggagggcgccatcatcgccggcctgctggtgggcctgaacgtgatcgacgccaacttctgcatgaagggcgaggacctggacagccaggtgggcgtgatcgacttcagcatgtacctgaaggacggcaacagcagcaagggcaccgagggcgacggccagatcaccgccatcctggaccagaagaactacgtggaggagctgaacagacacctgaacgccaccgtgaacaacctgcaggccaaggtggacgccctggagaagagcaacaccaagctgaccgaggagctggccgtggccaacaacagaatcatcaccctgcaggaggagatggagagagtgaaggaggagagcagctacatcctggagagcaacagaaagggccccaagcaggacagaaccgccgagggccaggccctgagcgaggccagaaagcacctgaaggaggagacccagctgagactggacgtggagaaggagctggagatgcagatcagcatgagacaggagatggagctggccatgaagatgctggagaaggacgtgtgcgagaagcaggacgccctggtgagcctgagacagcagctggacgacctgagagccctgaagcacgagctggccttcaagctgcagagcagcgacctgggcgtgaagcagaagagcgagctgaacagcagactggaggagaagaccaaccagatggccgccaccatcaagcagctggagcagagcgagaaggacctggtgaagcaggccaagaccctgaacagcgccgccaacaagctgatccccaagcaccactag

SEQ ID NO: 72333 - DNA, 2394 bp, Artificial Sequence
  Description of Artificial Sequence: Synthetic coding sequence
atggcccacagatgcctgagactgtggggcagaggcggctgctggcccagaggcctgcagcagctgctggtgcccggcggcgtgggccccggcgagcagccctgcctgagaaccctgtacagattcgtgaccacccaggccagagccagcagaaacagcctgctgaccgacatcatcgccgcctaccagagattctgcagcagaccccccaagggcttcgagaagtacttccccaacggcaagaacggcaagaaggccagcgagcccaaggaggtgatgggcgagaagaaggagagcaagcccgccgccaccaccagaagcagcggcggcggcggcggcggcggcggcaagagaggcggcaagaaggacgacagccactggtggagcagattccagaagggcgacatcccctgggacgacaaggacttcagaatgttcttcctgtggaccgccctgttctggggcggcgtgatgttctacctgctgctgaagagaagcggcagagagatcacctggaaggacttcgtgaacaactacctgagcaagggcgtggtggacagactggaggtggtgaacaagagattcgtgagagtgaccttcacccccggcaagacccccgtggacggccagtacgtgtggttcaacatcggcagcgtggacaccttcgagagaaacctggagaccctgcagcaggagctgggcatcgagggcgagaacagagtgcccgtggtgtacatcgccgagagcgacggcagcttcctgctgagcatgctgcccaccgtgctgatcatcgccttcctgctgtacaccatcagaagaggccccgccggcatcggcagaaccggcagaggcatgggcggcctgttcagcgtgggcgagaccaccgccaaggtgctgaaggacgagatcgacgtgaagttcaaggacgtggccggctgcgaggaggccaagctggagatcatggagttcgtgaacttcctgaagaaccccaagcagtaccaggacctgggcgccaagatccccaagggcgccatcctgaccggcccccccggcaccggcaagaccctgctggccaaggccaccgccggcgaggccaacgtgcccttcatcaccgtgagcggcagcgagttcctggagatgttcgtgggcgtgggccccgccagagtgagagacctgttcgccctggccagaaagaacgccccctgcatcctgttcatcgacgagatcgacgccgtgggcagaaagagaggcagaggcaacttcggcggccagagcgagcaggagaacaccctgaaccagctgctggtggagatggacggcttcaacaccaccaccaacgtggtgatcctggccggcaccaacagacccgacatcctggaccccgccctgctgagacccggcagattcgacagacagatcttcatcggcccccccgacatcaagggcagagccagcatcttcaaggtgcacctgagacccctgaagctggacagcaccctggagaaggacaagctggccagaaagctggccagcctgacccccggcttcagcggcgccgacgtggccaacgtgtgcaacgaggccgccctgatcgccgccagacacctgagcgacagcatcaaccagaagcacttcgagcaggccatcgagagagtgatcggcggcctggagaagaagacccaggtgctgcagcccgaggagaagaagaccgtggcctaccacgaggccggccacgccgtggccggctggtacctggagcacgccgaccccctgctgaaggtgagcatcatccccagaggcaagggcctgggctacgcccagtacctgcccaaggagcagtacctgtacaccaaggagcagctgctggacagaatgtgcatgaccctgggcggcagagtgagcgaggagatcttcttcggcagaatcaccaccggcgcccaggacgacctgagaaaggtgacccagagcgcctacgcccagatcgtgcagttcggcatgaacgagaaggtgggccagatcagcttcgacctgcccagacagggcgacatggtgctggagaagccctacagcgaggccaccgccagactgatcgacgacgaggtgagaatcctgatcaacgacgcctacaagagaaccgtggccctgctgaccgagaagaaggccgacgtggagaaggtggccctgctgctgctggagaaggaggtgctggacaagaacgacatggtggagctgctgggccccagacccttcgccgagaagagcacctacgaggagttcgtggagggcaccggcagcctggacgaggacaccagcctgcccgagggcctgaaggactggaacaaggagagagagaaggagaaggaggagccccccggcgagaaggtggccaactag

SEQ ID NO: 72334 - DNA, 2439 bp, Artificial Sequence
  Description of Artificial Sequence: Synthetic coding sequence
ggcgccggcggcagaagaagaagagtggagagcctgggcagcagcgtgagcagaagaagagccagcctgcccggcggcctgagccccagcagagccagattccccagaccccccgtggtggcctgccccagactgagagagcagccctgcctgagaaccctgtacagattcgtgaccacccaggccagagccagcagaaacagcctgctgaccgacatcatcgccgcctaccagagattctgcagcagaccccccaagggcttcgagaagtacttccccaacggcaagaacggcaagaaggccagcgagcccaaggaggtgatgggcgagaagaaggagagcaagcccgccgccaccaccagaagcagcggcggcggcggcggcggcggcggcaagagaggcggcaagaaggacgacagccactggtggagcagattccagaagggcgacatcccctgggacgacaaggacttcagaatgttcttcctgtggaccgccctgttctggggcggcgtgatgttctacctgctgctgaagagaagcggcagagagatcacctggaaggacttcgtgaacaactacctgagcaagggcgtggtggacagactggaggtggtgaacaagagattcgtgagagtgaccttcacccccggcaagacccccgtggacggccagtacgtgtggttcaacatcggcagcgtggacaccttcgagagaaacctggagaccctgcagcaggagctgggcatcgagggcgagaacagagtgcccgtggtgtacatcgccgagagcgacggcagcttcctgctgagcatgctgcccaccgtgctgatcatcgccttcctgctgtacaccatcagaagaggccccgccggcatcggcagaaccggcagaggcatgggcggcctgttcagcgtgggcgagaccaccgccaaggtgctgaaggacgagatcgacgtgaagttcaaggacgtggccggctgcgaggaggccaagctggagatcatggagttcgtgaacttcctgaagaaccccaagcagtaccaggacctgggcgccaagatccccaagggcgccatcctgaccggcccccccggcaccggcaagaccctgctggccaaggccaccgccggcgaggccaacgtgcccttcatcaccgtgagcggcagcgagttcctggagatgttcgtgggcgtgggccccgccagagtgagagacctgttcgccctggccagaaagaacgccccctgcatcctgttcatcgacgagatcgacgccgtgggcagaaagagaggcagaggcaacttcggcggccagagcgagcaggagaacaccctgaaccagctgctggtggagatggacggcttcaacaccaccaccaacgtggtgatcctggccggcaccaacagacccgacatcctggaccccgccctgctgagacccggcagattcgacagacagatcttcatcggcccccccgacatcaagggcagagccagcatcttcaaggtgcacctgagacccctgaagctggacagcaccctggagaaggacaagctggccagaaagctggccagcctgacccccggcttcagcggcgccgacgtggccaacgtgtgcaacgaggccgccctgatcgccgccagacacctgagcgacagcatcaaccagaagcacttcgagcaggccatcgagagagtgatcggcggcctggagaagaagacccaggtgctgcagcccgaggagaagaagaccgtggcctaccacgaggccggccacgccgtggccggctggtacctggagcacgccgaccccctgctgaaggtgagcatcatccccagaggcaagggcctgggctacgcccagtacctgcccaaggagcagtacctgtacaccaaggagcagctgctggacagaatgtgcatgaccctgggcggcagagtgagcgaggagatcttcttcggcagaatcaccaccggcgcccaggacgacctgagaaaggtgacccagagcgcctacgcccagatcgtgcagttcggcatgaacgagaaggtgggccagatcagcttcgacctgcccagacagggcgacatggtgctggagaagccctacagcgaggccaccgccagactgatcgacgacgaggtgagaatcctgatcaacgacgcctacaagagaaccgtggccctgctgaccgagaagaaggccgacgtggagaaggtggccctgctgctgctggagaaggaggtgctggacaagaacgacatggtggagctgctgggccccagacccttcgccgagaagagcacctacgaggagttcgtggagggcaccggcagcctggacgaggacaccagcctgcccgagggcctgaaggactggaacaaggagagagagaaggagaaggaggagccccccggcgagaaggtggccaactag

SEQ ID NO: 72335 - DNA, 7251 bp, Artificial Sequence
  Description of Artificial Sequence: Synthetic coding sequence
atgaccaccctgctgtgggtgttcgtgaccctgagagtgatcaccgccgccgtgaccgtggagaccagcgaccacgacaacagcctgagcgtgagcatcccccagcccagccccctgagagtgctgctgggcaccagcctgaccatcccctgctacttcatcgaccccatgcaccccgtgaccaccgcccccagcaccgcccccctggcccccagaatcaagtggagcagagtgagcaaggagaaggaggtggtgctgctggtggccaccgagggcagagtgagagtgaacagcgcctaccaggacaaggtgagcctgcccaactaccccgccatccccagcgacgccaccctggaggtgcagagcctgagaagcaacgacagcggcgtgtacagatgcgaggtgatgcacggcatcgaggacagcgaggccaccctggaggtggtggtgaagggcatcgtgttccactacagagccatcagcaccagatacaccctggacttcgacagagcccagagagcctgcctgcagaacagcgccatcatcgccacccccgagcagctgcaggccgcctacgaggacggcttccaccagtgcgacgccggctggctggccgaccagaccgtgagataccccatccacacccccagagagggctgctacggcgacaaggacgagttccccggcgtgagaacctacggcatcagagacaccaacgagacctacgacgtgtactgcttcgccgaggagatggagggcgaggtgttctacgccaccagccccgagaagttcaccttccaggaggccgccaacgagtgcagaagactgggcgccagactggccaccaccggccagctgtacctggcctggcaggccggcatggacatgtgcagcgccggctggctggccgacagaagcgtgagataccccatcagcaaggccagacccaactgcggcggcaacctgctgggcgtgagaaccgtgtacgtgcacgccaaccagaccggctaccccgaccccagcagcagatacgacgccatctgctacaccggcgaggacttcgtggacatccccgagaacttcttcggcgtgggcggcgaggaggacatcaccgtgcagaccgtgacctggcccgacatggagctgcccctgcccagaaacatcaccgagggcgaggccagaggcagcgtgatcctgaccgtgaagcccatcttcgaggtgagccccagccccctggagcccgaggagcccttcaccttcgcccccgagatcggcgccaccgccttcgccgaggtggagaacgagaccggcgaggccaccagaccctggggcttccccacccccggcctgggccccgccaccgccttcaccagcgaggacctggtggtgcaggtgaccgccgtgcccggccagccccacctgcccggcggcgtggtgttccactacagacccggccccaccagatacagcctgaccttcgaggaggcccagcaggcctgcctgagaaccggcgccgtgatcgccagccccgagcagctgcaggccgcctacgaggccggctacgagcagtgcgacgccggctggctgagagaccagaccgtgagataccccatcgtgagccccagaaccccctgcgtgggcgacaaggacagcagccccggcgtgagaacctacggcgtgagacccagcaccgagacctacgacgtgtactgcttcgtggacagactggagggcgaggtgttcttcgccaccagactggagcagttcaccttccaggaggccctggagttctgcgagagccacaacgccaccctggccaccaccggccagctgtacgccgcctggagcagaggcctggacaagtgctacgccggctggctggccgacggcagcctgagataccccatcgtgacccccagacccgcctgcggcggcgacaagcccggcgtgagaaccgtgtacctgtaccccaaccagaccggcctgcccgaccccctgagcagacaccacgccttctgcttcagaggcatcagcgccgtgcccagccccggcgaggaggagggcggcacccccaccagccccagcggcgtggaggagtggatcgtgacccaggtggtgcccggcgtggccgccgtgcccgtggaggaggagaccaccgccgtgcccagcggcgagaccaccgccatcctggagttcaccaccgagcccgagaaccagaccgagtgggagcccgcctacacccccgtgggcaccagccccctgcccggcatcctgcccacctggccccccaccggcgccgccaccgaggagagcaccgagggccccagcgccaccgaggtgcccagcgccagcgaggagcccagccccagcgaggtgcccttccccagcgaggagcccagccccagcgaggagcccttccccagcgtgagacccttccccagcgtggagctgttccccagcgaggagcccttccccagcaaggagcccagccccagcgaggagcccagcgccagcgaggagccctacacccccagcccccccgtgcccagctggaccgagctgcccagcagcggcgaggagagcggcgcccccgacgtgagcggcgacttcaccggcagcggcgacgtgagcggccacctggacttcagcggccagctgagcggcgacagagccagcggcctgcccagcggcgacctggacagcagcggcctgaccagcaccgtgggcagcggcctgcccgtggagagcggcctgcccagcggcgacgaggagagaatcgagtggcccagcacccccaccgtgggcgagctgcccagcggcgccgagatcctggagggcagcgccagcggcgtgggcgacctgagcggcctgcccagcggcgaggtgctggagaccagcgccagcggcgtgggcgacctgagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccaccgcccccggcgtggaggagatcagcggcctgcccagcggcgaggtgctggagaccaccgcccccggcgtggacgagatcagcggcctgcccagcggcgaggtgctggagaccaccgcccccggcgtggaggagatcagcggcctgcccagcggcgaggtgctggagaccagcaccagcgccgtgggcgacctgagcggcctgcccagcggcggcgaggtgctggagatcagcgtgagcggcgtggaggacatcagcggcctgcccagcggcgaggtggtggagaccagcgccagcggcatcgaggacgtgagcgagctgcccagcggcgagggcctggagaccagcgccagcggcgtggaggacctgagcagactgcccagcggcgaggaggtgctggagatcagcgccagcggcttcggcgacctgagcggcctgcccagcggcggcgagggcctggagaccagcgccagcgaggtgggcaccgacctgagcggcctgcccagcggcagagagggcctggagaccagcgccagcggcgccgaggacctgagcggcctgcccagcggcaaggaggacctggtgggcagcgccagcggcgacctggacctgggcaagctgcccagcggcaccctgggcagcggccaggcccccgagaccagcggcctgcccagcggcttcagcggcgagtacagcggcgtggacctgggcagcggcccccccagcggcctgcccgacttcagcggcctgcccagcggcttccccaccgtgagcctggtggacagcaccctggtggaggtggtgaccgccagcaccgccagcgagctggagggcagaggcaccatcggcatcagcggcgccggcgagatcagcggcctgcccagcagcgagctggacatcagcggcagagccagcggcctgcccagcggcaccgagctgagcggccaggccagcggcagccccgacgtgagcggcgagatccccggcctgttcggcgtgagcggccagcccagcggcttccccgacaccagcggcgagaccagcggcgtgaccgagctgagcggcctgagcagcggccagcccggcatcagcggcgaggccagcggcgtgctgtacggcaccagccagcccttcggcatcaccgacctgagcggcgagaccagcggcgtgcccgacctgagcggccagcccagcggcctgcccggcttcagcggcgccaccagcggcgtgcccgacctggtgagcggcaccaccagcggcagcggcgagagcagcggcatcaccttcgtggacaccagcctggtggaggtggcccccaccaccttcaaggaggaggagggcctgggcagcgtggagctgagcggcctgcccagcggcgaggccgacctgagcggcaagagcggcatggtggacgtgagcggccagttcagcggcaccgtggacagcagcggcttcaccagccagacccccgagttcagcggcctgcccagcggcatcgccgaggtgagcggcgagagcagcagagccgagatcggcagcagcctgcccagcggcgcctactacggcagcggcacccccagcagcttccccaccgtgagcctggtggacagaaccctggtggagagcgtgacccaggcccccaccgcccaggaggccggcgagggccccagcggcatcctggagctgagcggcgcccacagcggcgcccccgacatgagcggcgagcacagcggcttcctggacctgagcggcctgcagagcggcctgatcgagcccagcggcgagccccccggcaccccctacttcagcggcgacttcgccagcaccaccaacgtgagcggcgagagcagcgtggccatgggcaccagcggcgaggccagcggcctgcccgaggtgaccctgatcaccagcgagttcgtggagggcgtgaccgagcccaccatcagccaggagctgggccagagaccccccgtgacccacaccccccagctgttcgagagcagcggcaaggtgagcaccgccggcgacatcagcggcgccacccccgtgctgcccggcagcggcgtggaggtgagcagcgtgcccgagagcagcagcgagaccagcgcctaccccgaggccggcttcggcgccagcgccgcccccgaggccagcagagaggacagcggcagccccgacctgagcgagaccaccagcgccttccacgaggccaacctggagagaagcagcggcctgggcgtgagcggcagcaccctgaccttccaggagggcgaggccagcgccgcccccgaggtgagcggcgagagcaccaccaccagcgacgtgggcaccgaggcccccggcctgcccagcgccacccccaccgccagcggcgacagaaccgagatcagcggcgacctgagcggccacaccagccagctgggcgtggtgatcagcaccagcatccccgagagcgagtggacccagcagacccagagacccgccgagacccacctggagatcgagagcagcagcctgctgtacagcggcgaggagacccacaccgtggagaccgccaccagccccaccgacgccagcatccccgccagccccgagtggaagagagagagcgagagcaccgccgccgcccccgccagaagctgcgccgaggagccctgcggcgccggcacctgcaaggagaccgagggccacgtgatctgcctgtgcccccccggctacaccggcgagcactgcaacatcgaccaggaggtgtgcgaggagggctggaacaagtaccagggccactgctacagacacttccccgacagagagacctgggtggacgccgagagaagatgcagagagcagcagagccacctgagcagcatcgtgacccccgaggagcaggagttcgtgaacaacaacgcccaggactaccagtggatcggcctgaacgacagaaccatcgagggcgacttcagatggagcgacggccaccccatgcagttcgagaactggagacccaaccagcccgacaacttcttcgccgccggcgaggactgcgtggtgatgatctggcacgagaagggcgagtggaacgacgtgccctgcaactaccacctgcccttcacctgcaagaagggcaccgtggcctgcggcgagccccccgtggtggagcacgccagaaccttcggccagaagaaggacagatacgagatcaacagcctggtgagataccagtgcaccgagggcttcgtgcagagacacatgcccaccatcagatgccagcccagcggccactgggaggagccccagatcacctgcaccgaccccaccacctacaagagaagactgcagaagagaagcagcagacaccccagaagaagcagacccagcaccgcccactag

SEQ ID NO: 72336 - DNA, 7296 bp, Artificial Sequence
  Description of Artificial Sequence: Synthetic coding sequence
atgaccaccctgctgtgggtgttcgtgaccctgagagtgatcaccgccgccgtgaccgtggagaccagcgaccacgacaacagcctgagcgtgagcatcccccagcccagccccctgagagtgctgctgggcaccagcctgaccatcccctgctacttcatcgaccccatgcaccccgtgaccaccgcccccagcaccgcccccctggcccccagaatcaagtggagcagagtgagcaaggagaaggaggtggtgctgctggtggccaccgagggcagagtgagagtgaacagcgcctaccaggacaaggtgagcctgcccaactaccccgccatccccagcgacgccaccctggaggtgcagagcctgagaagcaacgacagcggcgtgtacagatgcgaggtgatgcacggcatcgaggacagcgaggccaccctggaggtggtggtgaagggcatcgtgttccactacagagccatcagcaccagatacaccctggacttcgacagagcccagagagcctgcctgcagaacagcgccatcatcgccacccccgagcagctgcaggccgcctacgaggacggcttccaccagtgcgacgccggctggctggccgaccagaccgtgagataccccatccacacccccagagagggctgctacggcgacaaggacgagttccccggcgtgagaacctacggcatcagagacaccaacgagacctacgacgtgtactgcttcgccgaggagatggagggcgaggtgttctacgccaccagccccgagaagttcaccttccaggaggccgccaacgagtgcagaagactgggcgccagactggccaccaccggccagctgtacctggcctggcaggccggcatggacatgtgcagcgccggctggctggccgacagaagcgtgagataccccatcagcaaggccagacccaactgcggcggcaacctgctgggcgtgagaaccgtgtacgtgcacgccaaccagaccggctaccccgaccccagcagcagatacgacgccatctgctacaccggcgaggacttcgtggacatccccgagaacttcttcggcgtgggcggcgaggaggacatcaccgtgcagaccgtgacctggcccgacatggagctgcccctgcccagaaacatcaccgagggcgaggccagaggcagcgtgatcctgaccgtgaagcccatcttcgaggtgagccccagccccctggagcccgaggagcccttcaccttcgcccccgagatcggcgccaccgccttcgccgaggtggagaacgagaccggcgaggccaccagaccctggggcttccccacccccggcctgggccccgccaccgccttcaccagcgaggacctggtggtgcaggtgaccgccgtgcccggccagccccacctgcccggcggcgtggtgttccactacagacccggccccaccagatacagcctgaccttcgaggaggcccagcaggcctgcctgagaaccggcgccgtgatcgccagccccgagcagctgcaggccgcctacgaggccggctacgagcagtgcgacgccggctggctgagagaccagaccgtgagataccccatcgtgagccccagaaccccctgcgtgggcgacaaggacagcagccccggcgtgagaacctacggcgtgagacccagcaccgagacctacgacgtgtactgcttcgtggacagactggagggcgaggtgttcttcgccaccagactggagcagttcaccttccaggaggccctggagttctgcgagagccacaacgccaccctggccaccaccggccagctgtacgccgcctggagcagaggcctggacaagtgctacgccggctggctggccgacggcagcctgagataccccatcgtgacccccagacccgcctgcggcggcgacaagcccggcgtgagaaccgtgtacctgtaccccaaccagaccggcctgcccgaccccctgagcagacaccacgccttctgcttcagaggcatcagcgccgtgcccagccccggcgaggaggagggcggcacccccaccagccccagcggcgtggaggagtggatcgtgacccaggtggtgcccggcgtggccgccgtgcccgtggaggaggagaccaccgccgtgcccagcggcgagaccaccgccatcctggagttcaccaccgagcccgagaaccagaccgagtgggagcccgcctacacccccgtgggcaccagccccctgcccggcatcctgcccacctggccccccaccggcgccgccaccgaggagagcaccgagggccccagcgccaccgaggtgcccagcgccagcgaggagcccagccccagcgaggtgcccttccccagcgaggagcccagccccagcgaggagcccttccccagcgtgagacccttccccagcgtggagctgttccccagcgaggagcccttccccagcaaggagcccagccccagcgaggagcccagcgccagcgaggagccctacacccccagcccccccgtgcccagctggaccgagctgcccagcagcggcgaggagagcggcgcccccgacgtgagcggcgacttcaccggcagcggcgacgtgagcggccacctggacttcagcggccagctgagcggcgacagagccagcggcctgcccagcggcgacctggacagcagcggcctgaccagcaccgtgggcagcggcctgcccgtggagagcggcctgcccagcggcgacgaggagagaatcgagtggcccagcacccccaccgtgggcgagctgcccagcggcgccgagatcctggagggcagcgccagcggcgtgggcgacctgagcggcctgcccagcggcgaggtgctggagaccagcgccagcggcgtgggcgacctgagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccaccgcccccggcgtggaggagatcagcggcctgcccagcggcgaggtgctggagaccaccgcccccggcgtggacgagatcagcggcctgcccagcggcgaggtgctggagaccaccgcccccggcgtggaggagatcagcggcctgcccagcggcgaggtgctggagaccagcaccagcgccgtgggcgacctgagcggcctgcccagcggcggcgaggtgctggagatcagcgtgagcggcgtggaggacatcagcggcctgcccagcggcgaggtggtggagaccagcgccagcggcatcgaggacgtgagcgagctgcccagcggcgagggcctggagaccagcgccagcggcgtggaggacctgagcagactgcccagcggcgaggaggtgctggagatcagcgccagcggcttcggcgacctgagcggcctgcccagcggcggcgagggcctggagaccagcgccagcgaggtgggcaccgacctgagcggcctgcccagcggcagagagggcctggagaccagcgccagcggcgccgaggacctgagcggcctgcccagcggcaaggaggacctggtgggcagcgccagcggcgacctggacctgggcaagctgcccagcggcaccctgggcagcggccaggcccccgagaccagcggcctgcccagcggcttcagcggcgagtacagcggcgtggacctgggcagcggcccccccagcggcctgcccgacttcagcggcctgcccagcggcttccccaccgtgagcctggtggacagcaccctggtggaggtggtgaccgccagcaccgccagcgagctggagggcagaggcaccatcggcatcagcggcgccggcgagatcagcggcctgcccagcagcgagctggacatcagcggcagagccagcggcctgcccagcggcaccgagctgagcggccaggccagcggcagccccgacgtgagcggcgagatccccggcctgttcggcgtgagcggccagcccagcggcttccccgacaccagcggcgagaccagcggcgtgaccgagctgagcggcctgagcagcggccagcccggcatcagcggcgaggccagcggcgtgctgtacggcaccagccagcccttcggcatcaccgacctgagcggcgagaccagcggcgtgcccgacctgagcggccagcccagcggcctgcccggcttcagcggcgccaccagcggcgtgcccgacctggtgagcggcaccaccagcggcagcggcgagagcagcggcatcaccttcgtggacaccagcctggtggaggtggcccccaccaccttcaaggaggaggagggcctgggcagcgtggagctgagcggcctgcccagcggcgaggccgacctgagcggcaagagcggcatggtggacgtgagcggccagttcagcggcaccgtggacagcagcggcttcaccagccagacccccgagttcagcggcctgcccagcggcatcgccgaggtgagcggcgagagcagcagagccgagatcggcagcagcctgcccagcggcgcctactacggcagcggcacccccagcagcttccccaccgtgagcctggtggacagaaccctggtggagagcgtgacccaggcccccaccgcccaggaggccggcgagggccccagcggcatcctggagctgagcggcgcccacagcggcgcccccgacatgagcggcgagcacagcggcttcctggacctgagcggcctgcagagcggcctgatcgagcccagcggcgagccccccggcaccccctacttcagcggcgacttcgccagcaccaccaacgtgagcggcgagagcagcgtggccatgggcaccagcggcgaggccagcggcctgcccgaggtgaccctgatcaccagcgagttcgtggagggcgtgaccgagcccaccatcagccaggagctgggccagagaccccccgtgacccacaccccccagctgttcgagagcagcggcaaggtgagcaccgccggcgacatcagcggcgccacccccgtgctgcccggcagcggcgtggaggtgagcagcgtgcccgagagcagcagcgagaccagcgcctaccccgaggccggcttcggcgccagcgccgcccccgaggccagcagagaggacagcggcagccccgacctgagcgagaccaccagcgccttccacgaggccaacctggagagaagcagcggcctgggcgtgagcggcagcaccctgaccttccaggagggcgaggccagcgccgcccccgaggtgagcggcgagagcaccaccaccagcgacgtgggcaccgaggcccccggcctgcccagcgccacccccaccgccagcggcgacagaaccgagatcagcggcgacctgagcggccacaccagccagctgggcgtggtgatcagcaccagcatccccgagagcgagtggacccagcagacccagagacccgccgagacccacctggagatcgagagcagcagcctgctgtacagcggcgaggagacccacaccgtggagaccgccaccagccccaccgacgccagcatccccgccagccccgagtggaagagagagagcgagagcaccgccgccgaccaggaggtgtgcgaggagggctggaacaagtaccagggccactgctacagacacttccccgacagagagacctgggtggacgccgagagaagatgcagagagcagcagagccacctgagcagcatcgtgacccccgaggagcaggagttcgtgaacaacaacgcccaggactaccagtggatcggcctgaacgacagaaccatcgagggcgacttcagatggagcgacggccaccccatgcagttcgagaactggagacccaaccagcccgacaacttcttcgccgccggcgaggactgcgtggtgatgatctggcacgagaagggcgagtggaacgacgtgccctgcaactaccacctgcccttcacctgcaagaagggcaccgccaccacctacaagagaagactgcagaagagaagcagcagacaccccagaagaagcagacccagcaccgcccactag

SEQ ID NO: 72337 - DNA, 7593 bp, Artificial Sequence
  Description of Artificial Sequence: Synthetic coding sequence
atgaccaccctgctgtgggtgttcgtgaccctgagagtgatcaccgccgccgtgaccgtggagaccagcgaccacgacaacagcctgagcgtgagcatcccccagcccagccccctgagagtgctgctgggcaccagcctgaccatcccctgctacttcatcgaccccatgcaccccgtgaccaccgcccccagcaccgcccccctggcccccagaatcaagtggagcagagtgagcaaggagaaggaggtggtgctgctggtggccaccgagggcagagtgagagtgaacagcgcctaccaggacaaggtgagcctgcccaactaccccgccatccccagcgacgccaccctggaggtgcagagcctgagaagcaacgacagcggcgtgtacagatgcgaggtgatgcacggcatcgaggacagcgaggccaccctggaggtggtggtgaagggcatcgtgttccactacagagccatcagcaccagatacaccctggacttcgacagagcccagagagcctgcctgcagaacagcgccatcatcgccacccccgagcagctgcaggccgcctacgaggacggcttccaccagtgcgacgccggctggctggccgaccagaccgtgagataccccatccacacccccagagagggctgctacggcgacaaggacgagttccccggcgtgagaacctacggcatcagagacaccaacgagacctacgacgtgtactgcttcgccgaggagatggagggcgaggtgttctacgccaccagccccgagaagttcaccttccaggaggccgccaacgagtgcagaagactgggcgccagactggccaccaccggccagctgtacctggcctggcaggccggcatggacatgtgcagcgccggctggctggccgacagaagcgtgagataccccatcagcaaggccagacccaactgcggcggcaacctgctgggcgtgagaaccgtgtacgtgcacgccaaccagaccggctaccccgaccccagcagcagatacgacgccatctgctacaccggcgaggacttcgtggacatccccgagaacttcttcggcgtgggcggcgaggaggacatcaccgtgcagaccgtgacctggcccgacatggagctgcccctgcccagaaacatcaccgagggcgaggccagaggcagcgtgatcctgaccgtgaagcccatcttcgaggtgagccccagccccctggagcccgaggagcccttcaccttcgcccccgagatcggcgccaccgccttcgccgaggtggagaacgagaccggcgaggccaccagaccctggggcttccccacccccggcctgggccccgccaccgccttcaccagcgaggacctggtggtgcaggtgaccgccgtgcccggccagccccacctgcccggcggcgtggtgttccactacagacccggccccaccagatacagcctgaccttcgaggaggcccagcaggcctgcctgagaaccggcgccgtgatcgccagccccgagcagctgcaggccgcctacgaggccggctacgagcagtgcgacgccggctggctgagagaccagaccgtgagataccccatcgtgagccccagaaccccctgcgtgggcgacaaggacagcagccccggcgtgagaacctacggcgtgagacccagcaccgagacctacgacgtgtactgcttcgtggacagactggagggcgaggtgttcttcgccaccagactggagcagttcaccttccaggaggccctggagttctgcgagagccacaacgccaccctggccaccaccggccagctgtacgccgcctggagcagaggcctggacaagtgctacgccggctggctggccgacggcagcctgagataccccatcgtgacccccagacccgcctgcggcggcgacaagcccggcgtgagaaccgtgtacctgtaccccaaccagaccggcctgcccgaccccctgagcagacaccacgccttctgcttcagaggcatcagcgccgtgcccagccccggcgaggaggagggcggcacccccaccagccccagcggcgtggaggagtggatcgtgacccaggtggtgcccggcgtggccgccgtgcccgtggaggaggagaccaccgccgtgcccagcggcgagaccaccgccatcctggagttcaccaccgagcccgagaaccagaccgagtgggagcccgcctacacccccgtgggcaccagccccctgcccggcatcctgcccacctggccccccaccggcgccgccaccgaggagagcaccgagggccccagcgccaccgaggtgcccagcgccagcgaggagcccagccccagcgaggtgcccttccccagcgaggagcccagccccagcgaggagcccttccccagcgtgagacccttccccagcgtggagctgttccccagcgaggagcccttccccagcaaggagcccagccccagcgaggagcccagcgccagcgaggagccctacacccccagcccccccgtgcccagctggaccgagctgcccagcagcggcgaggagagcggcgcccccgacgtgagcggcgacttcaccggcagcggcgacgtgagcggccacctggacttcagcggccagctgagcggcgacagagccagcggcctgcccagcggcgacctggacagcagcggcctgaccagcaccgtgggcagcggcctgcccgtggagagcggcctgcccagcggcgacgaggagagaatcgagtggcccagcacccccaccgtgggcgagctgcccagcggcgccgagatcctggagggcagcgccagcggcgtgggcgacctgagcggcctgcccagcggcgaggtgctggagaccagcgccagcggcgtgggcgacctgagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccaccgcccccggcgtggaggagatcagcggcctgcccagcggcgaggtgctggagaccaccgcccccggcgtggacgagatcagcggcctgcccagcggcgaggtgctggagaccaccgcccccggcgtggaggagatcagcggcctgcccagcggcgaggtgctggagaccagcaccagcgccgtgggcgacctgagcggcctgcccagcggcggcgaggtgctggagatcagcgtgagcggcgtggaggacatcagcggcctgcccagcggcgaggtggtggagaccagcgccagcggcatcgaggacgtgagcgagctgcccagcggcgagggcctggagaccagcgccagcggcgtggaggacctgagcagactgcccagcggcgaggaggtgctggagatcagcgccagcggcttcggcgacctgagcggcctgcccagcggcggcgagggcctggagaccagcgccagcgaggtgggcaccgacctgagcggcctgcccagcggcagagagggcctggagaccagcgccagcggcgccgaggacctgagcggcctgcccagcggcaaggaggacctggtgggcagcgccagcggcgacctggacctgggcaagctgcccagcggcaccctgggcagcggccaggcccccgagaccagcggcctgcccagcggcttcagcggcgagtacagcggcgtggacctgggcagcggcccccccagcggcctgcccgacttcagcggcctgcccagcggcttccccaccgtgagcctggtggacagcaccctggtggaggtggtgaccgccagcaccgccagcgagctggagggcagaggcaccatcggcatcagcggcgccggcgagatcagcggcctgcccagcagcgagctggacatcagcggcagagccagcggcctgcccagcggcaccgagctgagcggccaggccagcggcagccccgacgtgagcggcgagatccccggcctgttcggcgtgagcggccagcccagcggcttccccgacaccagcggcgagaccagcggcgtgaccgagctgagcggcctgagcagcggccagcccggcatcagcggcgaggccagcggcgtgctgtacggcaccagccagcccttcggcatcaccgacctgagcggcgagaccagcggcgtgcccgacctgagcggccagcccagcggcctgcccggcttcagcggcgccaccagcggcgtgcccgacctggtgagcggcaccaccagcggcagcggcgagagcagcggcatcaccttcgtggacaccagcctggtggaggtggcccccaccaccttcaaggaggaggagggcctgggcagcgtggagctgagcggcctgcccagcggcgaggccgacctgagcggcaagagcggcatggtggacgtgagcggccagttcagcggcaccgtggacagcagcggcttcaccagccagacccccgagttcagcggcctgcccagcggcatcgccgaggtgagcggcgagagcagcagagccgagatcggcagcagcctgcccagcggcgcctactacggcagcggcacccccagcagcttccccaccgtgagcctggtggacagaaccctggtggagagcgtgacccaggcccccaccgcccaggaggccggcgagggccccagcggcatcctggagctgagcggcgcccacagcggcgcccccgacatgagcggcgagcacagcggcttcctggacctgagcggcctgcagagcggcctgatcgagcccagcggcgagccccccggcaccccctacttcagcggcgacttcgccagcaccaccaacgtgagcggcgagagcagcgtggccatgggcaccagcggcgaggccagcggcctgcccgaggtgaccctgatcaccagcgagttcgtggagggcgtgaccgagcccaccatcagccaggagctgggccagagaccccccgtgacccacaccccccagctgttcgagagcagcggcaaggtgagcaccgccggcgacatcagcggcgccacccccgtgctgcccggcagcggcgtggaggtgagcagcgtgcccgagagcagcagcgagaccagcgcctaccccgaggccggcttcggcgccagcgccgcccccgaggccagcagagaggacagcggcagccccgacctgagcgagaccaccagcgccttccacgaggccaacctggagagaagcagcggcctgggcgtgagcggcagcaccctgaccttccaggagggcgaggccagcgccgcccccgaggtgagcggcgagagcaccaccaccagcgacgtgggcaccgaggcccccggcctgcccagcgccacccccaccgccagcggcgacagaaccgagatcagcggcgacctgagcggccacaccagccagctgggcgtggtgatcagcaccagcatccccgagagcgagtggacccagcagacccagagacccgccgagacccacctggagatcgagagcagcagcctgctgtacagcggcgaggagacccacaccgtggagaccgccaccagccccaccgacgccagcatccccgccagccccgagtggaagagagagagcgagagcaccgccgccgcccccgccagaagctgcgccgaggagccctgcggcgccggcacctgcaaggagaccgagggccacgtgatctgcctgtgcccccccggctacaccggcgagcactgcaacatcgaccaggaggtgtgcgaggagggctggaacaagtaccagggccactgctacagacacttccccgacagagagacctgggtggacgccgagagaagatgcagagagcagcagagccacctgagcagcatcgtgacccccgaggagcaggagttcgtgaacaacaacgcccaggactaccagtggatcggcctgaacgacagaaccatcgagggcgacttcagatggagcgacggccaccccatgcagttcgagaactggagacccaaccagcccgacaacttcttcgccgccggcgaggactgcgtggtgatgatctggcacgagaagggcgagtggaacgacgtgccctgcaactaccacctgcccttcacctgcaagaagggcaccgtggcctgcggcgagccccccgtggtggagcacgccagaaccttcggccagaagaaggacagatacgagatcaacagcctggtgagataccagtgcaccgagggcttcgtgcagagacacatgcccaccatcagatgccagcccagcggccactgggaggagccccagatcacctgcaccgaccccaccacctacaagagaagactgcagaagagaagcagcagacaccccagaagaagcagacccagcaccgcccactag

SEQ ID NO: 72338 - DNA, 7479 bp, Artificial Sequence
  Description of Artificial Sequence: Synthetic coding sequence
atgaccaccctgctgtgggtgttcgtgaccctgagagtgatcaccgccgccgtgaccgtggagaccagcgaccacgacaacagcctgagcgtgagcatcccccagcccagccccctgagagtgctgctgggcaccagcctgaccatcccctgctacttcatcgaccccatgcaccccgtgaccaccgcccccagcaccgcccccctggcccccagaatcaagtggagcagagtgagcaaggagaaggaggtggtgctgctggtggccaccgagggcagagtgagagtgaacagcgcctaccaggacaaggtgagcctgcccaactaccccgccatccccagcgacgccaccctggaggtgcagagcctgagaagcaacgacagcggcgtgtacagatgcgaggtgatgcacggcatcgaggacagcgaggccaccctggaggtggtggtgaagggcatcgtgttccactacagagccatcagcaccagatacaccctggacttcgacagagcccagagagcctgcctgcagaacagcgccatcatcgccacccccgagcagctgcaggccgcctacgaggacggcttccaccagtgcgacgccggctggctggccgaccagaccgtgagataccccatccacacccccagagagggctgctacggcgacaaggacgagttccccggcgtgagaacctacggcatcagagacaccaacgagacctacgacgtgtactgcttcgccgaggagatggagggcgaggtgttctacgccaccagccccgagaagttcaccttccaggaggccgccaacgagtgcagaagactgggcgccagactggccaccaccggccagctgtacctggcctggcaggccggcatggacatgtgcagcgccggctggctggccgacagaagcgtgagataccccatcagcaaggccagacccaactgcggcggcaacctgctgggcgtgagaaccgtgtacgtgcacgccaaccagaccggctaccccgaccccagcagcagatacgacgccatctgctacaccggcgaggacttcgtggacatccccgagaacttcttcggcgtgggcggcgaggaggacatcaccgtgcagaccgtgacctggcccgacatggagctgcccctgcccagaaacatcaccgagggcgaggccagaggcagcgtgatcctgaccgtgaagcccatcttcgaggtgagccccagccccctggagcccgaggagcccttcaccttcgcccccgagatcggcgccaccgccttcgccgaggtggagaacgagaccggcgaggccaccagaccctggggcttccccacccccggcctgggccccgccaccgccttcaccagcgaggacctggtggtgcaggtgaccgccgtgcccggccagccccacctgcccggcggcgtggtgttccactacagacccggccccaccagatacagcctgaccttcgaggaggcccagcaggcctgcctgagaaccggcgccgtgatcgccagccccgagcagctgcaggccgcctacgaggccggctacgagcagtgcgacgccggctggctgagagaccagaccgtgagataccccatcgtgagccccagaaccccctgcgtgggcgacaaggacagcagccccggcgtgagaacctacggcgtgagacccagcaccgagacctacgacgtgtactgcttcgtggacagactggagggcgaggtgttcttcgccaccagactggagcagttcaccttccaggaggccctggagttctgcgagagccacaacgccaccctggccaccaccggccagctgtacgccgcctggagcagaggcctggacaagtgctacgccggctggctggccgacggcagcctgagataccccatcgtgacccccagacccgcctgcggcggcgacaagcccggcgtgagaaccgtgtacctgtaccccaaccagaccggcctgcccgaccccctgagcagacaccacgccttctgcttcagaggcatcagcgccgtgcccagccccggcgaggaggagggcggcacccccaccagccccagcggcgtggaggagtggatcgtgacccaggtggtgcccggcgtggccgccgtgcccgtggaggaggagaccaccgccgtgcccagcggcgagaccaccgccatcctggagttcaccaccgagcccgagaaccagaccgagtgggagcccgcctacacccccgtgggcaccagccccctgcccggcatcctgcccacctggccccccaccggcgccgccaccgaggagagcaccgagggccccagcgccaccgaggtgcccagcgccagcgaggagcccagccccagcgaggtgcccttccccagcgaggagcccagccccagcgaggagcccttccccagcgtgagacccttccccagcgtggagctgttccccagcgaggagcccttccccagcaaggagcccagccccagcgaggagcccagcgccagcgaggagccctacacccccagcccccccgtgcccagctggaccgagctgcccagcagcggcgaggagagcggcgcccccgacgtgagcggcgacttcaccggcagcggcgacgtgagcggccacctggacttcagcggccagctgagcggcgacagagccagcggcctgcccagcggcgacctggacagcagcggcctgaccagcaccgtgggcagcggcctgcccgtggagagcggcctgcccagcggcgacgaggagagaatcgagtggcccagcacccccaccgtgggcgagctgcccagcggcgccgagatcctggagggcagcgccagcggcgtgggcgacctgagcggcctgcccagcggcgaggtgctggagaccagcgccagcggcgtgggcgacctgagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccaccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccgccgcccccggcgtggaggacatcagcggcctgcccagcggcgaggtgctggagaccaccgcccccggcgtggaggagatcagcggcctgcccagcggcgaggtgctggagaccaccgcccccggcgtggacgagatcagcggcctgcccagcggcgaggtgctggagaccaccgcccccggcgtggaggagatcagcggcctgcccagcggcgaggtgctggagaccagcaccagcgccgtgggcgacctgagcggcctgcccagcggcggcgaggtgctggagatcagcgtgagcggcgtggaggacatcagcggcctgcccagcggcgaggtggtggagaccagcgccagcggcatcgaggacgtgagcgagctgcccagcggcgagggcctggagaccagcgccagcggcgtggaggacctgagcagactgcccagcggcgaggaggtgctggagatcagcgccagcggcttcggcgacctgagcggcctgcccagcggcggcgagggcctggagaccagcgccagcgaggtgggcaccgacctgagcggcctgcccagcggcagagagggcctggagaccagcgccagcggcgccgaggacctgagcggcctgcccagcggcaaggaggacctggtgggcagcgccagcggcgacctggacctgggcaagctgcccagcggcaccctgggcagcggccaggcccccgagaccagcggcctgcccagcggcttcagcggcgagtacagcggcgtggacctgggcagcggcccccccagcggcctgcccgacttcagcggcctgcccagcggcttccccaccgtgagcctggtggacagcaccctggtggaggtggtgaccgccagcaccgccagcgagctggagggcagaggcaccatcggcatcagcggcgccggcgagatcagcggcctgcccagcagcgagctggacatcagcggcagagccagcggcctgcccagcggcaccgagctgagcggccaggccagcggcagccccgacgtgagcggcgagatccccggcctgttcggcgtgagcggccagcccagcggcttccccgacaccagcggcgagaccagcggcgtgaccgagctgagcggcctgagcagcggccagcccggcatcagcggcgaggccagcggcgtgctgtacggcaccagccagcccttcggcatcaccgacctgagcggcgagaccagcggcgtgcccgacctgagcggccagcccagcggcctgcccggcttcagcggcgccaccagcggcgtgcccgacctggtgagcggcaccaccagcggcagcggcgagagcagcggcatcaccttcgtggacaccagcctggtggaggtggcccccaccaccttcaaggaggaggagggcctgggcagcgtggagctgagcggcctgcccagcggcgaggccgacctgagcggcaagagcggcatggtggacgtgagcggccagttcagcggcaccgtggacagcagcggcttcaccagccagacccccgagttcagcggcctgcccagcggcatcgccgaggtgagcggcgagagcagcagagccgagatcggcagcagcctgcccagcggcgcctactacggcagcggcacccccagcagcttccccaccgtgagcctggtggacagaaccctggtggagagcgtgacccaggcccccaccgcccaggaggccggcgagggccccagcggcatcctggagctgagcggcgcccacagcggcgcccccgacatgagcggcgagcacagcggcttcctggacctgagcggcctgcagagcggcctgatcgagcccagcggcgagccccccggcaccccctacttcagcggcgacttcgccagcaccaccaacgtgagcggcgagagcagcgtggccatgggcaccagcggcgaggccagcggcctgcccgaggtgaccctgatcaccagcgagttcgtggagggcgtgaccgagcccaccatcagccaggagctgggccagagaccccccgtgacccacaccccccagctgttcgagagcagcggcaaggtgagcaccgccggcgacatcagcggcgccacccccgtgctgcccggcagcggcgtggaggtgagcagcgtgcccgagagcagcagcgagaccagcgcctaccccgaggccggcttcggcgccagcgccgcccccgaggccagcagagaggacagcggcagccccgacctgagcgagaccaccagcgccttccacgaggccaacctggagagaagcagcggcctgggcgtgagcggcagcaccctgaccttccaggagggcgaggccagcgccgcccccgaggtgagcggcgagagcaccaccaccagcgacgtgggcaccgaggcccccggcctgcccagcgccacccccaccgccagcggcgacagaaccgagatcagcggcgacctgagcggccacaccagccagctgggcgtggtgatcagcaccagcatccccgagagcgagtggacccagcagacccagagacccgccgagacccacctggagatcgagagcagcagcctgctgtacagcggcgaggagacccacaccgtggagaccgccaccagccccaccgacgccagcatccccgccagccccgagtggaagagagagagcgagagcaccgccgccgaccaggaggtgtgcgaggagggctggaacaagtaccagggccactgctacagacacttccccgacagagagacctgggtggacgccgagagaagatgcagagagcagcagagccacctgagcagcatcgtgacccccgaggagcaggagttcgtgaacaacaacgcccaggactaccagtggatcggcctgaacgacagaaccatcgagggcgacttcagatggagcgacggccaccccatgcagttcgagaactggagacccaaccagcccgacaacttcttcgccgccggcgaggactgcgtggtgatgatctggcacgagaagggcgagtggaacgacgtgccctgcaactaccacctgcccttcacctgcaagaagggcaccgtggcctgcggcgagccccccgtggtggagcacgccagaaccttcggccagaagaaggacagatacgagatcaacagcctggtgagataccagtgcaccgagggcttcgtgcagagacacatgcccaccatcagatgccagcccagcggccactgggaggagccccagatcacctgcaccgaccccaccacctacaagagaagactgcagaagagaagcagcagacaccccagaagaagcagacccagcaccgcccactag

SEQ ID NO: 72339 - DNA, 7593 bp, Artificial Sequence; identical to SEQ ID NO: 72337
  Description of Artificial Sequence: Synthetic coding sequence

SEQ ID NO: 72340 - DNA, 399 bp, Artificial Sequence
  Description of Artificial Sequence: Synthetic coding sequence
atgctgaccgccgccgtgctgagctgcgccctgctgctggccctgcccgccaccagaggcgcccagatgggcctggcccccatggagggcatcagaagacccgaccaggccctgctgcccgagctgcccggcctgggcctgagagcccccctgaagaagaccaccgccgagcaggccgaggaggacctgctgcaggaggcccaggccctggccgaggtgctggacctgcaggacagagagcccagaagcagcagaagatgcgtgagactgcacgagagctgcctgggccagcaggtgccctgctgcgacccctgcgccacctgctactgcagattcttcaacgccttctgctactgcagaaagctgggcaccgccatgaacccctgcagcagaacctag

SEQ ID NO: 72341 - DNA, 399 bp, Artificial Sequence
  Description of Artificial Sequence: Synthetic coding sequence
atggacgtgaccagactgctgctggccaccctgctggtgttcctgtgcttcttcaccgccaacagccacctgccccccgaggagaagctgagagacgacagaagcctgagaagcaacagcagcgtgaacctgctggacgtgcccagcgtgagcatcgtggccctgaacaagaagagcaagcagatcggcagaaaggccgccgagaagaagagaagcagcaagaaggaggccagcatgaagaaggtggtgagacccagaacccccctgagcgccccctgcgtggccaccagaaacagctgcaagccccccgcccccgcctgctgcgacccctgcgccagctgccagtgcagattcttcagaagcgcctgcagctgcagagtgctgagcctgaactgctag

SEQ ID NO: 72342 - DNA, 936 bp, Artificial Sequence
  Description of Artificial Sequence: Synthetic coding sequence
atggccctggaggtggtgttcctggccagaggccccagcggcctgctgctgtacaacggccagaagaccgacggcaagggcgacttcgtgagcctggccctgagagacagaagactggagttcagatacgacctgggcaagggcgccgccgtgatcagaagcagagagcccgtgaccctgggcgcctggaccagagtgagcctggagagaaacggcagaaagggcgccctgagagtgggcgacggccccagagtgctgggcgagagccccaagagcagaaaggtgccccacaccgtgctgaacctgaaggagcccctgtacgtgggcggcgcccccgacttcagcaagctggccagagccgccgccgtgagcagcggcttcgacggcgccatccagctggtgagcctgggcggcagacagctgctgacccccgagcacgtgctgagacaggtggacgtgaccagcttcgccggccacccctgcaccagagccagcggccacccctgcctgaacggcgccagctgcgtgcccagagaggccgcctacgtgtgcctgtgccccggcggcttcagcggcccccactgcgagaagggcctggtggagaagagcgccggcgacgtggacaccctggccttcgacggcagaaccttcgtggagtacctgaacgccgtgaccgagagcgagctggccaacgagatccccgtgcccgagaccctggacagcggcgccctgcacagcgagaaggccctgcagagcaaccacttcgagctgagcctgagaaccgaggccacccagggcctggtgctgtggagcggcaaggccaccgagagagccgactacgtggccctggccatcgtggacggccacctgcagctgagctacaacctgggcagccagcccgtggtgctgagaagcaccgtgcccgtgaacacctag

SEQ ID NO: 72343 - DNA, 6138 bp, Artificial Sequence
  Description of Artificial Sequence: Synthetic coding sequence
atggccggcagaagccaccccggccccctgagacccctgctgcccctgctggtggtggccgcctgcgtgctgcccggcgccggcggcacctgccccgagagagccctggagagaagagaggaggaggccaacgtggtgctgaccggcaccgtggaggagatcctgaacgtggaccccgtgcagcacacctacagctgcaaggtgagagtgtggagatacctgaagggcaaggacctggtggccagagagagcctgctggacggcggcaacaaggtggtgatcagcggcttcggcgaccccctgatctgcgacaaccaggtgagcaccggcgacaccagaatcttcttcgtgaaccccgcccccccctacctgtggcccgcccacaagaacgagctgatgctgaacagcagcctgatgagaatcaccctgagaaacctggaggaggtggagttctgcgtggaggacaagcccggcacccacttcacccccgtgccccccaccccccccgacgcctgcagaggcatgctgtgcggcttcggcgccgtgtgcgagcccaacgccgagggccccggcagagccagctgcgtgtgcaagaagagcccctgccccagcgtggtggcccccgtgtgcggcagcgacgccagcacctacagcaacgagtgcgagctgcagagagcccagtgcagccagcagagaagaatcagactgctgagcagaggcccctgcggcagcagagacccctgcagcaacgtgacctgcagcttcggcagcacctgcgccagaagcgccgacggcctgaccgccagctgcctgtgccccgccacctgcagaggcgcccccgagggcaccgtgtgcggcagcgacggcgccgactaccccggcgagtgccagctgctgagaagagcctgcgccagacaggagaacgtgttcaagaagttcgacggcccctgcgacccctgccagggcgccctgcccgaccccagcagaagctgcagagtgaaccccagaaccagaagacccgagatgctgctgagacccgagagctgccccgccagacaggcccccgtgtgcggcgacgacggcgtgacctacgagaacgactgcgtgatgggcagaagcggcgccgccagaggcctgctgctgcagaaggtgagaagcggccagtgccagggcagagaccagtgccccgagccctgcagattcaacgccgtgtgcctgagcagaagaggcagacccagatgcagctgcgacagagtgacctgcgacggcgcctacagacccgtgtgcgcccaggacggcagaacctacgacagcgactgctggagacagcaggccgagtgcagacagcagagagccatccccagcaagcaccagggcccctgcgaccaggcccccagcccctgcctgggcgtgcagtgcgccttcggcgccacctgcgccgtgaagaacggccaggccgcctgcgagtgcctgcaggcctgcagcagcctgtacgaccccgtgtgcggcagcgacggcgtgacctacggcagcgcctgcgagctggaggccaccgcctgcaccctgggcagagagatccaggtggccagaaagggcccctgcgacagatgcggccagtgcagattcggcgccctgtgcgaggccgagaccggcagatgcgtgtgccccagcgagtgcgtggccctggcccagcccgtgtgcggcagcgacggccacacctaccccagcgagtgcatgctgcacgtgcacgcctgcacccaccagatcagcctgcacgtggccagcgccggcccctgcgagacctgcggcgacgccgtgtgcgccttcggcgccgtgtgcagcgccggccagtgcgtgtgccccagatgcgagcaccccccccccggccccgtgtgcggcagcgacggcgtgacctacggcagcgcctgcgagctgagagaggccgcctgcctgcagcagacccagatcgaggaggccagagccggcccctgcgagcaggccgagtgcggcagcggcggcagcggcagcggcgaggacggcgactgcgagcaggagctgtgcagacagagaggcggcatctgggacgaggacagcgaggacggcccctgcgtgtgcgacttcagctgccagagcgtgcccggcagccccgtgtgcggcagcgacggcgtgacctacagcaccgagtgcgagctgaagaaggccagatgcgagagccagagaggcctgtacgtggccgcccagggcgcctgcagaggccccaccttcgcccccctgccccccgtggcccccctgcactgcgcccagaccccctacggctgctgccaggacaacatcaccgccgccagaggcgtgggcctggccggctgccccagcgcctgccagtgcaacccccacggcagctacggcggcacctgcgaccccgccaccggccagtgcagctgcagacccggcgtgggcggcctgagatgcgacagatgcgagcccggcttctggaacttcagaggcatcgtgaccgacggcagaagcggctgcaccccctgcagctgcgacccccagggcgccgtgagagacgactgcgagcagatgaccggcctgtgcagctgcaagcccggcgtggccggccccaagtgcggccagtgccccgacggcagagccctgggccccgccggctgcgaggccgacgccagcgcccccgccacctgcgccgagatgagatgcgagttcggcgccagatgcgtggaggagagcggcagcgcccactgcgtgtgccccatgctgacctgccccgaggccaacgccaccaaggtgtgcggcagcgacggcgtgacctacggcaacgagtgccagctgaagaccatcgcctgcagacagggcctgcagatcagcatccagagcctgggcccctgccaggaggccgtggcccccagcacccaccccaccagcgccagcgtgaccgtgaccacccccggcctgctgctgagccaggccctgcccgccccccccggcgccctgcccctggcccccagcagcaccgcccacagccagaccacccccccccccagcagcagacccagaaccaccgccagcgtgcccagaaccaccgtgtggcccgtgctgaccgtgccccccaccgcccccagccccgcccccagcctggtggccagcgccttcggcgagagcggcagcaccgacggcagcagcgacgaggagctgagcggcgaccaggaggccagcggcggcggcagcggcggcctggagcccctggagggcagcagcgtggccacccccggcccccccgtggagagagccagctgctacaacagcgccctgggctgctgcagcgacggcaagacccccagcctggacgccgagggcagcaactgccccgccaccaaggtgttccagggcgtgctggagctggagggcgtggagggccaggagctgttctacacccccgagatggccgaccccaagagcgagctgttcggcgagaccgccagaagcatcgagagcaccctggacgacctgttcagaaacagcgacgtgaagaaggacttcagaagcgtgagactgagagacctgggccccggcaagagcgtgagagccatcgtggacgtgcacttcgaccccaccaccgccttcagagcccccgacgtggccagagccctgctgagacagatccaggtgagcagaagaagaagcctgggcgtgagaagacccctgcaggagcacgtgagattcatggacttcgactggttccccgccttcatcaccggcgccaccagcggcgccatcgccgccggcgccaccgccagagccaccaccgccagcagactgcccagcagcgccgtgacccccagagccccccaccccagccacaccagccagcccgtggccaagaccaccgccgcccccaccaccagaagaccccccaccaccgcccccagcagagtgcccggcagaagaccccccgccccccagcagccccccaagccctgcgacagccagccctgcttccacggcggcacctgccaggactgggccctgggcggcggcttcacctgcagctgccccgccggcagaggcggcgccgtgtgcgagaaggtgctgggcgcccccgtgcccgccttcgagggcagaagcttcctggccttccccaccctgagagcctaccacaccctgagactggccctggagttcagagccctggagccccagggcctgctgctgtacaacggcaacgccagaggcaaggacttcctggccctggccctgctggacggcagagtgcagctgagattcgacaccggcagcggccccgccgtgctgaccagcgccgtgcccgtggagcccggccagtggcacagactggagctgagcagacactggagaagaggcaccctgagcgtggacggcgagacccccgtgctgggcgagagccccagcggcaccgacggcctgaacctggacaccgacctgttcgtgggcggcgtgcccgaggaccaggccgccgtggccctggagagaaccttcgtgggcgccggcctgagaggctgcatcagactgctggacgtgaacaaccagagactggagctgggcatcggccccggcgccgccaccagaggcagcggcgtgggcgagtgcggcgaccacccctgcctgcccaacccctgccacggcggcgccccctgccagaacctggaggccggcagattccactgccagtgcccccccggcagagtgggccccacctgcgccgacgagaagagcccctgccagcccaacccctgccacggcgccgccccctgcagagtgctgcccgagggcggcgcccagtgcgagtgccccctgggcagagagggcaccttctgccagaccgccagcggccaggacggcagcggccccttcctggccgacttcaacggcttcagccacctggagctgagaggcctgcacaccttcgccagagacctgggcgagaagatggccctggaggtggtgttcctggccagaggccccagcggcctgctgctgtacaacggccagaagaccgacggcaagggcgacttcgtgagcctggccctgagagacagaagactggagttcagatacgacctgggcaagggcgccgccgtgatcagaagcagagagcccgtgaccctgggcgcctggaccagagtgagcctggagagaaacggcagaaagggcgccctgagagtgggcgacggccccagagtgctgggcgagagccccgtgccccacaccgtgctgaacctgaaggagcccctgtacgtgggcggcgcccccgacttcagcaagctggccagagccgccgccgtgagcagcggcttcgacggcgccatccagctggtgagcctgggcggcagacagctgctgacccccgagcacgtgctgagacaggtggacgtgaccagcttcgccggccacccctgcaccagagccagcggccacccctgcctgaacggcgccagctgcgtgcccagagaggccgcctacgtgtgcctgtgccccggcggcttcagcggcccccactgcgagaagggcctggtggagaagagcgccggcgacgtggacaccctggccttcgacggcagaaccttcgtggagtacctgaacgccgtgaccgagagcgagaaggccctgcagagcaaccacttcgagctgagcctgagaaccgaggccacccagggcctggtgctgtggagcggcaaggccaccgagagagccgactacgtggccctggccatcgtggacggccacctgcagctgagctacaacctgggcagccagcccgtggtgctgagaagcaccgtgcccgtgaacaccaacagatggctgagagtggtggcccacagagagcagagagagggcagcctgcaggtgggcaacgaggcccccgtgaccggcagcagccccctgggcgccacccagctggacaccgacggcgccctgtggctgggcggcctgcccgagctgcccgtgggccccgccctgcccaaggcctacggcaccggcttcgtgggctgcctgagagacgtggtggtgggcagacaccccctgcacctgctggaggacgccgtgaccaagcccgagctgagaccctgccccaccccctag

SEQ ID NO: 72344 - DNA, 816 bp, Artificial Sequence
  Description of Artificial Sequence: Synthetic coding sequence
tgaagatacgacctgggcaagggcgccgccgtgatcagaagcagagagcccgtgaccctgggcgcctggaccagagtgagcctggagagaaacggcagaaagggcgccctgagagtgggcgacggccccagagtgctgggcgagagccccaagagcagaaaggtgccccacaccgtgctgaacctgaaggagcccctgtacgtgggcggcgcccccgacttcagcaagctggccagagccgccgccgtgagcagcggcttcgacggcgccatccagctggtgagcctgggcggcagacagctgctgacccccgagcacgtgctgagacaggtggacgtgaccagcttcgccggccacccctgcaccagagccagcggccacccctgcctgaacggcgccagctgcgtgcccagagaggccgcctacgtgtgcctgtgccccggcggcttcagcggcccccactgcgagaagggcctggtggagaagagcgccggcgacgtggacaccctggccttcgacggcagaaccttcgtggagtacctgaacgccgtgaccgagagcgagctggccaacgagatccccgtgcccgagaccctggacagcggcgccctgcacagcgagaaggccctgcagagcaaccacttcgagctgagcctgagaaccgaggccacccagggcctggtgctgtggagcggcaaggccaccgagagagccgactacgtggccctggccatcgtggacggccacctgcagctgagctacaacctgggcagccagcccgtggtgctgagaagcaccgtgcccgtgaacacctag

SEQ ID NO: 72345 - DNA, 462 bp, Artificial Sequence
  Description of Artificial Sequence: Synthetic coding sequence
atggccctggtgttcgtgtacggcaccctgaagagaggccagcccaaccacagagtgctgagagacggcgcccacggcagcgccgccttcagagccagaggcagaaccctggagccctaccccctggtgatcgccggcgagcacaacatcccctggctgctgcacctgcccggcagcggcagactggtggagggcgaggtgtacgccgtggacgagagaatgctgagattcctggacgacttcgagagctgccccgccctgtaccagagaaccgtgctgagagtgcagctgctggaggacagagcccccggcgccgaggagccccccgcccccaccgccgtgcagtgcttcgtgtacagcagagccaccttcccccccgagtgggcccagctgccccaccacgacagctacgacagcgagggcccccacggcctgagatacaaccccagagagaacagatag

SEQ ID NO: 72346 - DNA, 462 bp, Artificial Sequence; identical to SEQ ID NO: 72345
  Description of Artificial Sequence: Synthetic coding sequence

SEQ ID NO: 72347 - DNA, 879 bp, Artificial Sequence
  Description of Artificial Sequence: Synthetic coding sequence
atgaaccccttctggagcatgagcaccagcagcgtgagaaagagaagcgagggcgaggagaagaccctgaccggcgacgtgaagaccagcccccccagaaccgcccccaagaagcagctgcccagcatccccaagaacgccctgcccatcaccaagcccaccagccccgcccccgccgcccagagcaccaacggcacccacgccagctacggccccttctacctggagtacagcctgctggccgagttcaccctggtggtgaagcagaagctgcccggcgtgtacgtgcagcccagctacagaagcgccctgatgtggttcggcgtgatcttcatcagacacggcctgtaccaggacggcgtgttcaagttcaccgtgtacatccccgacaactaccccgacggcgactgccccagactggtgttcgacatccccgtgttccaccccctggtggaccccaccagcggcgagctggacgtgaagagagccttcgccaagtggagaagaaaccacaaccacatctggcaggtgctgatgtacgccagaagagtgttctacaagatcgacaccgccagccccctgaaccccgaggccgccgtgctgtacgagaaggacatccagctgttcaagagcaaggtggtggacagcgtgaaggtgtgcaccgccagactgttcgaccagcccaagatcgaggacccctacgccatcagcttcagcccctggaaccccagcgtgcacgacgaggccagagagaagatgctgacccagaagaagcccgaggagcagcacaacaagagcgtgcacgtggccggcctgagctgggtgaagcccggcagcgtgcagcccttcagcaaggaggagaagaccgtggccacctag

SEQ ID NO: 72348 - DNA, 879 bp, Artificial Sequence; identical to SEQ ID NO: 72347
  Description of Artificial Sequence: Synthetic coding sequence

SEQ ID NO: 72349 - DNA, 1179 bp, Artificial Sequence
  Description of Artificial Sequence: Synthetic coding sequence
atggccagccacaagctgctggtgaccccccccaaggccctgctgaagcccctgagcatccccaaccagctgctgctgggccccggccccagcaacctgccccccagaatcatggccgccggcggcctgcagatgatcggcagcatgagcaaggacatgtaccagatcatggacgagatcaaggagggcatccagtacgtgttccagaccagaaaccccctgaccctggtgatcagcggcagcggccactgcgccctggaggccgccctggtgaacgtgctggagcccggcgacagcttcctggtgggcgccaacggcatctggggccagagagccgtggacatcggcgagagaatcggcgccagagtgcaccccatgaccaaggaccccggcggccactacaccctgcaggaggtggaggagggcctggcccagcacaagcccgtgctgctgttcctgacccacggcgagagcagcaccggcgtgctgcagcccctggacggcttcggcgagctgtgccacagatacaagtgcctgctgctggtggacagcgtggccagcctgggcggcacccccctgtacatggacagacagggcatcgacatcctgtacagcggcagccagaaggccctgaacgccccccccggcaccagcctgatcagcttcagcgacaaggccaagaagaagatgtacagcagaaagaccaagcccttcagcttctacctggacatcaagtggctggccaacttctggggctgcgacgaccagcccagaatgtaccaccacaccatccccgtgatcagcctgtacagcctgagagagagcctggccctgatcgccgagcagggcctggagaacagctggagacagcacagagaggccgccgcctacctgcacggcagactgcaggccctgggcctgcagctgttcgtgaaggaccccgccctgagactgcccaccgtgaccaccgtggccgtgcccgccggctacgactggagagacatcgtgagctacgtgatcgaccacttcgacatcgagatcatgggcggcctgggccccagcaccggcaaggtgctgagaatcggcctgctgggctgcaacgccaccagagagaacgtggacagagtgaccgaggccctgagagccgccctgcagcactgccccaagaagaagctgtag

SEQ ID NO: 72350 - DNA, 3078 bp, Artificial Sequence
  Description of Artificial Sequence: Synthetic coding sequence
atggagcccttcaccaacgacagactgcagctgcccagaaacatgatcgagaacagcatgttcgaggaggagcccgacgtggtggacctggccaaggagccctgcctgcaccccctggagcccgacgaggtggagtacgagcccagaggcagcagactgctggtgagaggcctgggcgagcacgagatggaggaggacgaggaggactacgagagcagcgccaagctgctgggcatgagcttcatgaacagaagcagcggcctgagaaacagcgccaccggctacagacagagccccgacggcgcctgcagcgtgcccagcgccagaaccatggtggtgtgcgccttcgtgatcgtggtggccgtgagcgtgatcatggtgatctacctgctgcccagatgcaccttcaccaaggagggctgccacaagaagaaccagagcatcggcctgatccagcccttcgccaccaacggcaagctgttcccctgggcccagatcagactgcccaccgccgtggtgcccctgagatacgagctgagcctgcaccccaacctgaccagcatgaccttcagaggcagcgtgaccatcagcgtgcaggccctgcaggtgacctggaacatcatcctgcacagcaccggccacaacatcagcagagtgaccttcatgagcgccgtgagcagccaggagaagcaggccgagatcctggagtacgcctaccacggccagatcgccatcgtggcccccgaggccctgctggccggccacaactacaccctgaagatcgagtacagcgccaacatcagcagcagctactacggcttctacggcttcagctacaccgacgagagcaacgagaagaagtacttcgccgccacccagttcgagcccctggccgccagaagcgccttcccctgcttcgacgagcccgccttcaaggccaccttcatcatcaagatcatcagagacgagcagtacaccgccctgagcaacatgcccaagaagagcagcgtggtgctggacgacggcctggtgcaggacgagttcagcgagagcgtgaagatgagcacctacctggtggccttcatcgtgggcgagatgaagaacctgagccaggacgtgaacggcaccctggtgagcatctacgccgtgcccgagaagatcggccaggtgcactacgccctggagaccaccgtgaagctgctggagttcttccagaactacttcgagatccagtaccccctgaagaagctggacctggtggccatccccgacttcgaggccggcgccatggagaactggggcctgctgaccttcagagaggagaccctgctgtacgacagcaacaccagcagcatggccgacagaaagctggtgaccaagatcatcgcccacgagctggcccaccagtggttcggcaacctggtgaccatgaagtggtggaacgacctgtggctgaacgagggcttcgccaccttcatggagtacttcagcctggagaagatcttcaaggagctgagcagctacgaggacttcctggacgccagattcaagaccatgaagaaggacagcctgaacagcagccaccccatcagcagcagcgtgcagagcagcgagcagatcgaggagatgttcgacagcctgagctacttcaagggcagcagcctgctgctgatgctgaagacctacctgagcgaggacgtgttccagcacgccgtggtgctgtacctgcacaaccacagctacgccagcatccagagcgacgacctgtgggacagcttcaacgaggtgaccaaccagaccctggacgtgaagagaatgatgaagacctggaccctgcagaagggcttccccctggtgaccgtgcagaagaagggcaaggagctgttcatccagcaggagagattcttcctgaacatgaagcccgagatccagcccagcgacaccagctacctgtggcacatccccctgagctacgtgaccgagggcagaaactacagcaagtaccagagcgtgagcctgctggacaagaagagcggcgtgatcaacctgaccgaggaggtgctgtgggtgaaggtgaacatcaacatgaacggctactacatcgtgcactacgccgacgacgactgggaggccctgatccaccagctgaagatcaacccctacgtgctgagcgacaaggacagagccaacctgatcaacaacatcttcgagctggccggcctgggcaaggtgcccctgaagagagccttcgacctgatcaactacctgggcaacgagaaccacaccgcccccatcaccgaggccctgttccagaccgacctgatctacaacctgctggagaagctgggctacatggacctggccagcagactggtgaccagagtgttcaagctgctgcagaaccagatccagcagcagacctggaccgacgagggcacccccagcatgagagagctgagaagcgccctgctggagttcgcctgcacccacaacctgggcaactgcagcaccaccgccatgaagctgttcgacgactggatggccagcaacggcacccagagcctgcccaccgacgtgatgaccaccgtgttcaaggtgggcgccaagaccgacaagggctggagcttcctgctgggcaagtacatcagcatcggcagcgaggccgagaagaacaagatcctggaggccctggccagcagcgaggacgtgagaaagctgtactggctgatgaagagcagcctgaacggcgacaacttcagaacccagaagctgagcttcatcatcagaaccgtgggcagacacttccccggccacctgctggcctgggacttcgtgaaggagaactggaacaagctggtgcagaagttccccctgggcagctacaccatccagaacatcgtggccggcagcacctacctgttcagcaccaagacccacctgagcgaggtgcaggccttcttcgagaaccagagcgaggccaccttcagactgagatgcgtgcaggaggccctggaggtgatccagctgaacatccagtggatggagaagaacctgaagagcctgacctggtggctgtag

SEQ ID NO: 72351 - DNA, 2907 bp, Artificial Sequence
  Description of Artificial Sequence: Synthetic coding sequence
atggacagcaccctgaccgccagcgagatcagacagagattcatcgacttcttcaagagaaacgagcacacctacgtgcacagcagcgccaccatccccctggacgaccccaccctgctgttcgccaacgccggcatgaaccagttcaagcccatcttcctgaacaccatcgaccccagccaccccatggccaagctgagcagagccgccaacacccagaagtgcatcagagccggcggcaagcacaacgacctggacgacgtgggcaaggacgtgtaccaccacaccttcttcgagatgctgggcagctggagcttcggcgactacttcaaggagctggcctgcaagatggccctggagctgctgacccaggagttcggcatccccatcgagagactgtacgtgacctacttcggcggcgacgaggccgccggcctggaggccgacctggagtgcaagcagatctggcagaacctgggcctggacgacaccaagatcctgcccggcaacatgaaggacaacttctgggagatgggcgacaccggcccctgcggcccctgcagcgagatccactacgacagaatcggcggcagagacgccgcccacctggtgaaccaggacgaccccaacgtgctggagatctggaacctggtgttcatccagtacaacagagaggccgacggcatcctgaagcccctgcccaagaagagcatcgacaccggcatgggcctggagagactggtgagcgtgctgcagaacaagatgagcaactacgacaccgacctgttcgtgccctacttcgaggccatccagaagggcaccggcgccagaccctacaccggcaaggtgggcgccgaggacgccgacggcatcgacatggcctacagagtgctggccgaccacgccagaaccatcaccgtggccctggccgacggcggcagacccgacaacaccggcagaggctacgtgctgagaagaatcctgagaagagccgtgagatacgcccacgagaagctgaacgccagcagaggcttcttcgccaccctggtggacgtggtggtgcagagcctgggcgacgccttccccgagctgaagaaggaccccgacatggtgaaggacatcatcaacgaggaggaggtgcagttcctgaagaccctgagcagaggcagaagaatcctggacagaaagatccagagcctgggcgacagcaagaccatccccggcgacaccgcctggctgctgtacgacacctacggcttccccgtggacctgaccggcctgatcgccgaggagaagggcctggtggtggacatggacggcttcgaggaggagagaaagctggcccagctgaagagccagggcaagggcgccggcggcgaggacctgatcatgctggacatctacgccatcgaggagctgagagccagaggcctggaggtgaccgacgacagccccaagtacaactaccacctggacagcagcggcagctacgtgttcgagaacaccgtggccaccgtgatggccctgagaagagagaagatgttcgtggaggaggtgagcaccggccaggagtgcggcgtggtgctggacaagacctgcttctacgccgagcagggcggccagatctacgacgagggctacctggtgaaggtggacgacagcagcgaggacaagaccgagttcaccgtgaagaacgcccaggtgagaggcggctacgtgctgcacatcggcaccatctacggcgacctgaaggtgggcgaccaggtgtggctgttcatcgacgagcccagaagaagacccatcatgagcaaccacaccgccacccacatcctgaacttcgccctgagaagcgtgctgggcgaggccgaccagaagggcagcctggtggcccccgacagactgagattcgacttcaccgccaagggcgccatgagcacccagcagatcaagaaggccgaggagatcgccaacgagatgatcgaggccgccaaggccgtgtacacccaggactgccccctggccgccgccaaggccatccagggcctgagagccgtgttcgacgagacctaccccgaccccgtgagagtggtgagcatcggcgtgcccgtgagcgagctgctggacgaccccagcggccccgccggcagcctgaccagcgtggagttctgcggcggcacccacctgagaaacagcagccacgccggcgccttcgtgatcgtgaccgaggaggccatcgccaagggcatcagaagaatcgtggccgtgaccggcgccgaggcccagaaggccctgagaaaggccgagagcctgaagaagtgcctgagcgtgatggaggccaaggtgaaggcccagaccgcccccaacaaggacgtgcagagagagatcgccgacctgggcgaggccctggccaccgccgtgatcccccagtggcagaaggacgagctgagagagaccctgaagagcctgaagaaggtgatggacgacctggacagagccagcaaggccgacgtgcagaagagagtgctggagaagaccaagcagttcatcgacagcaaccccaaccagcccctggtgatcctggagatggagagcggcgccagcgccaaggccctgaacgaggccctgaagctgttcaagatgcacagcccccagaccagcgccatgctgttcaccgtggacaacgaggccggcaagatcacctgcctgtgccaggtgccccagaacgccgccaacagaggcctgaaggccagcgagtgggtgcagcaggtgagcggcctgatggacggcaagggcggcggcaaggacgtgagcgcccaggccaccggcaagaacgtgggctgcctgcaggaggccctgcagctggccaccagcttcgcccagctgagactgggcgacgtgaagaactag

SEQ ID NO: 72352 - DNA, 2958 bp, Artificial Sequence
  Description of Artificial Sequence: Synthetic coding sequence
atggccgccagcgtggccgccgccgccagaagactgagaagagccatcagaagaagccccgcctggagaggcctgagccacagacccctgagcagcgagccccccgccgccaaggccagcgccgtgagagccgccttcctgaacttcttcagagacagacacggccacagactggtgcccagcgccagcgtgagacccagaggcgaccccagcctgctgttcgtgaacgccggcatgaaccagttcaagcccatcttcctgggcaccgtggaccccagaagcgagatggccggcttcagaagagtggccaacagccagaagtgcgtgagagccggcggccaccacaacgacctggaggacgtgggcagagacctgagccaccacaccttcttcgagatgctgggcaactgggccttcggcggcgagtacttcaaggaggaggcctgcaacatggcctgggagctgctgacccaggtgtacggcatccccgaggagagactgtggatcagctacttcgacggcgaccccaaggccggcctggaccccgacctggagaccagagacatctggctgagcctgggcgtgcccgccagcagagtgctgagcttcggcccccaggagaacttctgggagatgggcgacaccggcccctgcggcccctgcaccgagatccactacgacctggccggcggcgtgggcgccccccagctggtggagctgtggaacctggtgttcatgcagcacaacagagaggccgacggcagcctgcagcccctgccccagagacacgtggacaccggcatgggcctggagagactggtggccgtgctgcagggcaagcacagcacctacgacaccgacctgttcagccccctgctgaacgccatccagcagggctgcagagcccccccctacctgggcagagtgggcgtggccgacgagggcagaaccgacaccgcctacagagtggtggccgaccacatcagaaccctgagcgtgtgcatcagcgacggcatcttccccggcatgagcggcccccccctggtgctgagaagaatcctgagaagagccgtgagattcagcatggagatcctgaaggccccccccggcttcctgggcagcctggtgcccgtggtggtggagaccctgggcgacgcctaccccgagctgcagagaaacagcgcccagatcgccaacctggtgagcgaggacgaggccgccttcctggccagcctggagagaggcagaagaatcatcgacagaaccctgagaaccctgggccccagcgacatgttccccgccgaggtggcctggagcctgagcctgtgcggcgacctgggcctgcccctggacatggtggagctgatgctggaggagaagggcgtgcagctggacagcgccggcctggagagactggcccaggaggaggcccagcacagagccagacaggccgagcccgtgcagaagcagggcctgtggctggacgtgcacgccctgggcgagctgcagagacagggcgtgccccccaccgacgacagccccaagtacaactacagcctgagacccagcggcagctacgagttcggcacctgcgaggcccaggtgctgcagctgtacaccgaggacggcaccgccgtggccagcgtgggcaagggccagagatgcggcctgctgctggacagaaccaacttctacgccgagcagggcggccaggccagcgacagaggctacctggtgagagccggccaggaggacgtgctgttccccgtggccagagcccaggtgtgcggcggcttcatcctgcacgaggccgtggcccccgagtgcctgagactgggcgaccaggtgcagctgcacgtggacgaggcctggagactgggctgcatggccaagcacaccgccacccacctgctgaactgggccctgagacagaccctgggccccggcaccgagcagcagggcagccacctgaaccccgagcagctgagactggacgtgaccacccagacccccctgacccccgagcagctgagagccgtggagaacaccgtgcaggaggccgtgggccaggacgaggccgtgtacatggaggaggtgcccctggccctgaccgcccaggtgcccggcctgagaagcctggacgaggtgtaccccgaccccgtgagagtggtgagcgtgggcgtgcccgtggcccacgccctggaccccgccagccaggccgccctgcagaccagcgtggagctgtgctgcggcacccacctgctgagaaccggcgccgtgggcgacctggtgatcatcggcgacagacagctgagcaagggcaccaccagactgctggccgtgaccggcgagcaggcccagcaggccagagagctgggccagagcctggcccaggaggtgaaggccgccaccgagagactgagcctgggcagcagagacgtggccgaggccctgagactgagcaaggacatcggcagactgatcgaggccgtggagaccgccgtgatgccccagtggcagagaagagagctgctggccaccgtgaagatgctgcagagaagagccaacaccgccatcagaaagctgcagatgggccaggccgccaagaagacccaggagctgctggagagacacagcaagggccccctgatcgtggacaccgtgagcgccgagagcctgagcgtgctggtgaaggtggtgagacagctgtgcgagcaggcccccagcaccagcgtgctgctgctgagcccccagcccatgggcaaggtgctgtgcgcctgccaggtggcccagggcgccatgcccaccttcaccgccgaggcctgggccctggccgtgtgcagccacatgggcggcaaggcctggggcagcagagtggtggcccagggcaccggcagcaccaccgacctggaggccgccctgagcatcgcccagacctacgccctgagccagctgtag

SEQ ID NO: 72353 - DNA, 1578 bp, Artificial Sequence
  Description of Artificial Sequence: Synthetic coding sequence
atggagttctgcgtggaggacagcaccgacgtgcacgtgctgatcgaggaccacagaatcgtgttcagctgcaagaacgccgacggcgtggagctgtacaacgagatcgagttctacgccaaggtgaacagcaaggacagccaggacaagagaagcagcagaagcatcacctgcttcgtgagaaagtggaaggagaaggtggcctggcccagactgaccaaggaggacatcaagcccgtgtggctgagcgtggacttcgacaactggagagactgggagggcgacgaggagatggagctggcccacgtggagcactacgccgagctgctgaagaaggtgagcaccaagagacccccccccgccatggacgacctggacttcaccaccaccgtggtgagctgctgccccgccgagctgcagaccgagggcagcaacggcaagaaggaggtgctgagcggcttccaggtggtgctggaggacaccgtgctgttccccgagggcggcggccagcccgacgacagaggcaccatcaacgacatcagcgtgctgagagtgaccagaagaggcgagcaggccgaccacttcacccagacccccctggaccccggcagccaggtgctggtgagagtggactgggagagaagattcgaccacatgcagcagcacagcggccagcacctgatcaccgccgtggccgaccacctgttcaagctgaagaccaccagctgggagctgggcagattcagaagcgccatcgagctggacacccccagcatgaccgccgagcaggtggccgccatcgagcagagcgtgaacgagaagatcagagacagactgcccgtgaacgtgagagagctgagcctggacgaccccgaggtggagcaggtgagcggcagaggcctgcccgacgaccacgccggccccatcagagtggtgaacatcgagggcgtggacagcaacatgtgctgcggcacccacgtgagcaacctgagcgacctgcaggtgatcaagatcctgggcaccgagaagggcaagaagaacagaaccaacctgatcttcctgagcggcaacagagtgctgaagtggatggagagaagccacggcaccgagaaggccctgaccgccctgctgaagtgcggcgccgaggaccacgtggaggccgtgaagaagctgcagaacagcaccaagatcctgcagaagaacaacctgaacctgctgagagacctggccgtgcacatcgcccacagcctgagaaacagccccgactggggcggcgtggtgatcctgcacagaaaggagggcgacagcgagttcatgaacatcatcgccaacgagatcggcagcgaggagaccctgctgttcctgaccgtgggcgacgagaagggcggcggcctgttcctgctggccggcccccccgccagcgtggagaccctgggccccagagtggccgaggtgctggagggcaagggcgccggcaagaagggcagattccagggcaaggccaccaagatgagcagaagaatggaggcccaggccctgctgcaggactacatcagcacccagagcgccaaggagtag

SEQ ID NO: 72354 - DNA, 1761 bp, Artificial Sequence
  Description of Artificial Sequence: Synthetic coding sequence
atgttcagcctgcccctgaactgcagccccgaccacatcagaagaggcagctgctggggcagaccccaggacctgaagatcgccgcccccgcctggaacagcaagtgccaccccggcgccggcgccgccatggccagacagcacgccagaaccctgtggtacgacagacccagatacgtgttcatggagttctgcgtggaggacagcaccgacgtgcacgtgctgatcgaggaccacagaatcgtgttcagctgcaagaacgccgacggcgtggagctgtacaacgagatcgagttctacgccaaggtgaacagcaaggacagccaggacaagagaagcagcagaagcatcacctgcttcgtgagaaagtggaaggagaaggtggcctggcccagactgaccaaggaggacatcaagcccgtgtggctgagcgtggacttcgacaactggagagactgggagggcgacgaggagatggagctggcccacgtggagcactacgccgagctgctgaagaaggtgagcaccaagagacccccccccgccatggacgacctggacttcaccaccaccgtggtgagctgctgccccgccgagctgcagaccgagggcagcaacggcaagaaggaggtgctgagcggcttccaggtggtgctggaggacaccgtgctgttccccgagggcggcggccagcccgacgacagaggcaccatcaacgacatcagcgtgctgagagtgaccagaagaggcgagcaggccgaccacttcacccagacccccctggaccccggcagccaggtgctggtgagagtggactgggagagaagattcgaccacatgcagcagcacagcggccagcacctgatcaccgccgtggccgaccacctgttcaagctgaagaccaccagctgggagctgggcagattcagaagcgccatcgagctggacacccccagcatgaccgccgagcaggtggccgccatcgagcagagcgtgaacgagaagatcagagacagactgcccgtgaacgtgagagagctgagcctggacgaccccgaggtggagcaggtgagcggcagaggcctgcccgacgaccacgccggccccatcagagtggtgaacatcgagggcgtggacagcaacatgtgctgcggcacccacgtgagcaacctgagcgacctgcaggtgatcaagatcctgggcaccgagaagggcaagaagaacagaaccaacctgatcttcctgagcggcaacagagtgctgaagtggatggagagaagccacggcaccgagaaggccctgaccgccctgctgaagtgcggcgccgaggaccacgtggaggccgtgaagaagctgcagaacagcaccaagatcctgcagaagaacaacctgaacctgctgagagacctggccgtgcacatcgcccacagcctgagaaacagccccgactggggcggcgtggtgatcctgcacagaaaggagggcgacagcgagttcatgaacatcatcgccaacgagatcggcagcgaggagaccctgctgttcctgaccgtgggcgacgagaagggcggcggcctgttcctgctggccggcccccccgccagcgtggagaccctgggccccagagtggccgaggtgctggagggcaagggcgccggcaagaagggcagattccagggcaaggccaccaagatgagcagaagaatggaggcccaggccctgctgcaggactacatcagcacccagagcgccaaggagtag

SEQ ID NO: 72355 - DNA, 1761 bp, Artificial Sequence; identical to SEQ ID NO: 72354
  Description of Artificial Sequence: Synthetic coding sequence

SEQ ID NO: 72356 - DNA, 1239 bp, Artificial Sequence
  Description of Artificial Sequence: Synthetic coding sequence
atggccttctggtgccagagagacagctacgccagagagttcaccaccaccgtggtgagctgctgccccgccgagctgcagaccgagggcagcaacggcaagaaggaggtgctgagcggcttccaggtggtgctggaggacaccgtgctgttccccgagggcggcggccagcccgacgacagaggcaccatcaacgacatcagcgtgctgagagtgaccagaagaggcgagcaggccgaccacttcacccagacccccctggaccccggcagccaggtgctggtgagagtggactgggagagaagattcgaccacatgcagcagcacagcggccagcacctgatcaccgccgtggccgaccacctgttcaagctgaagaccaccagctgggagctgggcagattcagaagcgccatcgagctggacacccccagcatgaccgccgagcaggtggccgccatcgagcagagcgtgaacgagaagatcagagacagactgcccgtgaacgtgagagagctgagcctggacgaccccgaggtggagcaggtgagcggcagaggcctgcccgacgaccacgccggccccatcagagtggtgaacatcgagggcgtggacagcaacatgtgctgcggcacccacgtgagcaacctgagcgacctgcaggtgatcaagatcctgggcaccgagaagggcaagaagaacagaaccaacctgatcttcctgagcggcaacagagtgctgaagtggatggagagaagccacggcaccgagaaggccctgaccgccctgctgaagtgcggcgccgaggaccacgtggaggccgtgaagaagctgcagaacagcaccaagatcctgcagaagaacaacctgaacctgctgagagacctggccgtgcacatcgcccacagcctgagaaacagccccgactggggcggcgtggtgatcctgcacagaaaggagggcgacagcgagttcatgaacatcatcgccaacgagatcggcagcgaggagaccctgctgttcctgaccgtgggcgacgagaagggcggcggcctgttcctgctggccggcccccccgccagcgtggagaccctgggccccagagtggccgaggtgctggagggcaagggcgccggcaagaagggcagattccagggcaaggccaccaagatgagcagaagaatggaggcccaggccctgctgcaggactacatcagcacccagagcgccaaggagtag

SEQ ID NO: 72357 - DNA, 501 bp, Artificial Sequence
  Description of Artificial Sequence: Synthetic coding sequence
atgttcagcctgcccctgaactgcagccccgaccacatcagaagaggcagctgctggggcagaccccaggacctgaagatcgccgcccccgcctggaacagcaagtgccaccccggcgccggcgccgccatggccagacagcacgccagaaccctgtggtacgacagacccagatacgtgttcatggagttctgcgtggaggacagcaccgacgtgcacgtgctgatcgaggaccacagaatcgtgttcagctgcaagaacgccgacggcgtggagctgtacaacgagatcgagttctacgccaaggtgaacagcaagcccgtgtggctgagcgtggacttcgacaactggagagactgggagggcgacgaggagatggagctggcccacgtggagcactacgccgagctgctgaagaaggtgagcaccaagagacccccccccgccatggacgacctggacgacgacagcgacagcgccgacgacgccaccagcaactag

SEQ ID NO: 72358 - DNA, 399 bp, Artificial Sequence
  Description of Artificial Sequence: Synthetic coding sequence
atggagttctgcgtggaggacagcaccgacgtgcacgtgctgatcgaggaccacagaatcgtgttcagctgcaagaacgccgacggcgtggagctgtacaacgagatcgagttctacgccaaggtgaacagcaaggacagccaggacaagagaagcagcagaagcatcacctgcttcgtgagaaagtggaaggagaaggtggcctggcccagactgaccaaggaggacatcaagcccgtgtggctgagcgtggacttcgacaactggagagactgggagggcgacgaggagatggagctggcccacgtggagcactacgccgagctgctgaagaaggtgagcaccaagagacccccccccgccatggacgacctggacttcaccaccaccgtggtgtag

SEQ ID NO: 72359 - DNA, 1830 bp, Artificial Sequence
  Description of Artificial Sequence: Synthetic coding sequence
atgaagtgggtgaccttcatcagcctgctgttcctgttcagcagcgcctacagcagaggcgtgttcagaagagacgcccacaagagcgaggtggcccacagattcaaggacctgggcgaggagaacttcaaggccctggtgctgatcgccttcgcccagtacctgcagcagtgccccttcgaggaccacgtgaagctggtgaacgaggtgaccgagttcgccaagacctgcgtggccgacgagagcgccgagaactgcgacaagagcctgcacaccctgttcggcgacaagctgtgcaccgtggccaccctgagagagacctacggcgagatggccgactgctgcgccaagcaggagcccgagagaaacgagtgcttcctgcagcacaaggacgacaaccccaacctgcccagactggtgagacccgaggtggacgtgatgtgcaccgccttccacgacaacgaggagaccttcctgaagaagtacctgtacgagatcgccagaagacacccctacttctacgcccccgagctgctgttcttcgccaagagatacaaggccgccttcaccgagtgctgccaggccgccgacaaggccgcctgcctgctgcccaagctggacgagctgagagacgagggcaaggccagcagcgccaagcagagactgaagtgcgccagcctgcagaagttcggcgagagagccttcaaggcctgggccgtggccagactgagccagagattccccaaggccgagttcgccgaggtgagcaagctggtgaccgacctgaccaaggtgcacaccgagtgctgccacggcgacctgctggagtgcgccgacgacagagccgacctggccaagtacatctgcgagaaccaggacagcatcagcagcaagctgaaggagtgctgcgagaagcccctgctggagaagagccactgcatcgccgaggtggagaacgacgagatgcccgccgacctgcccagcctggccgccgacttcgtggagagcaaggacgtgtgcaagaactacgccgaggccaaggacgtgttcctgggcatgttcctgtacgagtacgccagaagacaccccgactacagcgtggtgctgctgctgagactggccaagacctacgagaccaccctggagaagtgctgcgccgccgccgacccccacgagtgctacgccaaggtgttcgacgagttcaagcccctggtggaggagccccagaacctgatcaagcagaactgcgagctgttcgagcagctgggcgagtacaagttccagaacgccctgctggtgagatacaccaagaaggtgccccaggtgagcacccccaccctggtggaggtgagcagaaacctgggcaaggtgggcagcaagtgctgcaagcaccccgaggccaagagaatgccctgcgccgaggactacctgagcgtggtgctgaaccagctgtgcgtgctgcacgagaagacccccgtgagcgacagagtgaccaagtgctgcaccgagagcctggtgaacagaagaccctgcttcagcgccctggaggtggacgagacctacgtgcccaaggagttcaacgccgagaccttcaccttccacgccgacatctgcaccctgagcgagaaggagagacagatcaagaagcagaccgccctggtggagctggtgaagcacaagcccaaggccaccaaggagcagctgaaggccgtgatggacgacttcgccgccttcgtggagaagtgctgcaaggccgacgacaaggagacctgcttcgccgaggagggcaagaagctggtggccgccagccaggccgccctgggcctgtag

SEQ ID NO: 72360 - DNA, 1191 bp, Artificial Sequence
  Description of Artificial Sequence: Synthetic coding sequence
atgaagtgggtgaccttcatcagcctgctgttcctgttcagcagcgcctacagcagaggcgtgttcagaagagacgcccacaagagcgaggtggcccacagattcaaggacctgggcgaggagaacttcaaggccctggtgctgatcgccttcgcccagtacctgcagcagtgccccttcgaggaccacgtgaagctggtgaacgaggtgaccgagttcgccaagacctgcgtggccgacgagagcgccgagaactgcgacaagagcctgcacaccctgttcggcgacaagctgtgcaccgtggccaccctgagagagacctacggcgagatggccgactgctgcgccaagcaggagcccgagagaaacgagtgcttcctgcagcacaaggacgacaaccccaacctgcccagactggtgagacccgaggtggacgtgatgtgcaccgccttccacgacaacgaggagaccttcctgaagaagtacctgtacgagaccaccctggagaagtgctgcgccgccgccgacccccacgagtgctacgccaaggtgttcgacgagttcaagcccctggtggaggagccccagaacctgatcaagcagaactgcgagctgttcgagcagctgggcgagtacaagttccagaacgccctgctggtgagatacaccaagaaggtgccccaggtgagcacccccaccctggtggaggtgagcagaaacctgggcaaggtgggcagcaagtgctgcaagcaccccgaggccaagagaatgccctgcgccgaggactacctgagcgtggtgctgaaccagctgtgcgtgctgcacgagaagacccccgtgagcgacagagtgaccaagtgctgcaccgagagcctggtgaacagaagaccctgcttcagcgccctggaggtggacgagacctacgtgcccaaggagttcaacgccgagaccttcaccttccacgccgacatctgcaccctgagcgagaaggagagacagatcaagaagcagaccgccctggtggagctggtgaagcacaagcccaaggccaccaaggagcagctgaaggccgtgatggacgacttcgccgccttcgtggagaagtgctgcaaggccgacgacaaggagacctgcttcgccgaggagggcaagaagctggtggccgccagccaggccgccctgggcctgtag

SEQ ID NO: 72361 - DNA, 1254 bp, Artificial Sequence
  Description of Artificial Sequence: Synthetic coding sequence
atgaagtgggtgaccttcatcagcctgctgttcctgttcagcagcgcctacagcagaggcgtgttcagaagagacgcccacaagagcgaggtggcccacagattcaaggacctgggcgaggagaacttcaaggccctggccgtggccagactgagccagagattccccaaggccgagttcgccgaggtgagcaagctggtgaccgacctgaccaaggtgcacaccgagtgctgccacggcgacctgctggagtgcgccgacgacagagccgacctggccaagtacatctgcgagaaccaggacagcatcagcagcaagctgaaggagtgctgcgagaagcccctgctggagaagagccactgcatcgccgaggtggagaacgacgagatgcccgccgacctgcccagcctggccgccgacttcgtggagagcaaggacgtgtgcaagaactacgccgaggccaaggacgtgttcctgggcatgttcctgtacgagtacgccagaagacaccccgactacagcgtggtgctgctgctgagactggccaagacctacgagaccaccctggagaagtgctgcgccgccgccgacccccacgagtgctacgccaaggtgttcgacgagttcaagcccctggtggaggagccccagaacctgatcaagcagaactgcgagctgttcgagcagctgggcgagtacaagttccagaacgccctgctggtgagatacaccaagaaggtgccccaggtgagcacccccaccctggtggaggtgagcagaaacctgggcaaggtgggcagcaagtgctgcaagcaccccgaggccaagagaatgccctgcgccgaggactacctgagcgtggtgctgaaccagctgtgcgtgctgcacgagaagacccccgtgagcgacagagtgaccaagtgctgcaccgagagcctggtgaacagaagaccctgcttcagcgccctggaggtggacgagacctacgtgcccaaggagttcaacgccgagaccttcaccttccacgccgacatctgcaccctgagcgagaaggagagacagatcaagaagcagaccgccctggtggagctggtgaagcacaagcccaaggccaccaaggagcagctgaaggccgtgatggacgacttcgccgccttcgtggagaagtgctgcaaggccgacgacaaggagacctgcttcgccgaggagggcaagaagctggtggccgccagccaggccgccctgggcctgtag

SEQ ID NO: 72362 - DNA, 1857 bp, Artificial Sequence
  Description of Artificial Sequence: Synthetic coding sequence
atgaagtgggtgaccttcatcagcctgctgttcctgttcagcagcgcctacagcagaggcgtgttcagaagagacgccctgttcctgttcttcttcccctgccccgacaagagcgaggtggcccacagattcaaggacctgggcgaggagaacttcaaggccctggtgctgatcgccttcgcccagtacctgcagcagtgccccttcgaggaccacgtgaagctggtgaacgaggtgaccgagttcgccaagacctgcgtggccgacgagagcgccgagaactgcgacaagagcctgcacaccctgttcggcgacaagctgtgcaccgtggccaccctgagagagacctacggcgagatggccgactgctgcgccaagcaggagcccgagagaaacgagtgcttcctgcagcacaaggacgacaaccccaacctgcccagactggtgagacccgaggtggacgtgatgtgcaccgccttccacgacaacgaggagaccttcctgaagaagtacctgtacgagatcgccagaagacacccctacttctacgcccccgagctgctgttcttcgccaagagatacaaggccgccttcaccgagtgctgccaggccgccgacaaggccgcctgcctgctgcccaagctggacgagctgagagacgagggcaaggccagcagcgccaagcagagactgaagtgcgccagcctgcagaagttcggcgagagagccttcaaggcctgggccgtggccagactgagccagagattccccaaggccgagttcgccgaggtgagcaagctggtgaccgacctgaccaaggtgcacaccgagtgctgccacggcgacctgctggagtgcgccgacgacagagccgacctggccaagtacatctgcgagaaccaggacagcatcagcagcaagctgaaggagtgctgcgagaagcccctgctggagaagagccactgcatcgccgaggtggagaacgacgagatgcccgccgacctgcccagcctggccgccgacttcgtggagagcaaggacgtgtgcaagaactacgccgaggccaaggacgtgttcctgggcatgttcctgtacgagtacgccagaagacaccccgactacagcgtggtgctgctgctgagactggccaagacctacgagaccaccctggagaagtgctgcgccgccgccgacccccacgagtgctacgccaaggtgttcgacgagttcaagcccctggtggaggagccccagaacctgatcaagcagaactgcgagctgttcgagcagctgggcgagtacaagttccagaacgccctgctggtgagatacaccaagaaggtgccccaggtgagcacccccaccctggtggaggtgagcagaaacctgggcaaggtgggcagcaagtgctgcaagcaccccgaggccaagagaatgccctgcgccgaggactacctgagcgtggtgctgaaccagctgtgcgtgctgcacgagaagacccccgtgagcgacagagtgaccaagtgctgcaccgagagcctggtgaacagaagaccctgcttcagcgccctggaggtggacgagacctacgtgcccaaggagttcaacgccgagaccttcaccttccacgccgacatctgcaccctgagcgagaaggagagacagatcaagaagcagaccgccctggtggagctggtgaagcacaagcccaaggccaccaaggagcagctgaaggccgtgatggacgacttcgccgccttcgtggagaagtgctgcaaggccgacgacaaggagacctgcttcgccgaggagggcaagaagctggtggccgccagccaggccgccctgggcctgtag

SEQ ID NO: 72363 - DNA, 1161 bp, Artificial Sequence
  Description of Artificial Sequence: Synthetic coding sequence
atgttcgccgagatccagatccaggacaaggacagaatgggcaccgccggcaaggtgatcaagtgcaaggccgccgtgctgtgggagcagaagcagcccttcagcatcgaggagatcgaggtggccccccccaagaccaaggaggtgagaatcaagatcctggccaccggcatctgcagaaccgacgaccacgtgatcaagggcaccatggtgagcaagttccccgtgatcgtgggccacgaggccaccggcatcgtggagagcatcggcgagggcgtgaccaccgtgaagcccggcgacaaggtgatccccctgttcctgccccagtgcagagagtgcaacgcctgcagaaaccccgacggcaacctgtgcatcagaagcgacatcaccggcagaggcgtgctggccgacggcaccaccagattcacctgcaagggcaagcccgtgcaccacttcatgaacaccagcaccttcaccgagtacaccgtggtggacgagagcagcgtggccaagatcgacgacgccgccccccccgagaaggtgtgcctgatcggctgcggcttcagcaccggctacggcgccgccgtgaagaccggcaaggtgaagcccggcagcacctgcgtggtgttcggcctgggcggcgtgggcctgagcgtgatcatgggctgcaagagcgccggcgccagcagaatcatcggcatcgacctgaacaaggacaagttcgagaaggccatggccgtgggcgccaccgagtgcatcagccccaaggacagcaccaagcccatcagcgaggtgctgagcgagatgaccggcaacaacgtgggctacaccttcgaggtgatcggccacctggagaccatgatcgacgccctggccagctgccacatgaactacggcaccagcgtggtggtgggcgtgccccccagcgccaagatgctgacctacgaccccatgctgctgttcaccggcagaacctggaagggctgcgtgttcggcggcctgaagagcagagacgacgtgcccaagctggtgaccgagttcctggccaagaagttcgacctggaccagctgatcacccacgtgctgcccttcaagaagatcagcgagggcttcgagctgctgaacagcggccagagcatcagaaccgtgctgaccttctag

SEQ ID NO: 72364 - DNA, 1128 bp, Artificial Sequence
  Description of Artificial Sequence: Synthetic coding sequence
atgagcaccgccggcaaggtgatcaagtgcaaggccgccgtgctgtgggaggtgaagaagcccttcagcatcgaggacgtggaggtggccccccccaaggcctacgaggtgagaatcaagatggtggccgtgggcatctgccacaccgacgaccacgtggtgagcggcaacctggtgacccccctgcccgtgatcctgggccacgaggccgccggcatcgtggagagcgtgggcgagggcgtgaccaccgtgaagcccggcgacaaggtgatccccctgttcaccccccagtgcggcaagtgcagagtgtgcaagaaccccgagagcaactactgcctgaagaacgacctgggcaaccccagaggcaccctgcaggacggcaccagaagattcacctgcagaggcaagcccatccaccacttcctgggcaccagcaccttcagccagtacaccgtggtggacgagaacgccgtggccaagatcgacgccgccagccccctggagaaggtgtgcctgatcggctgcggcttcagcaccggctacggcagcgccgtgaacgtggccaaggtgacccccggcagcacctgcgccgtgttcggcctgggcggcgtgggcctgagcgccgtgatgggctgcaaggccgccggcgccgccagaatcatcgccgtggacatcaacaaggacaagttcgccaaggccaaggagctgggcgccaccgagtgcatcaacccccaggactacaagaagcccatccaggaggtgctgaaggagatgaccgacggcggcgtggacttcagcttcgaggtgatcggcagactggacaccatgatggccagcctgctgtgctgccacgaggcctgcggcaccagcgtgatcgtgggcgtgccccccgccagccagaacctgagcatcaaccccatgctgctgctgaccggcagaacctggaagggcgccgtgtacggcggcttcaagagcaaggagggcatccccaagctggtggccgacttcatggccaagaagttcagcctggacgccctgatcacccacgtgctgcccttcgagaagatcaacgagggcttcgacctgctgcacagcggcaagagcatcagaaccgtgctgaccttctag

SEQ ID NO: 72365 - DNA, 1008 bp, Artificial Sequence
  Description of Artificial Sequence: Synthetic coding sequence
atggtggccgtgggcatctgccacaccgacgaccacgtggtgagcggcaacctggtgacccccctgcccgtgatcctgggccacgaggccgccggcatcgtggagagcgtgggcgagggcgtgaccaccgtgaagcccggcgacaaggtgatccccctgttcaccccccagtgcggcaagtgcagagtgtgcaagaaccccgagagcaactactgcctgaagaacgacctgggcaaccccagaggcaccctgcaggacggcaccagaagattcacctgcagaggcaagcccatccaccacttcctgggcaccagcaccttcagccagtacaccgtggtggacgagaacgccgtggccaagatcgacgccgccagccccctggagaaggtgtgcctgatcggctgcggcttcagcaccggctacggcagcgccgtgaacgtggccaaggtgacccccggcagcacctgcgccgtgttcggcctgggcggcgtgggcctgagcgccgtgatgggctgcaaggccgccggcgccgccagaatcatcgccgtggacatcaacaaggacaagttcgccaaggccaaggagctgggcgccaccgagtgcatcaacccccaggactacaagaagcccatccaggaggtgctgaaggagatgaccgacggcggcgtggacttcagcttcgaggtgatcggcagactggacaccatgatggccagcctgctgtgctgccacgaggcctgcggcaccagcgtgatcgtgggcgtgccccccgccagccagaacctgagcatcaaccccatgctgctgctgaccggcagaacctggaagggcgccgtgtacggcggcttcaagagcaaggagggcatccccaagctggtggccgacttcatggccaagaagttcagcctggacgccctgatcacccacgtgctgcccttcgagaagatcaacgagggcttcgacctgctgcacagcggcaagagcatcagaaccgtgctgaccttctag

SEQ ID NO: 72366 - DNA, 1089 bp, Artificial Sequence
  Description of Artificial Sequence: Synthetic coding sequence
atgagcaccgccggcaaggtgatcaagtgcaaggccgccgtgctgtgggaggtgaagaagcccttcagcatcgaggacgtggaggtggccccccccaaggcctacgaggtgagaatcaagatggtggccgtgggcatctgccacaccgacgaccacgtggtgagcggcaacctggtgacccccctgcccgtgatcctgggccacgaggccgccggcatcgtggagagcgtgggcgagggcgtgaccaccgtgaagcccggcgacaaggtgatccccctgttcaccccccagtgcggcaagtgcagagtgtgcaagaaccccgagagcaactactgcctgaagaacgacctgggcaaccccagaggcaagcccatccaccacttcctgggcaccagcaccttcagccagtacaccgtggtggacgagaacgccgtggccaagatcgacgccgccagccccctggagaaggtgtgcctgatcggctgcggcttcagcaccggctacggcagcgccgtgaacgtggccaaggtgacccccggcagcacctgcgccgtgttcggcctgggcggcgtgggcctgagcgccgtgatgggctgcaaggccgccggcgccgccagaatcatcgccgtggacatcaacaaggacaagttcgccaaggccaaggagctgggcgccaccgagtgcatcaacccccaggactacaagaagcccatccaggaggtgctgaaggagatgaccgacggcggcgtggacttcagcttcgaggtgatcggcagactggacaccatgatggccagcctgctgtgctgccacgaggcctgcggcaccagcgtgatcgtgggcgtgccccccgccagccagaacctgagcatcaaccccatgctgctgctgaccggcagaacctggaagggcgccgtgtacggcggcttcaagagcaaggagggcatccccaagctggtggccgacttcatggccaagaagttcagcctggacgccctgatcacccacgtgctgcccttcgagaagatcaacgagggcttcgacctgctgcacagcggcaagagcatcagaaccgtgctgaccttctag

SEQ ID NO: 72367 - DNA, 1143 bp, Artificial Sequence
  Description of Artificial Sequence: Synthetic coding sequence
atgggcaccaagggcaaggtgatcaagtgcaaggccgccatcgcctgggaggccggcaagcccctgtgcatcgaggaggtggaggtggccccccccaaggcccacgaggtgagaatccagatcatcgccaccagcctgtgccacaccgacgccaccgtgatcgacagcaagttcgagggcctggccttccccgtgatcgtgggccacgaggccgccggcatcgtggagagcatcggccccggcgtgaccaacgtgaagcccggcgacaaggtgatccccctgtacgcccccctgtgcagaaagtgcaagttctgcctgagccccctgaccaacctgtgcggcaagatcagcaacctgaagagccccgccagcgaccagcagctgatggaggacaagaccagcagattcacctgcaagggcaagcccgtgtaccacttcttcggcaccagcaccttcagccagtacaccgtggtgagcgacatcaacctggccaagatcgacgacgacgccaacctggagagagtgtgcctgctgggctgcggcttcagcaccggctacggcgccgccatcaacaacgccaaggtgacccccggcagcacctgcgccgtgttcggcctgggcggcgtgggcctgagcgccgtgatgggctgcaaggccgccggcgccagcagaatcatcggcatcgacatcaacagcgagaagttcgtgaaggccaaggccctgggcgccaccgactgcctgaaccccagagacctgcacaagcccatccaggaggtgatcatcgagctgaccaagggcggcgtggacttcgccctggactgcgccggcggcagcgagaccatgaaggccgccctggactgcaccaccgccggctggggcagctgcaccttcatcggcgtggccgccggcagcaagggcctgaccatcttccccgaggagctgatcatcggcagaaccatcaacggcaccttcttcggcggctggaagagcgtggacagcatccccaagctggtgaccgactacaagaacaagaagttcaacctggacgccctggtgacccacaccctgcccttcgacaagatcagcgaggccttcgacctgatgaaccagggcaagagcgtgagaaccatcctgatcttctag

SEQ ID NO: 72368 - DNA, 1200 bp, Artificial Sequence
  Description of Artificial Sequence: Synthetic coding sequence
atgctggtgagaggcccccacttcgagctgcagagatgcaagacccacctgttcagcagcaactacctgacccaggtgatcaagtgcaaggccgccatcgcctgggaggccggcaagcccctgtgcatcgaggaggtggaggtggccccccccaaggcccacgaggtgagaatccagatcatcgccaccagcctgtgccacaccgacgccaccgtgatcgacagcaagttcgagggcctggccttccccgtgatcgtgggccacgaggccgccggcatcgtggagagcatcggccccggcgtgaccaacgtgaagcccggcgacaaggtgatccccctgtacgcccccctgtgcagaaagtgcaagttctgcctgagccccctgaccaacctgtgcggcaagatcagcaacctgaagagccccgccagcgaccagcagctgatggaggacaagaccagcagattcacctgcaagggcaagcccgtgtaccacttcttcggcaccagcaccttcagccagtacaccgtggtgagcgacatcaacctggccaagatcgacgacgacgccaacctggagagagtgtgcctgctgggctgcggcttcagcaccggctacggcgccgccatcaacaacgccaaggtgacccccggcagcacctgcgccgtgttcggcctgggcggcgtgggcctgagcgccgtgatgggctgcaaggccgccggcgccagcagaatcatcggcatcgacatcaacagcgagaagttcgtgaaggccaaggccctgggcgccaccgactgcctgaaccccagagacctgcacaagcccatccaggaggtgatcatcgagctgaccaagggcggcgtggacttcgccctggactgcgccggcggcagcgagaccatgaaggccgccctggactgcaccaccgccggctggggcagctgcaccttcatcggcgtggccgccggcagcaagggcctgaccatcttccccgaggagctgatcatcggcagaaccatcaacggcaccttcttcggcggctggaagagcgtggacagcatccccaagctggtgaccgactacaagaacaagaagttcaacctggacgccctggtgacccacaccctgcccttcgacaagatcagcgaggccttcgacctgatgaaccagggcaagagcgtgagaaccatcctgatcttctag

SEQ ID NO: 72369 - DNA, 1125 bp, Artificial Sequence
  Description of Artificial Sequence: Synthetic coding sequence
atggccaacgaggtgatcaagtgcaaggccgccgtggcctgggaggccggcaagcccctgagcatcgaggagatcgaggtggccccccccaaggcccacgaggtgagaatcaagatcatcgccaccgccgtgtgccacaccgacgcctacaccctgagcggcgccgaccccgagggctgcttccccgtgatcctgggccacgagggcgccggcatcgtggagagcgtgggcgagggcgtgaccaagctgaaggccggcgacaccgtgatccccctgtacatcccccagtgcggcgagtgcaagttctgcctgaaccccaagaccaacctgtgccagaagatcagagtgacccagggcaagggcctgatgcccgacggcaccagcagattcacctgcaagggcaagaccatcctgcactacatgggcaccagcaccttcagcgagtacaccgtggtggccgacatcagcgtggccaagatcgaccccctggcccccctggacaaggtgtgcctgctgggctgcggcatcagcaccggctacggcgccgccgtgaacaccgccaagctggagcccggcagcgtgtgcgccgtgttcggcctgggcggcgtgggcctggccgtgatcatgggctgcaaggtggccggcgccagcagaatcatcggcgtggacatcaacaaggacaagttcgccagagccaaggagttcggcgccaccgagtgcatcaacccccaggacttcagcaagcccatccaggaggtgctgatcgagatgaccgacggcggcgtggactacagcttcgagtgcatcggcaacgtgaaggtgatgagagccgccctggaggcctgccacaagggctggggcgtgagcgtggtggtgggcgtggccgccagcggcgaggagatcgccaccagacccttccagctggtgaccggcagaacctggaagggcaccgccttcggcggctggaagagcgtggagagcgtgcccaagctggtgagcgagtacatgagcaagaagatcaaggtggacgagttcgtgacccacaacctgagcttcgacgagatcaacaaggccttcgagctgatgcacagcggcaagagcatcagaaccgtggtgaagatctag

SEQ ID NO: 72370 - DNA, 1107 bp, Artificial Sequence
  Description of Artificial Sequence: Synthetic coding sequence
atgtgcaccaccggccaggtgatcagatgcaaggccgccatcctgtggaagcccggcgcccccttcagcatcgaggaggtggaggtggccccccccaaggccaaggaggtgagaatcaaggtggtggccaccggcctgtgcggcaccgagatgaaggtgctgggcagcaagcacctggacctgctgtaccccaccatcctgggccacgagggcgccggcatcgtggagagcatcggcgagggcgtgagcaccgtgaagcccggcgacaaggtgatcaccctgttcctgccccagtgcggcgagtgcaccagctgcctgaacagcgagggcaacttctgcatccagttcaagcagagcaagacccagctgatgagcgacggcaccagcagattcacctgcaagggcaagagcatctaccacttcggcaacaccagcaccttctgcgagtacaccgtgatcaaggagatcagcgtggccaagatcgacgccgtggcccccctggagaaggtgtgcctgatcagctgcggcttcagcaccggcttcggcgccgccatcaacaccgccaaggtgacccccggcagcacctgcgccgtgttcggcctgggcggcgtgggcctgagcgtggtgatgggctgcaaggccgccggcgccgccagaatcatcggcgtggacgtgaacaaggagaagttcaagaaggcccaggagctgggcgccaccgagtgcctgaacccccaggacctgaagaagcccatccaggaggtgctgttcgacatgaccgacgccggcatcgacttctgcttcgaggccatcggcaacctggacgtgctggccgccgccctggccagctgcaacgagagctacggcgtgtgcgtggtggtgggcgtgctgcccgccagcgtgcagctgaagatcagcggccagctgttcttcagcggcagaagcctgaagggcagcgtgttcggcggctggaagagcagacagcacatccccaagctggtggccgactacatggccgagaagctgaacctggaccccctgatcacccacaccctgaacctggacaagatcaacgaggccgtggagctgatgaagaccggcaagtggtag

SEQ ID NO: 72371 - DNA, 1128 bp, Artificial Sequence
  Description of Artificial Sequence: Synthetic coding sequence
atgtgcaccaccggccaggtgatcagatgcaaggccgccatcctgtggaagcccggcgcccccttcagcatcgaggaggtggaggtggccccccccaaggccaaggaggtgagaatcaaggtggtggccaccggcctgtgcggcaccgagatgaaggtgctgggcagcaagcacctggacctgctgtaccccaccatcctgggccacgagggcgccggcatcgtggagagcatcggcgagggcgtgagcaccgtgaagcccggcgacaaggtgatcaccctgttcctgccccagtgcggcgagtgcaccagctgcctgaacagcgagggcaacttctgcatccagttcaagcagagcaagacccagctgatgagcgacggcaccagcagattcacctgcaagggcaagagcatctaccacttcggcaacaccagcaccttctgcgagtacaccgtgatcaaggagatcagcgtggccaagatcgacgccgtggcccccctggagaaggtgtgcctgatcagctgcggcttcagcaccggcttcggcgccgccatcaacaccgccaaggtgacccccggcagcacctgcgccgtgttcggcctgggcggcgtgggcctgagcgtggtgatgggctgcaaggccgccggcgccgccagaatcatcggcgtggacgtgaacaaggagaagttcaagaaggcccaggagctgggcgccaccgagtgcctgaacccccaggacctgaagaagcccatccaggaggtgctgttcgacatgaccgacgccggcatcgacttctgcttcgaggccatcggcaacctggacgtgctggccgccgccctggccagctgcaacgagagctacggcgtgtgcgtggtggtgggcgtgctgcccgccagcgtgcagctgaagatcagcggccagctgttcttcagcggcagaagcctgaagggcagcgtgttcggcggctggaagagcagacagcacatccccaagctggtggccgactacatggccgagaagctgaacctggaccccctgatcacccacaccctgaacctggacaagatcaacgaggccgtggagctgatgaagaccggcaagtgcatcagatgcatcctgctgctgtag

SEQ ID NO: 72372 - DNA, 501 bp, Artificial Sequence
  Description of Artificial Sequence: Synthetic coding sequence
atgggctgcaaggccgccggcgccgccagaatcatcggcgtggacgtgaacaaggagaagttcaagaaggcccaggagctgggcgccaccgagtgcctgaacccccaggacctgaagaagcccatccaggaggtgctgttcgacatgaccgacgccggcatcgacttctgcttcgaggccatcggcaacctggacgtgctggccgccgccctggccagctgcaacgagagctacggcgtgtgcgtggtggtgggcgtgctgcccgccagcgtgcagctgaagatcagcggccagctgttcttcagcggcagaagcctgaagggcagcgtgttcggcggctggaagagcagacagcacatccccaagctggtggccgactacatggccgagaagctgaacctggaccccctgatcacccacaccctgaacctggacaagatcaacgaggccgtggagctgatgaagaccggcaagtgcatcagatgcatcctgctgctgtag

SEQ ID NO: 72373 - DNA, 1068 bp, Artificial Sequence
  Description of Artificial Sequence: Synthetic coding sequence
atggagcccgagaagcagaccgagatcagcgagttcttcctgcagggcctgagcgagaagcccgagcaccagaccctgctgttcaccatgttcctgagcacctacctggtgaccatcatcggcaacgccctgatcatcctggccatcatcaccgacagccacctgcacacccccatgtacttcttcctgttcaacctgagcctggtggacaccctgctgagcagcaccaccgtgcccaagatgctggccaacatccaggcccagagcagagccatccccttcgtgggctgcctgacccagatgtacgccttccacctgttcggcaccatggacagcttcctgctggccgtgatggccatcgacagattcgtggccatcgtgcacccccagagatacctggtgctgatgtgcagccccgtgtgcggcctgctgctgggcgccagctggatgatcaccaacctgcagagcctgatccacacctgcctgatggcccagctgaccttctgcgccggcagcgagatcagccacttcttctgcgacctgatgcccctgctgaagctgagcggcagcgacacccacaccaacgagctggtgatcttcgccttcggcatcgtggtgggcaccagccccttcagctgcatcctgctgagctacatcagaatcttctggaccgtgttcaagatccccagcaccagaggcaagtggaaggccttcagcacctgcggcctgcacctgaccgtggtgagcctgagctacggcaccatcttcgccgtgtacctgcagcccaccagccccagcagcagccagaaggacaaggccgccgccctgatgtgcggcgtgttcatccccatgctgaaccccttcatctacagcatcagaaacaaggacatgaaggccgccctgggcaagctgatcggcaaggtggccgtgccctgccccagacccgagcagctgctggacgtgtaccacgtgcccggcagcctgctggccgccagagacaccgagatgcaccccatcccctaccccggcggcgtgcagagcctggccggcaacagagacatggagtag

SEQ ID NO: 72374 - DNA, 1125 bp, Artificial Sequence
  Description of Artificial Sequence: Synthetic coding sequence
atgggcaccgccggcaaggtgatcaagtgcaaggccgccgtgctgtgggagcagaagcagcccttcagcatcgaggagatcgaggtggccccccccaagaccaaggaggtgagaatcaagatcctggccaccggcatctgcagaaccgacgaccacgtgatcaagggcaccatggtgagcaagttccccgtgatcgtgggccacgaggccaccggcatcgtggagagcatcggcgagggcgtgaccaccgtgaagcccggcgacaaggtgatccccctgttcctgccccagtgcagagagtgcaacgcctgcagaaaccccgacggcaacctgtgcatcagaagcgacatcaccggcagaggcgtgctggccgacggcaccaccagattcacctgcaagggcaagcccgtgcaccacttcatgaacaccagcaccttcaccgagtacaccgtggtggacgagagcagcgtggccaagatcgacgacgccgccccccccgagaaggtgtgcctgatcggctgcggcttcagcaccggctacggcgccgccgtgaagaccggcaaggtgaagcccggcagcacctgcgtggtgttcggcctgggcggcgtgggcctgagcgtgatcatgggctgcaagagcgccggcgccagcagaatcatcggcatcgacctgaacaaggacaagttcgagaaggccatggccgtgggcgccaccgagtgcatcagccccaaggacagcaccaagcccatcagcgaggtgctgagcgagatgaccggcaacaacgtgggctacaccttcgaggtgatcggccacctggagaccatgatcgacgccctggccagctgccacatgaactacggcaccagcgtggtggtgggcgtgccccccagcgccaagatgctgacctacgaccccatgctgctgttcaccggcagaacctggaagggctgcgtgttcggcggcctgaagagcagagacgacgtgcccaagctggtgaccgagttcctggccaagaagttcgacctggaccagctgatcacccacgtgctgcccttcaagaagatcagcgagggcttcgagctgctgaacagcggccagagcatcagaaccgtgctgaccttctag

SEQ ID NO: 72375 - DNA, 1185 bp, Artificial Sequence
  Description of Artificial Sequence: Synthetic coding sequence
atgaagtgcctggtgagcagacacaccgtgagagagaccctggacatggtgttccagagaatgagcgtggaggccggcgtgatcaagtgcaaggccgccgtgctgtgggagcagaagcagcccttcagcatcgaggagatcgaggtggccccccccaagaccaaggaggtgagaatcaagatcctggccaccggcatctgcagaaccgacgaccacgtgatcaagggcaccatggtgagcaagttccccgtgatcgtgggccacgaggccaccggcatcgtggagagcatcggcgagggcgtgaccaccgtgaagcccggcgacaaggtgatccccctgttcctgccccagtgcagagagtgcaacgcctgcagaaaccccgacggcaacctgtgcatcagaagcgacatcaccggcagaggcgtgctggccgacggcaccaccagattcacctgcaagggcaagcccgtgcaccacttcatgaacaccagcaccttcaccgagtacaccgtggtggacgagagcagcgtggccaagatcgacgacgccgccccccccgagaaggtgtgcctgatcggctgcggcttcagcaccggctacggcgccgccgtgaagaccggcaaggtgaagcccggcagcacctgcgtggtgttcggcctgggcggcgtgggcctgagcgtgatcatgggctgcaagagcgccggcgccagcagaatcatcggcatcgacctgaacaaggacaagttcgagaaggccatggccgtgggcgccaccgagtgcatcagccccaaggacagcaccaagcccatcagcgaggtgctgagcgagatgaccggcaacaacgtgggctacaccttcgaggtgatcggccacctggagaccatgatcgacgccctggccagctgccacatgaactacggcaccagcgtggtggtgggcgtgccccccagcgccaagatgctgacctacgaccccatgctgctgttcaccggcagaacctggaagggctgcgtgttcggcggcctgaagagcagagacgacgtgcccaagctggtgaccgagttcctggccaagaagttcgacctggaccagctgatcacccacgtgctgcccttcaagaagatcagcgagggcttcgagctgctgaacagcggccagagcatcagaaccgtgctgaccttctag

SEQ ID NO: 72376 - DNA, 954 bp, Artificial Sequence
  Description of Artificial Sequence: Synthetic coding sequence
atggtgagcaagttccccgtgatcgtgggccacgaggccaccggcatcgtggagagcatcggcgagggcgtgaccaccgtgaagcccggcgacaaggtgatccccctgttcctgccccagtgcagagagtgcaacgcctgcagaaaccccgacggcaacctgtgcatcagaagcgacatcaccggcagaggcgtgctggccgacggcaccaccagattcacctgcaagggcaagcccgtgcaccacttcatgaacaccagcaccttcaccgagtacaccgtggtggacgagagcagcgtggccaagatcgacgacgccgccccccccgagaaggtgtgcctgatcggctgcggcttcagcaccggctacggcgccgccgtgaagaccggcaaggtgaagcccggcagcacctgcgtggtgttcggcctgggcggcgtgggcctgagcgtgatcatgggctgcaagagcgccggcgccagcagaatcatcggcatcgacctgaacaaggacaagttcgagaaggccatggccgtgggcgccaccgagtgcatcagccccaaggacagcaccaagcccatcagcgaggtgctgagcgagatgaccggcaacaacgtgggctacaccttcgaggtgatcggccacctggagaccatgatcgacgccctggccagctgccacatgaactacggcaccagcgtggtggtgggcgtgccccccagcgccaagatgctgacctacgaccccatgctgctgttcaccggcagaacctggaagggctgcgtgttcggcggcctgaagagcagagacgacgtgcccaagctggtgaccgagttcctggccaagaagttcgacctggaccagctgatcacccacgtgctgcccttcaagaagatcagcgagggcttcgagctgctgaacagcggccagagcatcagaaccgtgctgaccttctag

SEQ ID NO: 72377 - DNA, 912 bp, Artificial Sequence
  Description of Artificial Sequence: Synthetic coding sequence
atggccgccgccgccagagccagagtggcctacctgctgagacagctgcagagagccgcctgccagtgccccacccacagccacacctacagccaggcccccggcctgagccccagcggcaagaccaccgactacgccttcgagatggccgtgagcaacatcagatacggcgccgccgtgaccaaggaggtgggcatggacctgaagaacatgggcgccaagaacgtgtgcctgatgaccgacaagaacctgagcaagctgccccccgtgcaggtggccatggacagcctggtgaagaacggcatccccttcaccgtgtacgacaacgtgagagtggagcccaccgacagcagcttcatggaggccatcgagttcgcccagaagggcgccttcgacgcctacgtggccgtgggcggcggcagcaccatggacacctgcaaggccgccaacctgtacgccagcagcccccacagcgacttcctggactacgtgagcgcccccatcggcaagggcaagcccgtgagcgtgcccctgaagcccctgatcgccgtgcccaccaccagcggcaccggcagcgagaccaccggcgtggccatcttcgactacgagcacctgaaggtgaagatcggcatcaccagcagagccatcaagcccaccctgggcctgatcgaccccctgcacaccctgcacatgcccgccagagtggtggccaacagcggcttcgacgtgctgtgccacgccctggagagctacaccaccctgccctaccacctgagaagcccctgccccagcaaccccatcaccagacccgcctaccagggcagcaaccccatcagcgacatctgggccatccacgccctgagaatcgtggccaagtacctgaagagagccgtgaacagcaccgacaagtag

SEQ ID NO: 72378 - DNA, 1404 bp, Artificial Sequence
  Description of Artificial Sequence: Synthetic coding sequence
atggccgccgccgccagagccagagtggcctacctgctgagacagctgcagagagccgcctgccagtgccccacccacagccacacctacagccaggcccccggcctgagccccagcggcaagaccaccgactacgccttcgagatggccgtgagcaacatcagatacggcgccgccgtgaccaaggaggtgggcatggacctgaagaacatgggcgccaagaacgtgtgcctgatgaccgacaagaacctgagcaagctgccccccgtgcaggtggccatggacagcctggtgaagaacggcatccccttcaccgtgtacgacaacgtgagagtggagcccaccgacagcagcttcatggaggccatcgagttcgcccagaagggcgccttcgacgcctacgtggccgtgggcggcggcagcaccatggacacctgcaaggccgccaacctgtacgccagcagcccccacagcgacttcctggactacgtgagcgcccccatcggcaagggcaagcccgtgagcgtgcccctgaagcccctgatcgccgtgcccaccaccagcggcaccggcagcgagaccaccggcgtggccatcttcgactacgagcacctgaaggtgaagatcggcatcaccagcagagccatcaagcccaccctgggcctgatcgaccccctgcacaccctgcacatgcccgccagagtggtggccaacagcggcttcgacgtgctgtgccacgccctggagagctacaccaccctgccctaccacctgagaagcccctgccccagcaaccccatcaccagacccgcctaccagggcagcaaccccatcagcgacatctgggccatccacgccctgagaatcgtggccaagtacctgaagagagccgtgagaaaccccgacgacctggaggccagaagccacatgcacctggccagcgccttcgccggcatcggcttcggcaacgccggcgtgcacctgtgccacggcatgagctaccccatcagcggcctggtgaagatgtacaaggccaaggactacaacgtggaccaccccctggtgccccacggcctgagcgtggtgctgaccagccccgccgtgttcaccttcaccgcccagatgttccccgagagacacctggagatggccgagatcctgggcgccgacaccagaaccgccagaatccaggacgccggcctggtgctggccgacaccctgagaaagttcctgttcgacctggacgtggacgacggcctggccgccgtgggctacagcaaggccgacatccccgccctggtgaagggcaccctgccccaggagagagtgaccaagctggccccctgcccccagagcgaggaggacctggccgccctgttcgaggccagcatgaagctgtactag

SEQ ID NO: 72379 - DNA, 2406 bp, Artificial Sequence
  Description of Artificial Sequence: Synthetic coding sequence
atgaagatcgccgtgatcggccagagcctgttcggccaggaggtgtactgccacctgagaaaggagggccacgaggtggtgggcgtgttcaccgtgcccgacaaggacggcaaggccgaccccctgggcctggaggccgagaaggacggcgtgcccgtgttcaagtacagcagatggagagccaagggccaggccctgcccgacgtggtggccaagtaccaggccctgggcgccgagctgaacgtgctgcccttctgcagccagttcatccccatggagatcatcagcgcccccagacacggcagcatcatctaccaccccagcctgctgcccagacacagaggcgccagcgccatccacaactggatcagaggcaacgacaaggtgcccggcgcctggaccgaggcctgcgagcagaagctgaccttcttcaacagcaccctgaacaccagcggcctggtgcccgagggcgacgccctgcccatccccggcgcccacagacccggcgtggtgaccaaggccggcctgatcctgttcggcaacgacgacaagatgctgctggtgaagaacatccagctggaggacggcaagatgatcctggccagcaacttcttcaagggcgccgccagcagcgtgctggagctgaccgaggccgagctggtgaccgccgaggccgtgagaagcgtgtggcagagaatcctgcccaaggtgctggaggtggaggacagcaccgacttcttcaagagcggcgccgccagcgtggacgtggtgagactggtggaggaggtgaaggagctgtgcgacggcctggagctggagaacgaggacgtgtacatggccagcaccttcggcgacttcatccagctgctggtgagaaagctgagaggcgacgacgaggagggcgagtgcagcatcgactacgtggagatggccgtgaacaagagaaccgtgagaatgccccaccagctgttcatcggcggcgagttcgtggacgccgagggcgccaagaccagcgagaccatcaaccccaccgacggcagcgtgatctgccaggtgagcctggcccaggtgaccgacgtggacaaggccgtggccgccgccaaggacgccttcgagaacggcagatggggcaagatcagcgccagagacagaggcagactgatgtacagactggccgacctgatggagcagcaccaggaggagctggccaccatcgaggccctggacgccggcgccgtgtacaccctggccctgaagacccacgtgggcatgagcatccagaccttcagatacttcgccggctggtgcgacaagatccagggcagcaccatccccatcaaccaggccagacccaacagaaacctgaccctgaccagaaaggagcccgtgggcgtgtgcggcatcatcatcccctggaactaccccctgatgatgctgagctggaagaccgccgcctgcctggccgccggcaacaccgtggtgatcaagcccgcccaggtgacccccctgaccgccctgaagttcgccgagctgaccctgaaggccggcatccccaagggcgtggtgaacgtgctgcccggcagcggcagcctggtgggccagagactgagcgaccaccccgacgtgagaaagatcggcttcaccggcagcaccgaggtgggcaagcacatcatgaagagctgcgccatcagcaacgtgaagaaggtgagcctggagctgggcggcaagagccccctgatcatcttcgccgactgcgacctgaacaaggccgtgcagatgggcatgagcagcgtgttcttcaacaagggcgagaactgcatcgccgccggcagactgttcgtggaggacagcatccacgacgagttcgtgagaagagtggtggaggaggtgagaaagatgaaggtgggcaaccccctggacagagacaccgaccacggcccccagaaccaccacgcccacctggtgaagctgatggagtactgccagcacggcgtgaaggagggcgccaccctggtgtgcggcggcaaccaggtgcccagacccggcttcttcttcgagcccaccgtgttcaccgacgtggaggaccacatgttcatcgccaaggaggagagcttcggccccgtgatgatcatcagcagattcgccgacggcgacctggacgccgtgctgagcagagccaacgccaccgagttcggcctggccagcggcgtgttcaccagagacatcaacaaggccctgtacgtgagcgacaagctgcaggccggcaccgtgttcgtgaacacctacaacaagaccgacgtggccgcccccttcggcggcttcaagcagagcggcttcggcaaggacctgggcgaggccgccctgaacgagtacctgagagtgaagaccgtgaccttcgagtactag

SEQ ID NO: 72380 - DNA, 1506 bp, Artificial Sequence
  Description of Artificial Sequence: Synthetic coding sequence
atgagcagcagcggcacccccgacctgcccgtgctgctgaccgacctgaagatccagtacaccaagatcttcatcaacaacgagtggcacgacagcgtgagcggcaagaagttccccgtgttcaaccccgccaccgaggaggagctgtgccaggtggaggagggcgacaaggaggacgtggacaaggccgtgaaggccgccagacaggccttccagatcggcagcccctggagaaccatggacgccagcgagagaggcagactgctgtacaagctggccgacctgatcgagagagacagactgctgctggccaccatggagagcatgaacggcggcaagctgtacagcaacgcctacctgaacgacctggccggctgcatcaagaccctgagatactgcgccggctgggccgacaagatccagggcagaaccatccccatcgacggcaacttcttcacctacaccagacacgagcccatcggcgtgtgcggccagatcatcccctggaacttccccctggtgatgctgatctggaagatcggccccgccctgagctgcggcaacaccgtggtggtgaagcccgccgagcagacccccctgaccgccctgcacgtggccagcctgatcaaggaggccggcttcccccccggcgtggtgaacatcgtgcccggctacggccccaccgccggcgccgccatcagcagccacatggacatcgacaaggtggccttcaccggcagcaccgaggtgggcaagctgatcaaggaggccgccggcaagagcaacctgaagagagtgaccctggagctgggcggcaagagcccctgcatcgtgctggccgacgccgacctggacaacgccgtggagttcgcccaccacggcgtgttctaccaccagggccagtgctgcatcgccgccagcagaatcttcgtggaggagagcatctacgacgagttcgtgagaagaagcgtggagagagccaagaagtacatcctgggcaaccccctgacccccggcgtgacccagggcccccagatcgacaaggagcagtacgacaagatcctggacctgatcgagagcggcaagaaggagggcgccaagctggagtgcggcggcggcccctggggcaacaagggctacttcgtgcagcccaccgtgttcagcaacgtgaccgacgagatgagaatcgccaaggaggagatcttcggccccgtgcagcagatcatgaagttcaagagcctggacgacgtgatcaagagagccaacaacaccttctacggcctgagcgccggcgtgttcaccaaggacatcgacaaggccatcaccatcagcagcgccctgcaggccggcaccgtgtgggtgaactgctacggcgtggtgagcgcccagtgccccttcggcggcttcaagatgagcggcaacggcagagagctgggcgagtacggcttccacgagtacaccgaggtgaagaccgtgaccgtgaagatcagccagaagaacagctag

SEQ ID NO: 72381 - DNA, 693 bp, Artificial Sequence
  Description of Artificial Sequence: Synthetic coding sequence
atgagcagcagcggcacccccgacctgcccgtgctgctgaccgacctgaagatccagtacaccaagatcttcatcaacaacgagtggcacgacagcgtgagcggcaagaagttccccgtgttcaaccccgccaccgaggaggagctgtgccaggtggaggagggcgacaaggaggacgtggacaaggccgtgaaggccgccagacaggccttccagatcggcagcccctggagaaccatggacgccagcgagagaggcagactgctgtacaagctggccgacctgatcgagagagacagactgctgctggccaccatggagagcatgaacggcggcaagctgtacagcaacgcctacctgaacgacctggccggctgcatcaagaccctgagatactgcgccggctgggccgacaagatccagggcagaaccatccccatcgacggcaacttcttcacctacaccagacacgagcccatcggcgtgtgcggccagatcatcccctggaacttccccctggtgatgctgatctggaagatcggccccgccctgagctgcggcaacaccgtggtggtgaagcccgccgagcagacccccctgaccgccctgcacgtggccagcctgatcaaggaggccggcttcccccccggcgtggtgaacatcgtgcccggctacggcgccagcgtggtgtag

SEQ ID NO: 72382 - DNA, 717 bp, Artificial Sequence
  Description of Artificial Sequence: Synthetic coding sequence
atgagcagcagcggcacccccgacctgcccgtgctgctgaccgacctgaagatccagtacaccaagatcttcatcaacaacgagtggcacgacagcgtgagcggcaagaagttccccgtgttcaaccccgccaccgaggaggagctgtgccaggtggaggagggcgacaaggaggacgtggacaaggccgtgaaggccgccagacaggccttccagatcggcagcccctggagaaccatggacgccagcgagagaggcagactgctgtacaagctggccgacctgatcgagagagacagactgctgctggccaccatggagagcatgaacggcggcaagctgtacagcaacgcctacctgaacgacctggccggctgcatcaagaccctgagatactgcgccggctgggccgacaagatccagggcagaaccatccccatcgacggcaacttcttcacctacaccagacacgagcccatcggcgtgtgcggccagatcatcccctggaacttccccctggtgatgctgatctggaagatcggccccgccctgagctgcggcaacaccgtggtggtgaagcccgccgagcagacccccctgaccgccctgcacgtggccagcctgatcaaggaggccggcttcccccccggcgtggtgaacatcgtgcccggctacggccccaccgccggcgccgccatcagcagccacatggactag

SEQ ID NO: 72383 - DNA, 990 bp, Artificial Sequence
  Description of Artificial Sequence: Synthetic coding sequence
atcgccgagcccgtgacctgcgtgcccggcgccgagagcgagatgagcagcagcggcacccccgacctgcccgtgctgctgaccgacctgaagatccagtacaccaagatcttcatcaacaacgagtggcacgacagcgtgagcggcaagaagttccccgtgttcaaccccgccaccgaggaggagctgtgccaggtggaggagggcgacaaggaggacgtggacaaggccgtgaaggccgccagacaggccttccagatcggcagcccctggagaaccatggacgccagcgagagaggcagactgctgtacaagctggccgacctgatcgagagagacagactgctgctggccaccatggagagcatgaacggcggcaagctgtacagcaacgcctacctgaacgacctggccggctgcatcaagaccctgagatactgcgccggctgggccgacaagatccagggcagaaccatccccatcgacggcaacttcttcacctacaccagacacgagcccatcggcgtgtgcggccagatcatcccctggaacttccccctggtgatgctgatctggaagatcggccccgccctgagctgcggcaacaccgtggtggtgaagcccgccgagcagacccccctgaccgccctgcacgtggccagcctgatcaaggaggccggcttcccccccggcgtggtgaacatcgtgcccggctacggccccaccgccggcgccgccatcagcagccacatggacatcgacaaggtggccttcaccggcagcaccgaggtgggcaagctgatcaaggaggccgccggcaagagcaacctgaagagagtgaccctggagctgggcggcaagagcccctgcatcgtgctggccgacgccgacctggacaacgccgtggagttcgcccaccacggcgtgttctaccaccagggccagtgctgcatcgccgccagcagattctgcggcagaatcaacctgtag

SEQ ID NO: 72384 - DNA, 612 bp, Artificial Sequence
  Description of Artificial Sequence: Synthetic coding sequence
atgagcagcagcggcacccccgacctgcccgtgctgctgaccgacctgaagatccagtacaccaagatcttcatcaacaacgagtggcacgacagcgtgagcggcaagaagttccccgtgttcaaccccgccaccgaggaggagctgtgccaggtggaggagggcgacaaggaggacgtggacaaggccgtgaaggccgccagacaggccttccagatcggcagcccctggagaaccatggacgccagcgagagaggcagactgctgtacaagctggccgacctgatcgagagagacagactgctgctggccaccatggagagcatgaacggcggcaagctgtacagcaacgcctacctgaacgacctggccggctgcatcaagaccctgagatactgcgccggctgggccgacaagatccagggcagaaccatccccatcgacggcaacttcttcacctacaccagacacgagcccatcggcgtgtgcggccagatcatcccctggaacttccccctggtgatgctgatctggaagatcggccccgccctgagctgcggcaacaccgtggtggtgaagcccgccgagcagacccccctgaccgccctgtag

SEQ ID NO: 72385 - DNA, 1557 bp, Artificial Sequence
  Description of Artificial Sequence: Synthetic coding sequence
atgaccagcagcaagatcgagatgcccggcgaggtgaaggccgaccccgccgccctgatggccagcctgcacctgctgcccagccccacccccaacctggagatcaagtacaccaagatcttcatcaacaacgagtggcagaacagcgagagcggcagagtgttccccgtgtacaaccccgccaccggcgagcaggtgtgcgaggtgcaggaggccgacaaggccgacatcgacaaggccgtgcaggccgccagactggccttcagcctgggcagcgtgtggagaagaatggacgccagcgagagaggcagactgctggacaagctggccgacctggtggagagagacagagccgtgctggccaccatggagagcctgaacggcggcaagcccttcctgcaggccttctacgtggacctgcagggcgtgatcaagaccttcagatactacgccggctgggccgacaagatccacggcatgaccatccccgtggacggcgactacttcaccttcaccagacacgagcccatcggcgtgtgcggccagatcatcccctggaacttccccctgctgatgttcgcctggaagatcgcccccgccctgtgctgcggcaacaccgtggtgatcaagcccgccgagcagacccccctgagcgccctgtacatgggcgccctgatcaaggaggccggcttcccccccggcgtgatcaacatcctgcccggctacggccccaccgccggcgccgccatcgccagccacatcggcatcgacaagatcgccttcaccggcagcaccgaggtgggcaagctgatccaggaggccgccggcagaagcaacctgaagagagtgaccctggagctgggcggcaagagccccaacatcatcttcgccgacgccgacctggactacgccgtggagcaggcccaccagggcgtgttcttcaaccagggccagtgctgcaccgccggcagcagaatcttcgtggaggagagcatctacgaggagttcgtgagaagaagcgtggagagagccaagagaagagtggtgggcagccccttcgaccccaccaccgagcagggcccccagatcgacaagaagcagtacaacaagatcctggagctgatccagagcggcgtggccgagggcgccaagctggagtgcggcggcaagggcctgggcagaaagggcttcttcatcgagcccaccgtgttcagcaacgtgaccgacgacatgagaatcgccaaggaggagatcttcggccccgtgcaggagatcctgagattcaagaccatggacgaggtgatcgagagagccaacaacagcgacttcggcctggtggccgccgtgttcaccaacgacatcaacaaggccctgaccgtgagcagcgccatgcaggccggcaccgtgtggatcaactgctacaacgccctgaacgcccagagccccttcggcggcttcaagatgagcggcaacggcagagagatgggcgagttcggcctgagagagtacagcgaggtgaagaccgtgaccgtgaagatcccccagaagaacagctag

SEQ ID NO: 72386 - DNA, 1443 bp, Artificial Sequence
  Description of Artificial Sequence: Synthetic coding sequence
atgaccagcagcaagatcgagatgcccggcgaggtgaaggccgaccccgccgccctgatggccagcctgcacctgctgcccagccccacccccaacctggagatcaagtacaccaagatcttcatcaacaacgagtggcagaacagcgagagcggcagagtgttccccgtgtacaaccccgccaccggcgagcaggtgtgcgaggtgcaggaggccgacaaggccgacatcgacaaggccgtgcaggccgccagactggccttcagcctgggcagcgtgtggagaagaatggacgccagcgagagaggcagactgctggacaagctggccgacctggtggagagagacagagccgtgctggccaccatggagagcctgaacggcggcaagcccttcctgcaggccttctacgtggacctgcagggcgtgatcaagaccttcagatactacgccggctgggccgacaagatccacggcatgaccatccccgtggacggcgactacttcaccttcaccagacacgagcccatcggcgtgtgcggccagatcatcccctggaacttccccctgctgatgttcgcctggaagatcgcccccgccctgtgctgcggcaacaccgtggtgatcaagcccgccgagcagacccccctgagcgccctgtacatgggcgccctgatcaaggaggtgggcaagctgatccaggaggccgccggcagaagcaacctgaagagagtgaccctggagctgggcggcaagagccccaacatcatcttcgccgacgccgacctggactacgccgtggagcaggcccaccagggcgtgttcttcaaccagggccagtgctgcaccgccggcagcagaatcttcgtggaggagagcatctacgaggagttcgtgagaagaagcgtggagagagccaagagaagagtggtgggcagccccttcgaccccaccaccgagcagggcccccagatcgacaagaagcagtacaacaagatcctggagctgatccagagcggcgtggccgagggcgccaagctggagtgcggcggcaagggcctgggcagaaagggcttcttcatcgagcccaccgtgttcagcaacgtgaccgacgacatgagaatcgccaaggaggagatcttcggccccgtgcaggagatcctgagattcaagaccatggacgaggtgatcgagagagccaacaacagcgacttcggcctggtggccgccgtgttcaccaacgacatcaacaaggccctgaccgtgagcagcgccatgcaggccggcaccgtgtggatcaactgctacaacgccctgaacgcccagagccccttcggcggcttcaagatgagcggcaacggcagagagatgggcgagttcggcctgagagagtacagcgaggtgaagaccgtgaccgtgaagatcccccagaagaacagctag

SEQ ID NO: 72387 - DNA, 1494 bp, Artificial Sequence
  Description of Artificial Sequence: Synthetic coding sequence
atgaagaaccagtgcgagaccgtgtggctgaagagccccatcaagctgaagctgatcttcatcaacaacgagtggcagaacagcgagagcggcagagtgttccccgtgtacaaccccgccaccggcgagcaggtgtgcgaggtgcaggaggccgacaaggccgacatcgacaaggccgtgcaggccgccagactggccttcagcctgggcagcgtgtggagaagaatggacgccagcgagagaggcagactgctggacaagctggccgacctggtggagagagacagagccgtgctggccaccatggagagcctgaacggcggcaagcccttcctgcaggccttctacgtggacctgcagggcgtgatcaagaccttcagatactacgccggctgggccgacaagatccacggcatgaccatccccgtggacggcgactacttcaccttcaccagacacgagcccatcggcgtgtgcggccagatcatcccctggaacttccccctgctgatgttcgcctggaagatcgcccccgccctgtgctgcggcaacaccgtggtgatcaagcccgccgagcagacccccctgagcgccctgtacatgggcgccctgatcaaggaggccggcttcccccccggcgtgatcaacatcctgcccggctacggccccaccgccggcgccgccatcgccagccacatcggcatcgacaagatcgccttcaccggcagcaccgaggtgggcaagctgatccaggaggccgccggcagaagcaacctgaagagagtgaccctggagctgggcggcaagagccccaacatcatcttcgccgacgccgacctggactacgccgtggagcaggcccaccagggcgtgttcttcaaccagggccagtgctgcaccgccggcagcagaatcttcgtggaggagagcatctacgaggagttcgtgagaagaagcgtggagagagccaagagaagagtggtgggcagccccttcgaccccaccaccgagcagggcccccagatcgacaagaagcagtacaacaagatcctggagctgatccagagcggcgtggccgagggcgccaagctggagtgcggcggcaagggcctgggcagaaagggcttcttcatcgagcccaccgtgttcagcaacgtgaccgacgacatgagaatcgccaaggaggagatcttcggccccgtgcaggagatcctgagattcaagaccatggacgaggtgatcgagagagccaacaacagcgacttcggcctggtggccgccgtgttcaccaacgacatcaacaaggccctgaccgtgagcagcgccatgcaggccggcaccgtgtggatcaactgctacaacgccctgaacgcccagagccccttcggcggcttcaagatgagcggcaacggcagagagatgggcgagttcggcctgagagagtacagcgaggtgaagaccgtgaccgtgaagatcccccagaagaacagctag

SEQ ID NO: 72388 - DNA, 1470 bp, Artificial Sequence
  Description of Artificial Sequence: Synthetic coding sequence
atgaagggcaagaactgcaacgacgtgaagatcttcatcaacaacgagtggcagaacagcgagagcggcagagtgttccccgtgtacaaccccgccaccggcgagcaggtgtgcgaggtgcaggaggccgacaaggccgacatcgacaaggccgtgcaggccgccagactggccttcagcctgggcagcgtgtggagaagaatggacgccagcgagagaggcagactgctggacaagctggccgacctggtggagagagacagagccgtgctggccaccatggagagcctgaacggcggcaagcccttcctgcaggccttctacgtggacctgcagggcgtgatcaagaccttcagatactacgccggctgggccgacaagatccacggcatgaccatccccgtggacggcgactacttcaccttcaccagacacgagcccatcggcgtgtgcggccagatcatcccctggaacttccccctgctgatgttcgcctggaagatcgcccccgccctgtgctgcggcaacaccgtggtgatcaagcccgccgagcagacccccctgagcgccctgtacatgggcgccctgatcaaggaggccggcttcccccccggcgtgatcaacatcctgcccggctacggccccaccgccggcgccgccatcgccagccacatcggcatcgacaagatcgccttcaccggcagcaccgaggtgggcaagctgatccaggaggccgccggcagaagcaacctgaagagagtgaccctggagctgggcggcaagagccccaacatcatcttcgccgacgccgacctggactacgccgtggagcaggcccaccagggcgtgttcttcaaccagggccagtgctgcaccgccggcagcagaatcttcgtggaggagagcatctacgaggagttcgtgagaagaagcgtggagagagccaagagaagagtggtgggcagccccttcgaccccaccaccgagcagggcccccagatcgacaagaagcagtacaacaagatcctggagctgatccagagcggcgtggccgagggcgccaagctggagtgcggcggcaagggcctgggcagaaagggcttcttcatcgagcccaccgtgttcagcaacgtgaccgacgacatgagaatcgccaaggaggagatcttcggccccgtgcaggagatcctgagattcaagaccatggacgaggtgatcgagagagccaacaacagcgacttcggcctggtggccgccgtgttcaccaacgacatcaacaaggccctgaccgtgagcagcgccatgcaggccggcaccgtgtggatcaactgctacaacgccctgaacgcccagagccccttcggcggcttcaagatgagcggcaacggcagagagatgggcgagttcggcctgagagagtacagcgaggtgaagaccgtgaccgtgaagatcccccagaagaacagctag

SEQ ID NO: 72389 - DNA, 30 bp, Artificial Sequence
  Description of Artificial Sequence: Synthetic coding sequence
atggacgccagcgagagaggcagactgtag

SEQ ID NO: 72390 - DNA, 1470 bp, Artificial Sequence
  Description of Artificial Sequence: Synthetic coding sequence
atgaagggcagaaactggaagaccaccaagatcttcatcaacaacgagtggcagaacagcgagagcggcagagtgttccccgtgtacaaccccgccaccggcgagcaggtgtgcgaggtgcaggaggccgacaaggccgacatcgacaaggccgtgcaggccgccagactggccttcagcctgggcagcgtgtggagaagaatggacgccagcgagagaggcagactgctggacaagctggccgacctggtggagagagacagagccgtgctggccaccatggagagcctgaacggcggcaagcccttcctgcaggccttctacgtggacctgcagggcgtgatcaagaccttcagatactacgccggctgggccgacaagatccacggcatgaccatccccgtggacggcgactacttcaccttcaccagacacgagcccatcggcgtgtgcggccagatcatcccctggaacttccccctgctgatgttcgcctggaagatcgcccccgccctgtgctgcggcaacaccgtggtgatcaagcccgccgagcagacccccctgagcgccctgtacatgggcgccctgatcaaggaggccggcttcccccccggcgtgatcaacatcctgcccggctacggccccaccgccggcgccgccatcgccagccacatcggcatcgacaagatcgccttcaccggcagcaccgaggtgggcaagctgatccaggaggccgccggcagaagcaacctgaagagagtgaccctggagctgggcggcaagagccccaacatcatcttcgccgacgccgacctggactacgccgtggagcaggcccaccagggcgtgttcttcaaccagggccagtgctgcaccgccggcagcagaatcttcgtggaggagagcatctacgaggagttcgtgagaagaagcgtggagagagccaagagaagagtggtgggcagccccttcgaccccaccaccgagcagggcccccagatcgacaagaagcagtacaacaagatcctggagctgatccagagcggcgtggccgagggcgccaagctggagtgcggcggcaagggcctgggcagaaagggcttcttcatcgagcccaccgtgttcagcaacgtgaccgacgacatgagaatcgccaaggaggagatcttcggccccgtgcaggagatcctgagattcaagaccatggacgaggtgatcgagagagccaacaacagcgacttcggcctggtggccgccgtgttcaccaacgacatcaacaaggccctgaccgtgagcagcgccatgcaggccggcaccgtgtggatcaactgctacaacgccctgaacgcccagagccccttcggcggcttcaagatgagcggcaacggcagagagatgggcgagttcggcctgagagagtacagcgaggtgaagaccgtgaccgtgaagatcccccagaagaacagctag

SEQ ID NO: 72391 - DNA, 78 bp, Artificial Sequence
  Description of Artificial Sequence: Synthetic coding sequence
atggacgccagcgagagaggcagactgctggacaagctggccgacctggtggagagagacagagccgtgctggcctag

SEQ ID NO: 72392 - DNA, 1269 bp, Artificial Sequence
  Description of Artificial Sequence: Synthetic coding sequence
atggacgccagcgagagaggcagactgctggacaagctggccgacctggtggagagagacagagccgtgctggccaccatggagagcctgaacggcggcaagcccttcctgcaggccttctacgtggacctgcagggcgtgatcaagaccttcagatactacgccggctgggccgacaagatccacggcatgaccatccccgtggacggcgactacttcaccttcaccagacacgagcccatcggcgtgtgcggccagatcatcccctggaacttccccctgctgatgttcgcctggaagatcgcccccgccctgtgctgcggcaacaccgtggtgatcaagcccgccgagcagacccccctgagcgccctgtacatgggcgccctgatcaaggaggccggcttcccccccggcgtgatcaacatcctgcccggctacggccccaccgccggcgccgccatcgccagccacatcggcatcgacaagatcgccttcaccggcagcaccgaggtgggcaagctgatccaggaggccgccggcagaagcaacctgaagagagtgaccctggagctgggcggcaagagccccaacatcatcttcgccgacgccgacctggactacgccgtggagcaggcccaccagggcgtgttcttcaaccagggccagtgctgcaccgccggcagcagaatcttcgtggaggagagcatctacgaggagttcgtgagaagaagcgtggagagagccaagagaagagtggtgggcagccccttcgaccccaccaccgagcagggcccccagatcgacaagaagcagtacaacaagatcctggagctgatccagagcggcgtggccgagggcgccaagctggagtgcggcggcaagggcctgggcagaaagggcttcttcatcgagcccaccgtgttcagcaacgtgaccgacgacatgagaatcgccaaggaggagatcttcggccccgtgcaggagatcctgagattcaagaccatggacgaggtgatcgagagagccaacaacagcgacttcggcctggtggccgccgtgttcaccaacgacatcaacaaggccctgaccgtgagcagcgccatgcaggccggcaccgtgtggatcaactgctacaacgccctgaacgcccagagccccttcggcggcttcaagatgagcggcaacggcagagagatgggcgagttcggcctgagagagtacagcgaggtgaagaccgtgaccgtgaagatcccccagaagaacagctag

SEQ ID NO: 72393 - DNA, 258 bp, Artificial Sequence
  Description of Artificial Sequence: Synthetic coding sequence
atggacgccagcgagagaggcagactgctggacaagctggccgacctggtggagagagacagagccgtgctggccaccatggagagcctgaacggcggcaagcccttcctgcaggccttctacgtggacctgcagggcgtgatcaagaccttcagatactacgccggctgggccgacaagatccacggcatgaccatccccgtggacggcgactacttcaccttcaccagacacgagcccatcggcgtgtgcggctag

SEQ ID NO: 72394 - DNA, 1539 bp, Artificial Sequence
  Description of Artificial Sequence: Synthetic coding sequence
atggccaccgccaacggcgccgtggagaacggccagcccgacagaaagccccccgccctgcccagacccatcagaaacctggaggtgaagttcaccaagatcttcatcaacaacgagtggcacgagagcaagagcggcaagaagttcgccacctgcaaccccagcaccagagagcagatctgcgaggtggaggagggcgacaagcccgacgtggacaaggccgtggaggccgcccaggtggccttccagagaggcagcccctggagaagactggacgccctgagcagaggcagactgctgcaccagctggccgacctggtggagagagacagagccaccctggccgccctggagaccatggacaccggcaagcccttcctgcacgccttcttcatcgacctggagggctgcatcagaaccctgagatacttcgccggctgggccgacaagatccagggcaagaccatccccaccgacgacaacgtggtgtgcttcaccagacacgagcccatcggcgtgtgcggcgccatcaccccctggaacttccccctgctgatgctggtgtggaagctggcccccgccctgtgctgcggcaacaccatggtgctgaagcccgccgagcagacccccctgaccgccctgtacctgggcagcctgatcaaggaggccggcttcccccccggcgtggtgaacatcgtgcccggcttcggccccaccgtgggcgccgccatcagcagccacccccagatcaacaagatcgccttcaccggcagcaccgaggtgggcaagctggtgaaggaggccgccagcagaagcaacctgaagagagtgaccctggagctgggcggcaagaacccctgcatcgtgtgcgccgacgccgacctggacctggccgtggagtgcgcccaccagggcgtgttcttcaaccagggccagtgctgcaccgccgccagcagagtgttcgtggaggagcaggtgtacagcgagttcgtgagaagaagcgtggagtacgccaagaagagacccgtgggcgaccccttcgacgtgaagaccgagcagggcccccagatcgaccagaagcagttcgacaagatcctggagctgatcgagagcggcaagaaggagggcgccaagctggagtgcggcggcagcgccatggaggacaagggcctgttcatcaagcccaccgtgttcagcgaggtgaccgacaacatgagaatcgccaaggaggagatcttcggccccgtgcagcccatcctgaagttcaagagcatcgaggaggtgatcaagagagccaacagcaccgactacggcctgaccgccgccgtgttcaccaagaacctggacaaggccctgaagctggccagcgccctggagagcggcaccgtgtggatcaactgctacaacgccctgtacgcccaggcccccttcggcggcttcaagatgagcggcaacggcagagagctgggcgagtacgccctggccgagtacaccgaggtgaagaccgtgaccatcaagctgggcgacaagaacccctag

SEQ ID NO: 72395 - DNA, 456 bp, Artificial Sequence
  Description of Artificial Sequence: Synthetic coding sequence
atggccaccgccaacggcgccgtggagaacggccagcccgacagaaagccccccgccctgcccagacccatcagaaacctggaggtgaagttcaccaagatcttcatcaacaacgagtggcacgagagcaagagcggcaagaagttcgccacctgcaaccccagcaccagagagcagatctgcgaggtggaggagggcgacaagcccgacgtggacaaggccgtggaggccgcccaggtggccttccagagaggcagcccctggagaagactggacgccctgagcagaggcagactgctgcaccagctggccgacctggtggagagagacagagccaccctggccgccctggagaccatggacaccggcaagcccttcctgcacgccttcttcatcgacctggagggctgcatcagaaccctgagactgatcaagagcagcagcaccaagagctag

SEQ ID NO: 72396 - DNA, 1554 bp, Artificial Sequence
  Description of Artificial Sequence: Synthetic coding sequence
atgctgagattcctggcccccagactgctgagcctgcagggcagaaccgccagatacagcagcgccgccgccctgcccagccccatcctgaaccccgacatcccctacaaccagctgttcatcaacaacgagtggcaggacgccgtgagcaagaagaccttccccaccgtgaaccccaccaccggcgaggtgatcggccacgtggccgagggcgacagagccgacgtggacagagccgtgaaggccgccagagaggccttcagactgggcagcccctggagaagaatggacgccagcgagagaggcagactgctgaacagactggccgacctggtggagagagacagagtgtacctggccagcctggagaccctggacaacggcaagcccttccaggagagctacgccctggacctggacgaggtgatcaaggtgtacagatacttcgccggctgggccgacaagtggcacggcaagaccatccccatggacggccagcacttctgcttcaccagacacgagcccgtgggcgtgtgcggccagatcatcccctggaacttccccctggtgatgcagggctggaagctggcccccgccctggccaccggcaacaccgtggtgatgaaggtggccgagcagacccccctgagcgccctgtacctggccagcctgatcaaggaggccggcttcccccccggcgtggtgaacatcatcaccggctacggccccaccgccggcgccgccatcgcccagcacgtggacgtggacaaggtggccttcaccggcagcaccgaggtgggccacctgatccagaaggccgccggcgacagcaacctgaagagagtgaccctggagctgggcggcaagagccccagcatcgtgctggccgacgccgacatggagcacgccgtggagcagtgccacgaggccctgttcttcaacatgggccagtgctgctgcgccggcagcagaaccttcgtggaggagagcatctacaacgagttcctggagagaaccgtggagaaggccaagcagagaaaggtgggcaaccccttcgagctggacacccagcagggcccccaggtggacaaggagcagttcgagagagtgctgggctacatccagctgggccagaaggagggcgccaagctgctgtgcggcggcgagagattcggcgagagaggcttcttcatcaagcccaccgtgttcggcggcgtgcaggacgacatgagaatcgccaaggaggagatcttcggccccgtgcagcccctgttcaagttcaagaagatcgaggaggtggtggagagagccaacaacaccagatacggcctggccgccgccgtgttcaccagagacctggacaaggccatgtacttcacccaggccctgcaggccggcaccgtgtgggtgaacacctacaacatcgtgacctgccacacccccttcggcggcttcaaggagagcggcaacggcagagagctgggcgaggacggcctgaaggcctacaccgaggtgaagaccgtgaccatcaaggtgccccagaagaacagctag

SEQ ID NO: 72397 - DNA, 657 bp, Artificial Sequence
  Description of Artificial Sequence: Synthetic coding sequence
atggagcacgccgtggagcagtgccacgaggccctgttcttcaacatgggccagtgctgctgcgccggcagcagaaccttcgtggaggagagcatctacaacgagttcctggagagaaccgtggagaaggccaagcagagaaaggtgggcaaccccttcgagctggacacccagcagggcccccaggtggacaaggagcagttcgagagagtgctgggctacatccagctgggccagaaggagggcgccaagctgctgtgcggcggcgagagattcggcgagagaggcttcttcatcaagcccaccgtgttcggcggcgtgcaggacgacatgagaatcgccaaggaggagatcttcggccccgtgcagcccctgttcaagttcaagaagatcgaggaggtggtggagagagccaacaacaccagatacggcctggccgccgccgtgttcaccagagacctggacaaggccatgtacttcacccaggccctgcaggccggcaccgtgtgggtgaacacctacaacatcgtgacctgccacacccccttcggcggcttcaaggagagcggcaacggcagagagctgggcgaggacggcctgaaggcctacaccgaggtgaagaccgtgaccatcaaggtgccccagaagaacagctag

SEQ ID NO: 72398 - DNA, 2739 bp, Artificial Sequence
  Description of Artificial Sequence: Synthetic coding sequence
atggccggccccagcaacccccccgccaccatgaagatcgccgtgatcggccagagcctgttcggccaggaggtgtactgccacctgagaaaggagggccacgaggtggtgggcgtgttcaccgtgcccgacaaggacggcaaggccgaccccctgggcctggaggccgagaaggacggcgtgcccgtgttcaagtacagcagatggagagccaagggccaggccctgcccgacgtggtggccaagtaccaggccctgggcgccgagctgaacgtgctgcccttctgcagccagttcatccccatggagatcatcagcgcccccagacacggcagcatcatctaccaccccagcctgctgcccagacacagaggcgccagcgccatcaactggaccctgatccacggcgacaagaagggcggcttcagcatcttctgggccgacgacggcctggacaccggcgacctgctgctgcagaaggagtgcgaggtgctgcccgacgacaccgtgagcaccctgtacaacagattcctgttccccgagggcatcaagggcatggtgcaggccgtgagactgatcgccgagggcaaggcccccagactgccccagcccgaggagggcgccacctacgagggcatccagaagaaggagaccgccaagatcaactgggaccagcccgccgaggccatccacaactggatcagaggcaacgacaaggtgcccggcgcctggaccgaggcctgcgagcagaagctgaccttcttcaacagcaccctgaacaccagcggcctggtgcccgagggcgacgccctgcccatccccggcgcccacagacccggcgtggtgaccaaggccggcctgatcctgttcggcaacgacgacaagatgctgctggtgaagaacatccagctggaggacggcaagatgatcctggccagcaacttcttcaagggcgccgccagcagcgtgctggagctgaccgaggccgagctggtgaccgccgaggccgtgagaagcgtgtggcagagaatcctgcccaaggtgctggaggtggaggacagcaccgacttcttcaagagcggcgccgccagcgtggacgtggtgagactggtggaggaggtgaaggagctgtgcgacggcctggagctggagaacgaggacgtgtacatggccagcaccttcggcgacttcatccagctgctggtgagaaagctgagaggcgacgacgaggagggcgagtgcagcatcgactacgtggagatggccgtgaacaagagaaccgtgagaatgccccaccagctgttcatcggcggcgagttcgtggacgccgagggcgccaagaccagcgagaccatcaaccccaccgacggcagcgtgatctgccaggtgagcctggcccaggtgaccgacgtggacaaggccgtggccgccgccaaggacgccttcgagaacggcagatggggcaagatcagcgccagagacagaggcagactgatgtacagactggccgacctgatggagcagcaccaggaggagctggccaccatcgaggccctggacgccggcgccgtgtacaccctggccctgaagacccacgtgggcatgagcatccagaccttcagatacttcgccggctggtgcgacaagatccagggcagcaccatccccatcaaccaggccagacccaacagaaacctgaccctgaccagaaaggagcccgtgggcgtgtgcggcatcatcatcccctggaactaccccctgatgatgctgagctggaagaccgccgcctgcctggccgccggcaacaccgtggtgatcaagcccgcccaggtgacccccctgaccgccctgaagttcgccgagctgaccctgaaggccggcatccccaagggcgtggtgaacgtgctgcccggcagcggcagcctggtgggccagagactgagcgaccaccccgacgtgagaaagatcggcttcaccggcagcaccgaggtgggcaagcacatcatgaagagctgcgccatcagcaacgtgaagaaggtgagcctggagctgggcggcaagagccccctgatcatcttcgccgactgcgacctgaacaaggccgtgcagatgggcatgagcagcgtgttcttcaacaagggcgagaactgcatcgccgccggcagactgttcgtggaggacagcatccacgacgagttcgtgagaagagtggtggaggaggtgagaaagatgaaggtgggcaaccccctggacagagacaccgaccacggcccccagaaccaccacgcccacctggtgaagctgatggagtactgccagcacggcgtgaaggagggcgccaccctggtgtgcggcggcaaccaggtgcccagacccggcttcttcttcgagcccaccgtgttcaccgacgtggaggaccacatgttcatcgccaaggaggagagcttcggccccgtgatgatcatcagcagattcgccgacggcgacctggacgccgtgctgagcagagccaacgccaccgagttcggcctggccagcggcgtgttcaccagagacatcaacaaggccctgtacgtgagcgacaagctgcaggccggcaccgtgttcgtgaacacctacaacaagaccgacgtggccgcccccttcggcggcttcaagcagagcggcttcggcaaggacctgggcgaggccgccctgaacgagtacctgagagtgaagaccgtgaccttcgagtactag

SEQ ID NO: 72399 - DNA, 1518 bp, Artificial Sequence
  Description of Artificial Sequence: Synthetic coding sequence
atgaagatcgccgtgatcggccagagcctgttcggccaggaggtgtactgccacctgagaaaggagggccacgaggtggtgggcgtgttcaccgtgcccgacaaggacggcaaggccgaccccctgggcctggaggccgagaaggacggcgtgcccgtgttcaagtacagcagatggagagccaagggccaggccctgcccgacgtggtggccaagtaccaggccctgggcgccgagctgaacgtgctgcccttctgcagccagttcatccccatggagatcatcagcgcccccagacacggcagcatcatctaccaccccagcctgctgcccagacacagaggcgccagcgccatcaactggaccctgatccacggcgacaagaagggcggcttcagcatcttctgggccgacgacggcctggacaccggcgacctgctgctgcagaaggagtgcgaggtgctgcccgacgacaccgtgagcaccctgtacaacagattcctgttccccgagggcatcaagggcatggtgcaggccgtgagactgatcgccgagggcaaggcccccagactgccccagcccgaggagggcgccacctacgagggcatccagaagaaggagaccgccaagatcaactgggaccagcccgccgaggccatccacaactggatcagaggcaacgacaaggtgcccggcgcctggaccgaggcctgcgagcagaagctgaccttcttcaacagcaccctgaacaccagcggcctggtgcccgagggcgacgccctgcccatccccggcgcccacagacccggcgtggtgaccaaggccggcctgatcctgttcggcaacgacgacaagatgctgctggtgaagaacatccagctggaggacggcaagatgatcctggccagcaacttcttcaagggcgccgccagcagcgtgctggagctgaccgaggccgagctggtgaccgccgaggccgtgagaagcgtgtggcagagaatcctgcccaaggtgctggaggtggaggacagcaccgacttcttcaagagcggcgccgccagcgtggacgtggtgagactggtggaggaggtgaaggagctgtgcgacggcctggagctggagaacgaggacgtgtacatggccagcaccttcggcgacttcatccagctgctggtgagaaagctgagaggcgacgacgaggagggcgagtgcagcatcgactacgtggagatggccgtgaacaagagaaccgtgagaatgccccaccagctgttcatcggcggcgagttcgtggacgccgagggcgccaagaccagcgagaccatcaaccccaccgacggcagcgtgatctgccaggtgagcctggcccaggtgaccgacgtggacaaggccgtggccgccgccaaggacgccttcgagaacggcagatggggcaagatcagcgccagagacagaggcagactgatgtacagagccccccccagccccagcaccagacccgaccccaccgccacctag

SEQ ID NO: 72400 - DNA, 2709 bp, Artificial Sequence
  Description of Artificial Sequence: Synthetic coding sequence
atgaagatcgccgtgatcggccagagcctgttcggccaggaggtgtactgccacctgagaaaggagggccacgaggtggtgggcgtgttcaccgtgcccgacaaggacggcaaggccgaccccctgggcctggaggccgagaaggacggcgtgcccgtgttcaagtacagcagatggagagccaagggccaggccctgcccgacgtggtggccaagtaccaggccctgggcgccgagctgaacgtgctgcccttctgcagccagttcatccccatggagatcatcagcgcccccagacacggcagcatcatctaccaccccagcctgctgcccagacacagaggcgccagcgccatcaactggaccctgatccacggcgacaagaagggcggcttcagcatcttctgggccgacgacggcctggacaccggcgacctgctgctgcagaaggagtgcgaggtgctgcccgacgacaccgtgagcaccctgtacaacagattcctgttccccgagggcatcaagggcatggtgcaggccgtgagactgatcgccgagggcaaggcccccagactgccccagcccgaggagggcgccacctacgagggcatccagaagaaggagaccgccaagatcaactgggaccagcccgccgaggccatccacaactggatcagaggcaacgacaaggtgcccggcgcctggaccgaggcctgcgagcagaagctgaccttcttcaacagcaccctgaacaccagcggcctggtgcccgagggcgacgccctgcccatccccggcgcccacagacccggcgtggtgaccaaggccggcctgatcctgttcggcaacgacgacaagatgctgctggtgaagaacatccagctggaggacggcaagatgatcctggccagcaacttcttcaagggcgccgccagcagcgtgctggagctgaccgaggccgagctggtgaccgccgaggccgtgagaagcgtgtggcagagaatcctgcccaaggtgctggaggtggaggacagcaccgacttcttcaagagcggcgccgccagcgtggacgtggtgagactggtggaggaggtgaaggagctgtgcgacggcctggagctggagaacgaggacgtgtacatggccagcaccttcggcgacttcatccagctgctggtgagaaagctgagaggcgacgacgaggagggcgagtgcagcatcgactacgtggagatggccgtgaacaagagaaccgtgagaatgccccaccagctgttcatcggcggcgagttcgtggacgccgagggcgccaagaccagcgagaccatcaaccccaccgacggcagcgtgatctgccaggtgagcctggcccaggtgaccgacgtggacaaggccgtggccgccgccaaggacgccttcgagaacggcagatggggcaagatcagcgccagagacagaggcagactgatgtacagactggccgacctgatggagcagcaccaggaggagctggccaccatcgaggccctggacgccggcgccgtgtacaccctggccctgaagacccacgtgggcatgagcatccagaccttcagatacttcgccggctggtgcgacaagatccagggcagcaccatccccatcaaccaggccagacccaacagaaacctgaccctgaccagaaaggagcccgtgggcgtgtgcggcatcatcatcccctggaactaccccctgatgatgctgagctggaagaccgccgcctgcctggccgccggcaacaccgtggtgatcaagcccgcccaggtgacccccctgaccgccctgaagttcgccgagctgaccctgaaggccggcatccccaagggcgtggtgaacgtgctgcccggcagcggcagcctggtgggccagagactgagcgaccaccccgacgtgagaaagatcggcttcaccggcagcaccgaggtgggcaagcacatcatgaagagctgcgccatcagcaacgtgaagaaggtgagcctggagctgggcggcaagagccccctgatcatcttcgccgactgcgacctgaacaaggccgtgcagatgggcatgagcagcgtgttcttcaacaagggcgagaactgcatcgccgccggcagactgttcgtggaggacagcatccacgacgagttcgtgagaagagtggtggaggaggtgagaaagatgaaggtgggcaaccccctggacagagacaccgaccacggcccccagaaccaccacgcccacctggtgaagctgatggagtactgccagcacggcgtgaaggagggcgccaccctggtgtgcggcggcaaccaggtgcccagacccggcttcttcttcgagcccaccgtgttcaccgacgtggaggaccacatgttcatcgccaaggaggagagcttcggccccgtgatgatcatcagcagattcgccgacggcgacctggacgccgtgctgagcagagccaacgccaccgagttcggcctggccagcggcgtgttcaccagagacatcaacaaggccctgtacgtgagcgacaagctgcaggccggcaccgtgttcgtgaacacctacaacaagaccgacgtggccgcccccttcggcggcttcaagcagagcggcttcggcaaggacctgggcgaggccgccctgaacgagtacctgagagtgaagaccgtgaccttcgagtactag

SEQ ID NO: 72401 - DNA, 483 bp, Artificial Sequence
  Description of Artificial Sequence: Synthetic coding sequence
atggtgcaggccgtgagactgatcgccgagggcaaggcccccagactgccccagcccgaggagggcgccacctacgagggcatccagaagaaggagaccgccaagatcaactgggaccagcccgccgaggccatccacaactggatcagaggcaacgacaaggtgcccggcgcctggaccgaggcctgcgagcagaagctgaccttcttcaacagcaccctgaacaccagcggcctggtgcccgagggcgacgccctgcccatccccggcgcccacagacccggcgtggtgaccaaggccggcctgatcctgttcggcaacgacgacaagatggtgagagccagactgtgggtgacctgcctgctgaaggccacccacgcccccgtgctgggcctgagaccccacagaaagaccctgggcagcagcggcgagaacggcaagaaccagacccaggagggcaccctgaccctgatctgcccctag

SEQ ID NO: 72402 - DNA, 507 bp, Artificial Sequence
  Description of Artificial Sequence: Synthetic coding sequence
atgaagatcgccgtgatcggccagagcctgttcggccaggaggtgtactgccacctgagaaaggagggccacgaggtggtgggcgtgttcaccgtgcccgacaaggacggcaaggccgaccccctgggcctggaggccgagaaggacggcgtgcccgtgttcaagtacagcagatggagagccaagggccaggccctgcccgacgtggtggccaagtaccaggccctgggcgccgagctgaacgtgctgcccttctgcagccagttcatccccatggagatcatcagcgcccccagacacggcagcatcatctaccaccccagcctgctgcccagacacagaggcgccagcgccatcaactggaccctgatccacggcgacaagaagggcggcttcagcatcttctgggccgacgacggcctggacaccggcgacctgctgctgcagaaggagtgcgaggtgctgcccgacgacaccgtgagcaccctgtacaacagattcctgtag

SEQ ID NO: 72403 - DNA, 2709 bp, Artificial Sequence; identical to SEQ ID NO: 72400
  Description of Artificial Sequence: Synthetic coding sequence

SEQ ID NO: 72404 - DNA, 474 bp, Artificial Sequence
  Description of Artificial Sequence: Synthetic coding sequence
atgaagatcgccgtgatcggccagagcctgttcggccaggaggtgtactgccacctgagaaaggagggccacgaggtggtgggcgtgttcaccgtgcccgacaaggacggcaaggccgaccccctgggcctggaggccgagaaggacggcgtgcccgtgttcaagtacagcagatggagagccaagggccaggccctgcccgacgtggtggccaagtaccaggccctgggcgccgagctgaacgtgctgcccttctgcagccagttcatccccatggagatcatcagcgcccccagacacggcagcatcatctaccaccccagcctgctgcccagacacagaggcgccagcgccatcaactggaccctgatccacggcgacaagaagggcggcttcagcatcttctgggccgacgacggcctggacaccggcgacctgctgctgcagaaggagtgcgaggtgctgcccgactag

SEQ ID NO: 72405 - DNA, 534 bp, Artificial Sequence
  Description of Artificial Sequence: Synthetic coding sequence
atgaagatcgccgtgatcggccagagcctgttcggccaggaggtgtactgccacctgagaaaggagggccacgaggtggtgggcgtgttcaccgtgcccgacaaggacggcaaggccgaccccctgggcctggaggccgagaaggacggcgtgcccgtgttcaagtacagcagatggagagccaagggccaggccctgcccgacgtggtggccaagtaccaggccctgggcgccgagctgaacgtgctgcccttctgcagccagttcatccccatggagatcatcagcgcccccagacacggcagcatcatctaccaccccagcctgctgcccagacacagaggcgccagcgccatcaactggaccctgatccacggcgacaagaagggcggcttcagcatcttctgggccgacgacggcctggacaccggcgacctgctgctgcagaaggagtgcgaggtgctgcccgacgacaccgtgagcaccctgtacaacagattcctgttccccgagggcatcaagggcatggtgtag

SEQ ID NO: 72406 - DNA, 303 bp, Artificial Sequence
  Description of Artificial Sequence: Synthetic coding sequence
atgaagatcgccgtgatcggccagagcctgttcggccaggaggtgtactgccacctgagaaaggagggccacgaggtggtgggcgtgttcaccgtgcccgacaaggacggcaaggccgaccccctgggcctggaggccgagaaggacggcgtgcccgtgttcaagtacagcagatggagagccaagggccaggccctgcccgacgtggtggccaagtaccaggccctgggcgccgagctgaacgtgctgcccttctgcagccagttcatccccatggagatcatcagcgcccccagacactag

SEQ ID NO: 72407 - DNA, 2409 bp, Artificial Sequence
  Description of Artificial Sequence: Synthetic coding sequence
atggccgccaccagagccggccccagagccagagagatcttcaccagcctggagtacggccccgtgcccgagagccacgcctgcgccctggcctggctggacacccaggacagatgcctgggccactacgtgaacggcaagtggctgaagcccgagcacagaaacagcgtgccctgccaggaccccatcaccggcgagaacctggccagctgcctgcaggcccaggccgaggacgtggccgccgccgtggaggccgccagaatggccttcaagggctggagcgcccaccccggcgtggtgagagcccagcacctgaccagactggccgaggtgatccagaagcaccagagactgctgtggaccctggagagcctggtgaccggcagagccgtgagagaggtgagagacggcgacgtgcagctggcccagcagctgctgcactaccacgccatccaggccagcacccaggaggaggccctggccggctgggagcccatgggcgtgatcggcctgatcctgccccccaccttcagcttcctggagatgatgtggagaatctgccccgccctggccgtgggctgcaccgtggtggccctggtgccccccgccagccccgcccccctgctgctggcccagctggccggcgagctgggccccttccccggcatcctgaacgtgctgagcggccccgccagcctggtgcccatcctggccagccagcccggcatcagaaaggtggccttctgcggcgcccccgaggagggcagagccctgagaagaagcctggccggcgagtgcgccgagctgggcctggccctgggcaccgagagcctgctgctgctgaccgacaccgccgacgtggacagcgccgtggagggcgtggtggacgccgcctggagcgacagaggccccggcggcctgagactgctgatccaggagagcgtgtgggacgaggccatgagaagactgcaggagagaatgggcagactgagaagcggcagaggcctggacggcgccgtggacatgggcgccagaggcgccgccgcctgcgacctggtgcagagattcgtgagagaggcccagagccagggcgcccaggtgttccaggccggcgacgtgcccagcgagagacccttctacccccccaccctggtgagcaacctgccccccgccagcccctgcgcccaggtggaggtgccctggcccgtggtggtggccagccccttcagaaccgccaaggaggccctgctggtggccaacggcacccccagaggcggcagcgccagcgtgtggagcgagagactgggccaggccctggagctgggctacggcctgcaggtgggcaccgtgtggatcaacgcccacggcctgagagaccccagcgtgcccaccggcggctgcaaggagagcggctgcagctggcacggcggccccgacggcctgtacgagtacctgagacccagcggcacccccgccagactgagctgcctgagcaagaacctgaactacgacaccttcggcctggccgtgcccagcaccctgcccgccggccccgagatcggccccagccccgcccccccctacggcctgttcgtgggcggcagattccaggcccccggcgccagaagcagcagacccatcagagacagcagcggcaacctgcacggctacgtggccgagggcggcgccaaggacatcagaggcgccgtggaggccgcccaccaggccttccccggctgggccggccagagccccggcgccagagccgccctgctgtgggccctggccgccgccctggagagaagaaagagcaccctggccagcagactggagagacagggcgccgagctgaaggccgccgaggccgaggtggagctgagcgccagaagactgagagcctggggcgccagagtgcaggcccagggccacaccctgcaggtggccggcctgagaggccccgtgctgagactgagagagcccctgggcgtgctggccgtggtgtgccccgacgagtggcccctgctggccttcgtgagcctgctggcccccgccctggcctacggcaacaccgtggtgatggtgcccagcgccgcctgccccctgctggccctggaggtgtgccaggacatggccaccgtgttccccgccggcctggccaacgtggtgaccggcgacagagaccacctgaccagatgcctggccctgcaccaggacgtgcaggccatgtggtacttcggcagcgcccagggcagccagttcgtggagtgggccagcgccggcaacctgaagcccgtgtgggccagcagaggctgccccagagcctgggaccaggaggccgagggcgccggccccgagctgggcctgagagtggccagaaccaaggccctgtggctgcccatgggcgactag

SEQ ID NO: 72408 - DNA, 1914 bp, Artificial Sequence
  Description of Artificial Sequence: Synthetic coding sequence
atgggcgtgatcggcctgatcctgccccccaccttcagcttcctggagatgatgtggagaatctgccccgccctggccgtgggctgcaccgtggtggccctggtgccccccgccagccccgcccccctgctgctggcccagctggccggcgagctgggccccttccccggcatcctgaacgtgctgagcggccccgccagcctggtgcccatcctggccagccagcccggcatcagaaaggtggccttctgcggcgcccccgaggagggcagagccctgagaagaagcctggccggcgagtgcgccgagctgggcctggccctgggcaccgagagcctgctgctgctgaccgacaccgccgacgtggacagcgccgtggagggcgtggtggacgccgcctggagcgacagaggccccggcggcctgagactgctgatccaggagagcgtgtgggacgaggccatgagaagactgcaggagagaatgggcagactgagaagcggcagaggcctggacggcgccgtggacatgggcgccagaggcgccgccgcctgcgacctggtgcagagattcgtgagagaggcccagagccagggcgcccaggtgttccaggccggcgacgtgcccagcgagagacccttctacccccccaccctggtgagcaacctgccccccgccagcccctgcgcccaggtggaggtgccctggcccgtggtggtggccagccccttcagaaccgccaaggaggccctgctggtggccaacggcacccccagaggcggcagcgccagcgtgtggagcgagagactgggccaggccctggagctgggctacggcctgcaggtgggcaccgtgtggatcaacgcccacggcctgagagaccccagcgtgcccaccggcggctgcaaggagagcggctgcagctggcacggcggccccgacggcctgtacgagtacctgagacccagcggcacccccgccagactgagctgcctgagcaagaacctgaactacgacaccttcggcctggccgtgcccagcaccctgcccgccggccccgagatcggccccagccccgcccccccctacggcctgttcgtgggcggcagattccaggcccccggcgccagaagcagcagacccatcagagacagcagcggcaacctgcacggctacgtggccgagggcggcgccaaggacatcagaggcgccgtggaggccgcccaccaggccttccccggctgggccggccagagccccggcgccagagccgccctgctgtgggccctggccgccgccctggagagaagaaagagcaccctggccagcagactggagagacagggcgccgagctgaaggccgccgaggccgaggtggagctgagcgccagaagactgagagcctggggcgccagagtgcaggcccagggccacaccctgcaggtggccggcctgagaggccccgtgctgagactgagagagcccctgggcgtgctggccgtggtgtgccccgacgagtggcccctgctggccttcgtgagcctgctggcccccgccctggcctacggcaacaccgtggtgatggtgcccagcgccgcctgccccctgctggccctggaggtgtgccaggacatggccaccgtgttccccgccggcctggccaacgtggtgaccggcgacagagaccacctgaccagatgcctggccctgcaccaggacgtgcaggccatgtggtacttcggcagcgcccagggcagccagttcgtggagtgggccagcgccggcaacctgaagcccgtgtgggccagcagaggctgccccagagcctgggaccaggaggccgagggcgccggccccgagctgggcctgagagtggccagaaccaaggccctgtggctgcccatgggcgactag

SEQ ID NO: 72409 - DNA, 2256 bp, Artificial Sequence
  Description of Artificial Sequence: Synthetic coding sequence
atggccgccaccagagccggccccagagccagagagatcttcaccagcctggagtacggccccgtgcccgagagccacgcctgcgccctggcctggctggacacccaggacagatgcctgggccactacgtgaacggcaagtggctgaagcccgagcacagaaacagcgtgccctgccaggaccccatcaccggcgagaacctggccagctgcctgcaggcccaggccgaggacgtggccgccgccgtggaggccgccagaatggccttcaagggctggagcgcccaccccggcgtggtgagagcccagcacctgaccagactggccgaggtgatccagaagcaccagagactgctgtggaccctggagagcctggtgaccggcagagccgtgagagaggtgagagacggcgacgtgcagctggcccagcagctgctgcactaccacgccatccaggccagcacccaggaggaggccctggccggctgggagcccatgggcgtgatcggcctgatcctgccccccaccttcagcttcctggagatgatgtggagaatctgccccgccctggccgtgggctgcaccgtggtggccctggtgccccccgccagccccgcccccctgctgctggcccagctggccggcgagctgggccccttccccggcatcctgaacgtgctgagcggccccgccagcctggtgcccatcctggccagccagcccggcatcagaaaggtggccttctgcggcgcccccgagggcggcctgagactgctgatccaggagagcgtgtgggacgaggccatgagaagactgcaggagagaatgggcagactgagaagcggcagaggcctggacggcgccgtggacatgggcgccagaggcgccgccgcctgcgacctggtgcagagattcgtgagagaggcccagagccagggcgcccaggtgttccaggccggcgacgtgcccagcgagagacccttctacccccccaccctggtgagcaacctgccccccgccagcccctgcgcccaggtggaggtgccctggcccgtggtggtggccagccccttcagaaccgccaaggaggccctgctggtggccaacggcacccccagaggcggcagcgccagcgtgtggagcgagagactgggccaggccctggagctgggctacggcctgcaggtgggcaccgtgtggatcaacgcccacggcctgagagaccccagcgtgcccaccggcggctgcaaggagagcggctgcagctggcacggcggccccgacggcctgtacgagtacctgagacccagcggcacccccgccagactgagctgcctgagcaagaacctgaactacgacaccttcggcctggccgtgcccagcaccctgcccgccggccccgagatcggccccagccccgcccccccctacggcctgttcgtgggcggcagattccaggcccccggcgccagaagcagcagacccatcagagacagcagcggcaacctgcacggctacgtggccgagggcggcgccaaggacatcagaggcgccgtggaggccgcccaccaggccttccccggctgggccggccagagccccggcgccagagccgccctgctgtgggccctggccgccgccctggagagaagaaagagcaccctggccagcagactggagagacagggcgccgagctgaaggccgccgaggccgaggtggagctgagcgccagaagactgagagcctggggcgccagagtgcaggcccagggccacaccctgcaggtggccggcctgagaggccccgtgctgagactgagagagcccctgggcgtgctggccgtggtgtgccccgacgagtggcccctgctggccttcgtgagcctgctggcccccgccctggcctacggcaacaccgtggtgatggtgcccagcgccgcctgccccctgctggccctggaggtgtgccaggacatggccaccgtgttccccgccggcctggccaacgtggtgaccggcgacagagaccacctgaccagatgcctggccctgcaccaggacgtgcaggccatgtggtacttcggcagcgcccagggcagccagttcgtggagtgggccagcgccggcaacctgaagcccgtgtgggccagcagaggctgccccagagcctgggaccaggaggccgagggcgccggccccgagctgggcctgagagtggccagaaccaaggccctgtggctgcccatgggcgactag

SEQ ID NO: 72410 - DNA, 1920 bp, Artificial Sequence
  Description of Artificial Sequence: Synthetic coding sequence
atgagaaccggcgtgatcggcctgatcctgccccccaccttcagcttcctggagatgatgtggagaatctgccccgccctggccgtgggctgcaccgtggtggccctggtgccccccgccagccccgcccccctgctgctggcccagctggccggcgagctgggccccttccccggcatcctgaacgtgctgagcggccccgccagcctggtgcccatcctggccagccagcccggcatcagaaaggtggccttctgcggcgcccccgaggagggcagagccctgagaagaagcctggccggcgagtgcgccgagctgggcctggccctgggcaccgagagcctgctgctgctgaccgacaccgccgacgtggacagcgccgtggagggcgtggtggacgccgcctggagcgacagaggccccggcggcctgagactgctgatccaggagagcgtgtgggacgaggccatgagaagactgcaggagagaatgggcagactgagaagcggcagaggcctggacggcgccgtggacatgggcgccagaggcgccgccgcctgcgacctggtgcagagattcgtgagagaggcccagagccagggcgcccaggtgttccaggccggcgacgtgcccagcgagagacccttctacccccccaccctggtgagcaacctgccccccgccagcccctgcgcccaggtggaggtgccctggcccgtggtggtggccagccccttcagaaccgccaaggaggccctgctggtggccaacggcacccccagaggcggcagcgccagcgtgtggagcgagagactgggccaggccctggagctgggctacggcctgcaggtgggcaccgtgtggatcaacgcccacggcctgagagaccccagcgtgcccaccggcggctgcaaggagagcggctgcagctggcacggcggccccgacggcctgtacgagtacctgagacccagcggcacccccgccagactgagctgcctgagcaagaacctgaactacgacaccttcggcctggccgtgcccagcaccctgcccgccggccccgagatcggccccagccccgcccccccctacggcctgttcgtgggcggcagattccaggcccccggcgccagaagcagcagacccatcagagacagcagcggcaacctgcacggctacgtggccgagggcggcgccaaggacatcagaggcgccgtggaggccgcccaccaggccttccccggctgggccggccagagccccggcgccagagccgccctgctgtgggccctggccgccgccctggagagaagaaagagcaccctggccagcagactggagagacagggcgccgagctgaaggccgccgaggccgaggtggagctgagcgccagaagactgagagcctggggcgccagagtgcaggcccagggccacaccctgcaggtggccggcctgagaggccccgtgctgagactgagagagcccctgggcgtgctggccgtggtgtgccccgacgagtggcccctgctggccttcgtgagcctgctggcccccgccctggcctacggcaacaccgtggtgatggtgcccagcgccgcctgccccctgctggccctggaggtgtgccaggacatggccaccgtgttccccgccggcctggccaacgtggtgaccggcgacagagaccacctgaccagatgcctggccctgcaccaggacgtgcaggccatgtggtacttcggcagcgcccagggcagccagttcgtggagtgggccagcgccggcaacctgaagcccgtgtgggccagcagaggctgccccagagcctgggaccaggaggccgagggcgccggccccgagctgggcctgagagtggccagaaccaaggccctgtggctgcccatgggcgactag

SEQ ID NO: 72411 - DNA, 2382 bp, Artificial Sequence
  Description of Artificial Sequence: Synthetic coding sequence
atgctgagccaggtgtacagatgcggcttccagcccttcaaccagcacctgctgccctgggtgaagtgcaccaccgtgttcagaagccactgcatccagcccagcgtgatcagacacgtgagaagctggagcaacatccccttcatcaccgtgcccctgagcagaacccacggcaagagcttcgcccacagaagcgagctgaagcacgccaagagaatcgtggtgaagctgggcagcgccgtggtgaccagaggcgacgagtgcggcctggccctgggcagactggccagcatcgtggagcaggtgagcgtgctgcagaaccagggcagagagatgatgctggtgaccagcggcgccgtggccttcggcaagcagagactgagacacgagatcctgctgagccagagcgtgagacaggccctgcacagcggccagaaccagctgaaggagatggccatccccgtgctggaggccagagcctgcgccgccgccggccagagcggcctgatggccctgtacgaggccatgttcacccagtacagcatctgcgccgcccagatcctggtgaccaacctggacttccacgacgagcagaagagaagaaacctgaacggcaccctgcacgagctgctgagaatgaacatcgtgcccatcgtgaacaccaacgacgccgtggtgccccccgccgagcccaacagcgacctgcagggcgtgatcagcgtgaaggacaacgacagcctggccgccagactggccgtggagatgaagaccgacctgctgatcgtgctgagcgacgtggagggcctgttcgacagcccccccggcagcgacgacgccaagctgatcgacatcttctaccccggcgaccagcagagcgtgaccttcggcaccaagagcagagtgggcatgggcggcatggaggccaaggtgaaggccgccctgtgggccctgcagggcggcaccagcgtggtgatcgccaacggcacccaccccaaggtgagcggccacgtgatcaccgacatcgtggagggcaagaaggtgggcaccttcttcagcgaggtgaagcccgccggccccaccgtggagcagcagggcgagatggccagaagcggcggcagaatgctggccaccctggagcccgagcagagagccgagatcatccaccacctggccgacctgctgaccgaccagagagacgagatcctgctggccaacaagaaggacctggaggaggccgagggcagactggccgcccccctgctgaagagactgagcctgagcaccagcaagctgaacagcctggccatcggcctgagacagatcgccgccagcagccaggacagcgtgggcagagtgctgagaagaaccagaatcgccaagaacctggagctggagcaggtgaccgtgcccatcggcgtgctgctggtgatcttcgagagcagacccgactgcctgccccaggtggccgccctggccatcgccagcggcaacggcctgctgctgaagggcggcaaggaggccgcccacagcaacagaatcctgcacctgctgacccaggaggccctgagcatccacggcgtgaaggaggccgtgcagctggtgaacaccagagaggaggtggaggacctgtgcagactggacaagatgatcgacctgatcatccccagaggcagcagccagctggtgagagacatccagaaggccgccaagggcatccccgtgatgggccacagcgagggcatctgccacatgtacgtggacagcgaggccagcgtggacaaggtgaccagactggtgagagacagcaagtgcgagtaccccgccgcctgcaacgccctggagaccctgctgatccacagagacctgctgagaacccccctgttcgaccagatcatcgacatgctgagagtggagcaggtgaagatccacgccggccccaagttcgccagctacctgaccttcagccccagcgaggtgaagagcctgagaaccgagtacggcgacctggagctgtgcatcgaggtggtggacaacgtgcaggacgccatcgaccacatccacaagtacggcagcagccacaccgacgtgatcgtgaccgaggacgagaacaccgccgagttcttcctgcagcacgtggacagcgcctgcgtgttctggaacgccagcaccagattcagcgacggctacagattcggcctgggcgccgaggtgggcatcagcaccagcagaatccacgccagaggccccgtgggcctggagggcctgctgaccaccaagtggctgctgagaggcaaggaccacgtggtgagcgacttcagcgagcacggcagcctgaagtacctgcacgagaacctgcccatcccccagagaaacaccaactag

SEQ ID NO: 72412 - DNA, 2388 bp, Artificial Sequence
  Description of Artificial Sequence: Synthetic coding sequence
atgctgagccaggtgtacagatgcggcttccagcccttcaaccagcacctgctgccctgggtgaagtgcaccaccgtgttcagaagccactgcatccagcccagcgtgatcagacacgtgagaagctggagcaacatccccttcatcaccgtgcccctgagcagaacccacggcaagagcttcgcccacagaagcgagctgaagcacgccaagagaatcgtggtgaagctgggcagcgccgtggtgaccagaggcgacgagtgcggcctggccctgggcagactggccagcatcgtggagcaggtgagcgtgctgcagaaccagggcagagagatgatgctggtgaccagcggcgccgtggccttcggcaagcagagactgagacacgagatcctgctgagccagagcgtgagacaggccctgcacagcggccagaaccagctgaaggagatggccatccccgtgctggaggccagagcctgcgccgccgccggccagagcggcctgatggccctgtacgaggccatgttcacccagtacagcatctgcgccgcccagatcctggtgaccaacctggacttccacgacgagcagaagagaagaaacctgaacggcaccctgcacgagctgctgagaatgaacatcgtgcccatcgtgaacaccaacgacgccgtggtgccccccgccgagcccaacagcgacctgcagggcgtgaacgtgatcagcgtgaaggacaacgacagcctggccgccagactggccgtggagatgaagaccgacctgctgatcgtgctgagcgacgtggagggcctgttcgacagcccccccggcagcgacgacgccaagctgatcgacatcttctaccccggcgaccagcagagcgtgaccttcggcaccaagagcagagtgggcatgggcggcatggaggccaaggtgaaggccgccctgtgggccctgcagggcggcaccagcgtggtgatcgccaacggcacccaccccaaggtgagcggccacgtgatcaccgacatcgtggagggcaagaaggtgggcaccttcttcagcgaggtgaagcccgccggccccaccgtggagcagcagggcgagatggccagaagcggcggcagaatgctggccaccctggagcccgagcagagagccgagatcatccaccacctggccgacctgctgaccgaccagagagacgagatcctgctggccaacaagaaggacctggaggaggccgagggcagactggccgcccccctgctgaagagactgagcctgagcaccagcaagctgaacagcctggccatcggcctgagacagatcgccgccagcagccaggacagcgtgggcagagtgctgagaagaaccagaatcgccaagaacctggagctggagcaggtgaccgtgcccatcggcgtgctgctggtgatcttcgagagcagacccgactgcctgccccaggtggccgccctggccatcgccagcggcaacggcctgctgctgaagggcggcaaggaggccgcccacagcaacagaatcctgcacctgctgacccaggaggccctgagcatccacggcgtgaaggaggccgtgcagctggtgaacaccagagaggaggtggaggacctgtgcagactggacaagatgatcgacctgatcatccccagaggcagcagccagctggtgagagacatccagaaggccgccaagggcatccccgtgatgggccacagcgagggcatctgccacatgtacgtggacagcgaggccagcgtggacaaggtgaccagactggtgagagacagcaagtgcgagtaccccgccgcctgcaacgccctggagaccctgctgatccacagagacctgctgagaacccccctgttcgaccagatcatcgacatgctgagagtggagcaggtgaagatccacgccggccccaagttcgccagctacctgaccttcagccccagcgaggtgaagagcctgagaaccgagtacggcgacctggagctgtgcatcgaggtggtggacaacgtgcaggacgccatcgaccacatccacaagtacggcagcagccacaccgacgtgatcgtgaccgaggacgagaacaccgccgagttcttcctgcagcacgtggacagcgcctgcgtgttctggaacgccagcaccagattcagcgacggctacagattcggcctgggcgccgaggtgggcatcagcaccagcagaatccacgccagaggccccgtgggcctggagggcctgctgaccaccaagtggctgctgagaggcaaggaccacgtggtgagcgacttcagcgagcacggcagcctgaagtacctgcacgagaacctgcccatcccccagagaaacaccaactag

SEQ ID NO: 72413 - DNA, 1554 bp, Artificial Sequence
  Description of Artificial Sequence: Synthetic coding sequence
atgctgagagccgccgccagattcggccccagactgggcagaagactgctgagcgccgccgccacccaggccgtgcccgcccccaaccagcagcccgaggtgttctgcaaccagatcttcatcaacaacgagtggcacgacgccgtgagcagaaagaccttccccaccgtgaaccccagcaccggcgaggtgatctgccaggtggccgagggcgacaaggaggacgtggacaaggccgtgaaggccgccagagccgccttccagctgggcagcccctggagaagaatggacgccagccacagaggcagactgctgaacagactggccgacctgatcgagagagacagaacctacctggccgccctggagaccctggacaacggcaagccctacgtgatcagctacctggtggacctggacatggtgctgaagtgcctgagatactacgccggctgggccgacaagtaccacggcaagaccatccccatcgacggcgacttcttcagctacaccagacacgagcccgtgggcgtgtgcggccagatcatcccctggaacttccccctgctgatgcaggcctggaagctgggccccgccctggccaccggcaacgtggtggtgatgaaggtggccgagcagacccccctgaccgccctgtacgtggccaacctgatcaaggaggccggcttcccccccggcgtggtgaacatcgtgcccggcttcggccccaccgccggcgccgccatcgccagccacgaggacgtggacaaggtggccttcaccggcagcaccgagatcggcagagtgatccaggtggccgccggcagcagcaacctgaagagagtgaccctggagctgggcggcaagagccccaacatcatcatgagcgacgccgacatggactgggccgtggagcaggcccacttcgccctgttcttcaaccagggccagtgctgctgcgccggcagcagaaccttcgtgcaggaggacatctacgacgagttcgtggagagaagcgtggccagagccaagagcagagtggtgggcaaccccttcgacagcaagaccgagcagggcccccaggtggacgagacccagttcaagaagatcctgggctacatcaacaccggcaagcaggagggcgccaagctgctgtgcggcggcggcatcgccgccgacagaggctacttcatccagcccaccgtgttcggcgacgtgcaggacggcatgaccatcgccaaggaggagatcttcggccccgtgatgcagatcctgaagttcaagaccatcgaggaggtggtgggcagagccaacaacagcacctacggcctggccgccgccgtgttcaccaaggacctggacaaggccaactacctgagccaggccctgcaggccggcaccgtgtgggtgaactgctacgacgtgttcggcgcccagagccccttcggcggctacaagatgagcggcagcggcagagagctgggcgagtacggcctgcaggcctacaccgaggtgaagaccgtgaccgtgaaggtgccccagaagaacagctag

SEQ ID NO: 72414 - DNA, 1413 bp, Artificial Sequence
  Description of Artificial Sequence: Synthetic coding sequence
atgctgagagccgccgccagattcggccccagactgggcagaagactgctgagcgccgccgccacccaggccgtgcccgcccccaaccagcagcccgaggtgttctgcaaccagatcttcatcaacaacgagtggcacgacgccgtgagcagaaagaccttccccaccgtgaaccccagcaccggcgaggtgatctgccaggtggccgagggcgacaaggccctggagaccctggacaacggcaagccctacgtgatcagctacctggtggacctggacatggtgctgaagtgcctgagatactacgccggctgggccgacaagtaccacggcaagaccatccccatcgacggcgacttcttcagctacaccagacacgagcccgtgggcgtgtgcggccagatcatcccctggaacttccccctgctgatgcaggcctggaagctgggccccgccctggccaccggcaacgtggtggtgatgaaggtggccgagcagacccccctgaccgccctgtacgtggccaacctgatcaaggaggccggcttcccccccggcgtggtgaacatcgtgcccggcttcggccccaccgccggcgccgccatcgccagccacgaggacgtggacaaggtggccttcaccggcagcaccgagatcggcagagtgatccaggtggccgccggcagcagcaacctgaagagagtgaccctggagctgggcggcaagagccccaacatcatcatgagcgacgccgacatggactgggccgtggagcaggcccacttcgccctgttcttcaaccagggccagtgctgctgcgccggcagcagaaccttcgtgcaggaggacatctacgacgagttcgtggagagaagcgtggccagagccaagagcagagtggtgggcaaccccttcgacagcaagaccgagcagggcccccaggtggacgagacccagttcaagaagatcctgggctacatcaacaccggcaagcaggagggcgccaagctgctgtgcggcggcggcatcgccgccgacagaggctacttcatccagcccaccgtgttcggcgacgtgcaggacggcatgaccatcgccaaggaggagatcttcggccccgtgatgcagatcctgaagttcaagaccatcgaggaggtggtgggcagagccaacaacagcacctacggcctggccgccgccgtgttcaccaaggacctggacaaggccaactacctgagccaggccctgcaggccggcaccgtgtgggtgaactgctacgacgtgttcggcgcccagagccccttcggcggctacaagatgagcggcagcggcagagagctgggcgagtacggcctgcaggcctacaccgaggtgaagaccgtgaccgtgaaggtgccccagaagaacagctag

SEQ ID NO: 72415 - DNA, 1989 bp, Artificial Sequence
  Description of Artificial Sequence: Synthetic coding sequence
atgagaggcgccggccccagccccagacagagccccagaaccctgagacccgaccccggccccgccatgagcttcttcagaagaaaggtgaagggcaaggagcaggagaagaccagcgacgtgaagagcatcaaggccagcatcagcgtgcacagcccccagaagagcaccaagaaccacgccctgctggaggccgccggccccagccacgtggccatcaacgccatcagcgccaacatggacagcttcagcagcagcagaaccgccaccctgaagaagcagcccagccacatggaggccgcccacttcggcgacctgggcagaagctgcctggactaccagacccaggagaccaagagcagcctgagcaagaccctggagcaggtgctgcacgacaccatcgtgctgccctacttcatccagttcatggagctgagaagaatggagcacctggtgaagttctggctggaggccgagagcttccacagcaccacctggagcagaatcagagcccacagcctgaacaccgtgaagcagagcagcctggccgagcccgtgagccccagcaagaagcacgagaccaccgccagcttcctgaccgacagcctggacaagagactggaggacagcggcagcgcccagctgttcatgacccacagcgagggcatcgacctgaacaacagaaccaacagcacccagaaccacctgctgctgagccaggagtgcgacagcgcccacagcctgagactggagatggccagagccggcacccaccaggtgagcatggagacccaggagagcagcagcaccctgaccgtggccagcagaaacagccccgccagccccctgaaggagctgagcggcaagctgatgaagagcatcgagcaggacgccgtgaacaccttcaccaagtacatcagccccgacgccgccaagcccatccccatcaccgaggccatgagaaacgacatcatcgccagaatctgcggcgaggacggccaggtggaccccaactgcttcgtgctggcccagagcatcgtgttcagcgccatggagcaggagcacttcagcgagttcctgagaagccaccacttctgcaagtaccagatcgaggtgctgaccagcggcaccgtgtacctggccgacatcctgttctgcgagagcgccctgttctacttcagcgagtacatggagaaggaggacgccgtgaacatcctgcagttctggctggccgccgacaacttccagagccagctggccgccaagaagggccagtacgacggccaggaggcccagaacgacgccatgatcctgtacgacaagtacttcagcctgcaggccacccaccccctgggcttcgacgacgtggtgagactggagatcgagagcaacatctgcagagagggcggccccctgcccaactgcttcaccacccccctgagacaggcctggaccaccatggagaaggtgttcctgcccggcttcctgagcagcaacctgtactacaagtacctgaacgacctgatccacagcgtgagaggcgacgagttcctgggcggcaacgtgagcctgaccgcccccggcagcgtgggcccccccgacgagagccaccccggcagcagcgacagcagcgccagccagagcagcgtgaagaaggccagcatcaagatcctgaagaacttcgacgaggccatcatcgtggacgccgccagcctggaccccgagagcctgtaccagagaacctacgccggcaagatgaccttcggcagagtgagcgacctgggccagttcatcagagagagcgagcccgagcccgacgtgagaaagagcaagggcagcatgttcagccaggccatgaagaagtgggtgcagggcaacaccgacgaggcccaggaggagctggcctggaagatcgccaagatgatcgtgagcgacatcatgcagcaggcccagtacgaccagcccctggagaagagcaccaagctgtag

SEQ ID NO: 72416 - DNA, 1536 bp, Artificial Sequence
  Description of Artificial Sequence: Synthetic coding sequence
gaggtgcagagaaccccccaccccaccttcgagtacttcttcttcctgagcagaaagctgcccggccaggagctgcagggcctgaacggcagagaggccggcagcctgaacaccagccccctgggcagctgcagaagcagaagccccagctacagagagagactgtgccagagaagacacgagcaggaccagagaggcagagaggccagacccagaagactgcagggcagaaccagacccctgcagttcagaatccagcagctggaggccctgcagagactgatccaggagcaggagcaggagctggtgggcgccctggccgccgacctgcacaagaacgagtggaacgcctactacgaggaggtggtgtacgtgctggaggagatcgagtacatgatccagaagctgcccgagtgggccgccgacgagcccgtggagaagaccccccagacccagcaggacgagctgtacatccacagcgagcccctgggcgtggtgctggtgatcggcacctggaactaccccttcaacctgaccatccagcccatggtgggcgccatcgccgccggcaacagcgtggtgctgaagcccagcgagctgagcgagaacatggccagcctgctggccaccatcatcccccagtacctggacaaggacctgtaccccgtgatcaacggcggcgtgcccgagaccaccgagctgctgaaggagagattcgaccacatcctgtacaccggcagcaccggcgtgggcaagatcatcatgaccgccgccgccaagcacctgacccccgtgaccctggagctgggcggcaagagcccctgctacgtggacaagaactgcgacctggacgtggcctgcagaagaatcgcctggggcaagttcatgaacagcggccagacctgcgtggcccccgactacatcctgtgcgaccccagcatccagaaccagatcgtggagaagctgaagaagagcctgaaggagttctacggcgaggacgccaagaagagcagagactacggcagaatcatcagcgccagacacttccagagagtgatgggcctgatcgagggccagaaggtggcctacggcggcaccggcgacgccgccaccagatacatcgcccccaccatcctgaccgacgtggacccccagagccccgtgatgcaggaggagatcttcggccccgtgctgcccatcgtgtgcgtgagaagcctggaggaggccatccagttcatcaaccagagagagaagcccctggccctgtacatgttcagcagcaacgacaaggtgatcaagaagatgatcgccgagaccagcagcggcggcgtggccgccaacgacgtgatcgtgcacatcaccctgcacagcctgcccttcggcggcgtgggcaacagcggcatgggcagctaccacggcaagaagagcttcgagaccttcagccacagaagaagctgcctggtgagacccctgatgaacgacgagggcctgaaggtgagatacccccccagccccgccaagatgacccagcactag

SEQ ID NO: 72417 - DNA, 1170 bp, Artificial Sequence
  Description of Artificial Sequence: Synthetic coding sequence
atgagcaagatcagcgaggccgtgaagagagccagagccgccttcagcagcggcagaaccagacccctgcagttcagaatccagcagctggaggccctgcagagactgatccaggagcaggagcaggagctggtgggcgccctggccgccgacctgcacaagaacgagtggaacgcctactacgaggaggtggtgtacgtgctggaggagatcgagtacatgatccagaagctgcccgagtgggccgccgacgagcccgtggagaagaccccccagacccagcaggacgagctgtacatccacagcgagcccctgggcgtggtgctggtgatcggcacctggaactaccccttcaacctgaccatccagcccatggtgggcgccatcgccgccggcaacagcgtggtgctgaagcccagcgagctgagcgagaacatggccagcctgctggccaccatcatcccccagtacctggacaaggacctgtaccccgtgatcaacggcggcgtgcccgagaccaccgagctgctgaaggagagattcgaccacatcctgtacaccggcagcaccggcgtgggcaagatcatcatgaccgccgccgccaagcacctgacccccgtgaccctggagctgggcggcaagagcccctgctacgtggacaagaactgcgacctggacgtggcctgcagaagaatcgcctggggcaagttcatgaacagcggccagacctgcgtggcccccgactacatcctgtgcgaccccagcatccagaaccagatcgtggagaagctgaagaagagcctgaaggagatcttcggccccgtgctgcccatcgtgtgcgtgagaagcctggaggaggccatccagttcatcaaccagagagagaagcccctggccctgtacatgttcagcagcaacgacaaggtgatcaagaagatgatcgccgagaccagcagcggcggcgtggccgccaacgacgtgatcgtgcacatcaccctgcacagcctgcccttcggcggcgtgggcaacagcggcatgggcagctaccacggcaagaagagcttcgagaccttcagccacagaagaagctgcctggtgagacccctgatgaacgacgagggcctgaaggtgagatacccccccagccccgccaagatgacccagcactag

SEQ ID NO: 72418 - DNA, 693 bp, Artificial Sequence
  Description of Artificial Sequence: Synthetic coding sequence
atgagcaagatcagcgaggccgtgaagagagccagagccgccttcagcagcggcagaaccagacccctgcagttcagaatccagcagctggaggccctgcagagactgatccaggagcaggagcaggagctggtgggcgccctggccgccgacctgcacaagaacgagtggaacgcctactacgaggaggtggtgtacgtgctggaggagatcgagtacatgatccagaagctgcccgagtgggccgccgacgagcccgtggagaagaccccccagacccagcaggacgagctgtacatccacagcgagcccctgggcgtggtgctggtgatcggcacctggaactaccccttcaacctgaccatccagcccatggtgggcgccatcgccgccggcaacagcgtggtgctgaagcccagcgagctgagcgagaacatggccagcctgctggccaccatcatcccccagtacctggacaaggacctgtaccccgtgatcaacggcggcgtgcccgagaccaccgagctgctgaaggagagattcgaccacatcctgtacaccggcagcaccggcgtgggcaagatcatcatgaccgccgccgccaagcacctgacccccgtgaccctggagctgggcggcaagagcccctgctacgtggacaagaactgcgacctggacgtggcctgcagatag

SEQ ID NO: 72419 - DNA, 1119 bp, Artificial Sequence
  Description of Artificial Sequence: Synthetic coding sequence
atgagcaagatcagcgaggccgtgaagagagccagagccgccttcagcagcggcagaaccagacccctgcagttcagaatccagcagctggaggccctgcagagactgatccaggagcaggagcaggagctggtgggcgccctggccgccgacctgcacaagaacgagtggaacgcctactacgaggaggtggtgtacgtgctggaggagatcgagtacatgatccagaagctgcccgagtgggccgccgacgagcccgtggagaagaccccccagacccagcaggacgagctgtacatccacagcgagcccctgggcgtggtgctggtgatcggcacctggaactaccccttcaacctgaccatccagcccatggtgggcgccatcgccgccggcaacagcgtggtgctgaagcccagcgagctgagcgagaacatggccagcctgctggccaccatcatcccccagtacctggacaaggacctgtaccccgtgatcaacggcggcgtgcccgagaccaccgagctgctgaaggagagattcgaccacatcctgtacaccggcagcaccggcgtgggcaagatcatcatgaccgccgccgccaagcacctgacccccgtgaccctggagctgggcggcaagagcccctgctacgtggacaagaactgcgacctggacgtggcctgcagaagaatcgcctggggcaagttcatgaacagcggccagacctgcgtggcccccgactacatcctgtgcgaccccagcatccagaaccagatcgtggagaagctgaagaagagcctgaaggagttctacggcgaggacgccaagaagagcagagactacggcagaatcatcagcgccagacacttccagagagtgatgggcctgatcgagggccagaaggtggcctacggcggcaccggcgacgccgccaccagatacatcgcccccaccatcctgaccgacgtggacccccagagccccgtgatgcaggaggagatcttcggccccgtgctgcccatcgtgtgcgtgagaagcctggaggaggccatccagttcatcaaccagagagagaagcccctggccctgtacatgttcagcagcaacgacaagtag

SEQ ID NO: 72420 - DNA, 1362 bp, Artificial Sequence
  Description of Artificial Sequence: Synthetic coding sequence
atgagcaagatcagcgaggccgtgaagagagccagagccgccttcagcagcggcagaaccagacccctgcagttcagaatccagcagctggaggccctgcagagactgatccaggagcaggagcaggagctggtgggcgccctggccgccgacctgcacaagaacgagtggaacgcctactacgaggaggtggtgtacgtgctggaggagatcgagtacatgatccagaagctgcccgagtgggccgccgacgagcccgtggagaagaccccccagacccagcaggacgagctgtacatccacagcgagcccctgggcgtggtgctggtgatcggcacctggaactaccccttcaacctgaccatccagcccatggtgggcgccatcgccgccggcaacagcgtggtgctgaagcccagcgagctgagcgagaacatggccagcctgctggccaccatcatcccccagtacctggacaaggacctgtaccccgtgatcaacggcggcgtgcccgagaccaccgagctgctgaaggagagattcgaccacatcctgtacaccggcagcaccggcgtgggcaagatcatcatgaccgccgccgccaagcacctgacccccgtgaccctggagctgggcggcaagagcccctgctacgtggacaagaactgcgacctggacgtggcctgcagaagaatcgcctggggcaagttcatgaacagcggccagacctgcgtggcccccgactacatcctgtgcgaccccagcatccagaaccagatcgtggagaagctgaagaagagcctgaaggagttctacggcgaggacgccaagaagagcagagactacggcagaatcatcagcgccagacacttccagagagtgatgggcctgatcgagggccagaaggtggcctacggcggcaccggcgacgccgccaccagatacatcgcccccaccatcctgaccgacgtggacccccagagccccgtgatgcaggaggagatcttcggccccgtgctgcccatcgtgtgcgtgagaagcctggaggaggccatccagttcatcaaccagagagagaagcccctggccctgtacatgttcagcagcaacgacaaggtgatcaagaagatgatcgccgagaccagcagcggcggcgtggccgccaacgacgtgatcgtgcacatcaccctgcacagcctgcccttcggcggcgtgggcaacagcggcatgggcagctaccacggcaagaagagcttcgagaccttcagccacagaagaagctgcctggtgagacccctgatgaacgacgagggcctgaaggtgagatacccccccagccccgccaagatgacccagcactag

SEQ ID NO: 72421 - DNA, 1362 bp, Artificial Sequence; identical to SEQ ID NO: 72420
  Description of Artificial Sequence: Synthetic coding sequence

SEQ ID NO: 72422 - DNA, 1203 bp, Artificial Sequence
  Description of Artificial Sequence: Synthetic coding sequence
atgatccagaagctgcccgagtgggccgccgacgagcccgtggagaagaccccccagacccagcaggacgagctgtacatccacagcgagcccctgggcgtggtgctggtgatcggcacctggaactaccccttcaacctgaccatccagcccatggtgggcgccatcgccgccggcaacagcgtggtgctgaagcccagcgagctgagcgagaacatggccagcctgctggccaccatcatcccccagtacctggacaaggacctgtaccccgtgatcaacggcggcgtgcccgagaccaccgagctgctgaaggagagattcgaccacatcctgtacaccggcagcaccggcgtgggcaagatcatcatgaccgccgccgccaagcacctgacccccgtgaccctggagctgggcggcaagagcccctgctacgtggacaagaactgcgacctggacgtggcctgcagaagaatcgcctggggcaagttcatgaacagcggccagacctgcgtggcccccgactacatcctgtgcgaccccagcatccagaaccagatcgtggagaagctgaagaagagcctgaaggagttctacggcgaggacgccaagaagagcagagactacggcagaatcatcagcgccagacacttccagagagtgatgggcctgatcgagggccagaaggtggcctacggcggcaccggcgacgccgccaccagatacatcgcccccaccatcctgaccgacgtggacccccagagccccgtgatgcaggaggagatcttcggccccgtgctgcccatcgtgtgcgtgagaagcctggaggaggccatccagttcatcaaccagagagagaagcccctggccctgtacatgttcagcagcaacgacaaggtgatcaagaagatgatcgccgagaccagcagcggcggcgtggccgccaacgacgtgatcgtgcacatcaccctgcacagcctgcccttcggcggcgtgggcaacagcggcatgggcagctaccacggcaagaagagcttcgagaccttcagccacagaagaagctgcctggtgagacccctgatgaacgacgagggcctgaaggtgagatacccccccagccccgccaagatgacccagcactggctgagctggccctgggagaacagaagctgcagccccagccccgcccccctgctgtgctag

SEQ ID NO: 72423 - DNA, 1458 bp, Artificial Sequence
  Description of Artificial Sequence: Synthetic coding sequence
atggagctggaggtgagaagagtgagacaggccttcctgagcggcagaagcagacccctgagattcagactgcagcagctggaggccctgagaagaatggtgcaggagagagagaaggacatcctgaccgccatcgccgccgacctgtgcaagagcgagttcaacgtgtacagccaggaggtgatcaccgtgctgggcgagatcgacttcatgctggagaacctgcccgagtgggtgaccgccaagcccgtgaagaagaacgtgctgaccatgctggacgaggcctacatccagccccagcccctgggcgtggtgctgatcatcggcgcctggaactaccccttcgtgctgaccatccagcccctgatcggcgccatcgccgccggcaacgccgtgatcatcaagcccagcgagctgagcgagaacaccgccaagatcctggccaagctgctgccccagtacctggaccaggacctgtacatcgtgatcaacggcggcgtggaggagaccaccgagctgctgaagcagagattcgaccacatcttctacaccggcaacaccgccgtgggcaagatcgtgatggaggccgccgccaagcacctgacccccgtgaccctggagctgggcggcaagagcccctgctacatcgacaaggactgcgacctggacatcgtgtgcagaagaatcacctggggcaagtacatgaactgcggccagacctgcatcgcccccgactacatcctgtgcgaggccagcctgcagaaccagatcgtgtggaagatcaaggagaccgtgaaggagttctacggcgagaacatcaaggagagccccgactacgagagaatcatcaacctgagacacttcaagagaatcctgagcctgctggagggccagaagatcgccttcggcggcgagaccgacgaggccaccagatacatcgcccccaccgtgctgaccgacgtggaccccaagaccaaggtgatgcaggaggagatcttcggccccatcctgcccatcgtgcccgtgaagaacgtggacgaggccatcaacttcatcaacgagagagagaagcccctggccctgtacgtgttcagccacaaccacaagctgatcaagagaatgatcgacgagaccagcagcggcggcgtgaccggcaacgacgtgatcatgcacttcaccctgaacagcttccccttcggcggcgtgggcagcagcggcatgggcgcctaccacggcaagcacagcttcgacaccttcagccaccagagaccctgcctgctgaagagcctgaagagagagggcgccaacaagctgagatacccccccaacagccagagcaaggtggactggggcaagttcttcctgctgaagagattcaacaaggagaagctgggcctgctgctgctgaccttcctgggcatcgtggccgccgtgctggtgaaggccgagtactactag

SEQ ID NO: 72424 - DNA, 1527 bp, Artificial Sequence
  Description of Artificial Sequence: Synthetic coding sequence
atggagctggaggtgagaagagtgagacaggccttcctgagcggcagaagcagacccctgagattcagactgcagcagctggaggccctgagaagaatggtgcaggagagagagaaggacatcctgaccgccatcgccgccgacctgtgcaagagcgagttcaacgtgtacagccaggaggtgatcaccgtgctgggcgagatcgacttcatgctggagaacctgcccgagtgggtgaccgccaagcccgtgaagaagaacgtgctgaccatgctggacgaggcctacatccagccccagcccctgggcgtggtgctgatcatcggcgcctggaactaccccttcgtgctgaccatccagcccctgatcggcgccatcgccgccggcaacgccgtgatcatcaagcccagcgagctgagcgagaacaccgccaagatcctggccaagctgctgccccagtacctggaccaggacctgtacatcgtgatcaacggcggcgtggaggagaccaccgagctgctgaagcagagattcgaccacatcttctacaccggcaacaccgccgtgggcaagatcgtgatggaggccgccgccaagcacctgacccccgtgaccctggagctgggcggcaagagcccctgctacatcgacaaggactgcgacctggacatcgtgtgcagaagaatcacctggggcaagtacatgaactgcggccagacctgcatcgcccccgactacatcctgtgcgaggccagcctgcagaaccagatcgtgtggaagatcaaggagaccgtgaaggagttctacggcgagaacatcaaggagagccccgactacgagagaatcatcaacctgagacacttcaagagaatcctgagcctgctggagggccagaagatcgccttcggcggcgagaccgacgaggccaccagatacatcgcccccaccgtgctgaccgacgtggaccccaagaccaaggtgatgcaggaggagatcttcggccccatcctgcccatcgtgcccgtgaagaacgtggacgaggccatcaacttcatcaacgagagagagaagcccctggccctgtacgtgttcagccacaaccacaagctgatcaagagaatgatcgacgagaccagcagcggcggcgtgaccggcaacgacgtgatcatgcacttcaccctgaacagcttccccttcggcggcgtgggcagcagcggcatgggcgcctaccacggcaagcacagcttcgacaccttcagccaccagagaccctgcctgctgaagagcctgaagagagagggcgccaacaagctgagatacccccccaacagccagagcaaggtggactggggcaagttcttcctgctgaagagattcaacaaggagaagctgggcctgctgctgctgaccttcctgggcatcgtggccgccgtgctggtgaagaagtaccaggccgtgctgagaagaaaggccctgctgatcttcctggtggtgcacagactgagatggagcagcaagcagagatag

SEQ ID NO: 72425 - DNA, 1458 bp, Artificial Sequence; identical to SEQ ID NO: 72423
  Description of Artificial Sequence: Synthetic coding sequence

SEQ ID NO: 72426 - DNA, 501 bp, Artificial Sequence
  Description of Artificial Sequence: Synthetic coding sequence
atggagctggaggtgagaagagtgagacaggccttcctgagcggcagaagcagacccctgagattcagactgcagcagctggaggccctgagaagaatggtgcaggagagagagaaggacatcctgaccgccatcgccgccgacctgtgcaagagcgagttcaacgtgtacagccaggaggtgatcaccgtgctgggcgagatcgacttcatgctggagaacctgcccgagtgggtgaccgccaagcccgtgaagaagaacgtgctgaccatgctggacgaggcctacatccagccccagcccctgggcgtggtgctgatcatcggcgcctggaactaccccttcgtgctgaccatccagcccctgatcggcgccatcgccgccggcaacgccgtgatcatcaagcccagcgagctgagcgagaacaccgccaagatcctggccaagctgctgccccagtacctggaccaggacctgtacatcgtgatcaacggcggctag

SEQ ID NO: 72427 - DNA, 1158 bp, Artificial Sequence
  Description of Artificial Sequence: Synthetic coding sequence
atgaaggacgagcccagaagcaccaacctgttcatgaagctggacagcgtgttcatctggaaggagcccttcggcctggtgctgatcatcgccccctggaactaccccctgaacctgaccctggtgctgctggtgggcgccctggccgccggcagctgcgtggtgctgaagcccagcgagatcagccagggcaccgagaaggtgctggccgaggtgctgccccagtacctggaccagagctgcttcgccgtggtgctgggcggcccccaggagaccggccagctgctggagcacaagctggactacatcttcttcaccggcagccccagagtgggcaagatcgtgatgaccgccgccaccaagcacctgacccccgtgaccctggagctgggcggcaagaacccctgctacgtggacgacaactgcgacccccagaccgtggccaacagagtggcctggttctgctacttcaacgccggccagacctgcgtggcccccgactacgtgctgtgcagccccgagatgcaggagagactgctgcccgccctgcagagcaccatcaccagattctacggcgacgacccccagagcagccccaacctgggccacatcatcaaccagaagcagttccagagactgagagccctgctgggctgcagcagagtggccatcggcggccagagcaacgagagcgacagatacatcgcccccaccgtgctggtggacgtgcaggagaccgagcccgtgatgcaggaggagatcttcggccccatcctgcccatcgtgaacgtgcagagcgtggacgaggccatcaagttcatcaacagacaggagaagcccctggccctgtacgccttcagcaacagcagccaggtggtgaaccagatgctggagagaaccagcagcggcagcttcggcggcaacgagggcttcacctacatcagcctgctgagcgtgcccttcggcggcgtgggccacagcggcatgggcagataccacggcaagttcaccttcgacaccttcagccaccacagaacctgcctgctggcccccagcggcctggagaagctgaaggagatccactaccccccctacaccgactggaaccagcagctgctgagatggggcatgggcagccagagctgcaccctgctgtag

SEQ ID NO: 72428 - DNA, 447 bp, Artificial Sequence
  Description of Artificial Sequence: Synthetic coding sequence
atgaaggacgagcccagaagcaccaacctgttcatgaagctggacagcgtgttcatctggaaggagcccttcggcctggtgctgatcatcgccccctggaactaccccctgaacctgaccctggtgctgctggtgggcgccctggccgccggcagctgcgtggtgctgaagcccagcgagatcagccagggcaccgagaaggtgctggccgaggtgctgccccagtacctggaccagagctgcttcgccgtggtgctgggcggcccccaggagaccggccagctgctggagcacaagctggactacatcttcttcaccggcagccccagagtgggcaagatcgtgatgaccgccgccaccaagcacctgacccccgtgaccctggagctgggcggcaagaacccctgctacgtggacgacaactgcgacccccagaccgtggcctag

SEQ ID NO: 72429 - DNA, 288 bp, Artificial Sequence
  Description of Artificial Sequence: Synthetic coding sequence
atgaaggacgagcccagaagcaccaacctgttcatgaagctggacagcgtgttcatctggaaggagcccttcggcctggtgctgatcatcgccccctggaactaccccctgaacctgaccctggtgctgctggtgggcgccctggccgccggcagctgcgtggtgctgaagcccagcgagatcagccagggcaccgagaaggtgctggccgaggtgctgccccagtacctggaccagagctgcttcgccgtggtgctgggcggcccccaggagaccggccagctgtag

SEQ ID NO: 72430 - DNA, 1158 bp, Artificial Sequence; identical to SEQ ID NO: 72427
  Description of Artificial Sequence: Synthetic coding sequence

SEQ ID NO: 72431 - DNA, 1692 bp, Artificial Sequence
  Description of Artificial Sequence: Synthetic coding sequence
atgctgctgcccgcccccgccctgagaagagccctgctgagcagaccctggaccggcgccggcctgagatggaagcacaccagcagcctgaaggtggccaacgagcccgtgctggccttcacccagggcagccccgagagagacgccctgcagaaggccctgaaggacctgaagggcagaatggaggccatcccctgcgtggtgggcgacgaggaggtgtggaccagcgacgtgcagtaccaggtgagccccttcaaccacggccacaaggtggccaagttctgctacgccgacaagagcctgctgaacaaggccatcgaggccgccctggccgccagaaaggagtgggacctgaagcccatcgccgacagagcccagatcttcctgaaggccgccgacatgctgagcggccccagaagagccgagatcctggccaagaccatggtgggccagggcaagaccgtgatccaggccgagatcgacgccgccgccgagctgatcgacttcttcagattcaacgccaagtacgccgtggagctggagggccagcagcccatcagcgtgccccccagcaccaacagcaccgtgtacagaggcctggagggcttcgtggccgccatcagccccttcaacttcaccgccatcggcggcaacctggccggcgcccccgccctgatgggcaacgtggtgctgtggaagcccagcgacaccgccatgctggccagctacgccgtgtacagaatcctgagagaggccggcctgccccccaacatcatccagttcgtgcccgccgacggccccctgttcggcgacaccgtgaccagcagcgagcacctgtgcggcatcaacttcaccggcagcgtgcccaccttcaagcacctgtggaagcaggtggcccagaacctggacagattccacaccttccccagactggccggcgagtgcggcggcaagaacttccacttcgtgcacagaagcgccgacgtggagagcgtggtgagcggcaccctgagaagcgccttcgagtacggcggccagaagtgcagcgcctgcagcagactgtacgtgccccacagcctgtggccccagatcaagggcagactgctggaggagcacagcagaatcaaggtgggcgaccccgccgaggacttcggcaccttcttcagcgccgtgatcgacgccaagagcttcgccagaatcaagaagtggctggagcacgccagaagcagccccagcctgaccatcctggccggcggcaagtgcgacgacagcgtgggctacttcgtggagccctgcatcgtggagagcaaggacccccaggagcccatcatgaaggaggagatcttcggccccgtgctgagcgtgtacgtgtaccccgacgacaagtacaaggagaccctgcagctggtggacagcaccaccagctacggcctgaccggcgccgtgttcagccaggacaaggacgtggtgcaggaggccaccaaggtgctgagaaacgccgccggcaacttctacatcaacgacaagagcaccggcagcatcgtgggccagcagcccttcggcggcgccagagccagcggcaccaacgacaagcccggcggcccccactacatcctgagatggaccagcccccaggtgatcaaggagacccacaagcccctgggcgactggagctacgcctacatgcagtag

SEQ ID NO: 72432 - DNA, 588 bp, Artificial Sequence
  Description of Artificial Sequence: Synthetic coding sequence
atggaggccatcccctgcgtggtgggcgacgaggaggtgtggaccagcgacgtgcagtaccaggtgagccccttcaaccacggccacaaggtggccaagttctgctacgccgacaagagcctgctgaacaaggccatcgaggccgccctggccgccagaaaggagtgggacctgaagcccatcgccgacagagcccagatcttcctgaaggccgccgacatgctgagcggccccagaagagccgagatcctggccaagaccatggtgggccagggcaagaccgtgatccaggccgagatcgacgccgccgccgagctgatcgacttcttcagattcaacgccaagtacgccgtggagctggagggccagcagcccatcagcgtgccccccagcaccaacagcaccgtgtacagaggcctggagggcttcgtggccgccatcagccccttcaacttcaccgccatcggcggcaacctggccggcgcccccgccctgatgctgagagagggcgtggtgaccctgcccctgtgccagatgaccaagctgagacacaccgccgtgacctacctggccagactgagcgactag

SEQ ID NO: 72433 - DNA, 633 bp, Artificial Sequence
  Description of Artificial Sequence: Synthetic coding sequence
atgctgctgcccgcccccgccctgagaagagccctgctgagcagaccctggaccggcgccggcctgagatggaagcacaccagcagcctgaaggtggccaacgagcccgtgctggccttcacccagggcagccccgagagagacgccctgcagaaggccctgaaggacctgaagggcagaatggaggccatcccctgcgtggtgggcgacgaggaggtgtggaccagcgacgtgcagtaccaggtgagcagcctgctgaacaaggccatcgaggccgccctggccgccagaaaggagtgggacctgaagcccatcgccgacagagcccagatcttcctgaaggccgccgacatgctgagcggccccagaagagccgagatcctggccaagaccatggtgggccagggcaagaccgtgatccaggccgagatcgacgccgccgccgagctgatcgacttcttcagattcaacgccaagtacgccgtggagctggagggccagcagcccatcagcgtgccccccagcaccaacagcaccgtgtacagaggcctggagggcttcgtggccgccatcagccccttcaacttcaccgccatcggcggcaacctggccggcgcccccgccctgatgtag

SEQ ID NO: 72434 - DNA, 1692 bp, Artificial Sequence; identical to SEQ ID NO: 72431
  Description of Artificial Sequence: Synthetic coding sequence

SEQ ID NO: 72435 - DNA, 645 bp, Artificial Sequence
  Description of Artificial Sequence: Synthetic coding sequence
atgctgctgcccgcccccgccctgagaagagccctgctgagcagaccctggaccggcgccggcctgagatggaagcacaccagcagcctgaaggtggccaacgagcccgtgctggccttcacccagggcagccccgagagagacgccctgcagaaggccctgaaggacctgaagggcagaatggaggccatcccctgcgtggtgggcgacgaggaggtgtggaccagcgacgtgcagtaccaggtgagcagcctgctgaacaaggccatcgaggccgccctggccgccagaaaggagtgggacctgaagcccatcgccgacagagcccagatcttcctgaaggccgccgacatgctgagcggccccagaagagccgagatcctggccaagaccatggtgggccagggcaagaccgtgatccaggccgagatcgacgccgccgccgagctgatcgacttcttcagattcaacgccaagtacgccgtggagctggagggccagcagcccatcagcgtgccccccagcaccaacagcaccgtgtacagaggcctggagggcttcgtggccgccatcagccccttcaacttcaccgccatcggcggcaacctggccggcgcccccgccctgatggtgagatgcggctag

SEQ ID NO: 72436 - DNA, 462 bp, Artificial Sequence
  Description of Artificial Sequence: Synthetic coding sequence
aacaaggccatcgaggccgccctggccgccagaaaggagtgggacctgaagcccatcgccgacagagcccagatcttcctgaaggccgccgacatgctgagcggccccagaagagccgagatcctggccaagaccatggtgggccagggcaagaccgtgatccaggccgagatcgacgccgccgccgagctgatcgacttcttcagattcaacgccaagtacgccgtggagctggagggccagcagcccatcagcgtgccccccagcaccaacagcaccgtgtacagaggcctggagggcttcgtggccgccatcagccccttcaacttcaccgccatcggcggcaacctggccggcgcccccgccctgatgctgagagagggcgtggtgaccctgcccctgtgccagatgaccaagctgagacacaccgccgtgacctacctggccagactgagcgactag

SEQ ID NO: 72437 - DNA, 1512 bp, Artificial Sequence
  Description of Artificial Sequence: Synthetic coding sequence
atggaggccatcccctgcgtggtgggcgacgaggaggtgtggaccagcgacgtgcagtaccaggtgagccccttcaaccacggccacaaggtggccaagttctgctacgccgacaagagcctgctgaacaaggccatcgaggccgccctggccgccagaaaggagtgggacctgaagcccatcgccgacagagcccagatcttcctgaaggccgccgacatgctgagcggccccagaagagccgagatcctggccaagaccatggtgggccagggcaagaccgtgatccaggccgagatcgacgccgccgccgagctgatcgacttcttcagattcaacgccaagtacgccgtggagctggagggccagcagcccatcagcgtgccccccagcaccaacagcaccgtgtacagaggcctggagggcttcgtggccgccatcagccccttcaacttcaccgccatcggcggcaacctggccggcgcccccgccctgatgggcaacgtggtgctgtggaagcccagcgacaccgccatgctggccagctacgccgtgtacagaatcctgagagaggccggcctgccccccaacatcatccagttcgtgcccgccgacggccccctgttcggcgacaccgtgaccagcagcgagcacctgtgcggcatcaacttcaccggcagcgtgcccaccttcaagcacctgtggaagcaggtggcccagaacctggacagattccacaccttccccagactggccggcgagtgcggcggcaagaacttccacttcgtgcacagaagcgccgacgtggagagcgtggtgagcggcaccctgagaagcgccttcgagtacggcggccagaagtgcagcgcctgcagcagactgtacgtgccccacagcctgtggccccagatcaagggcagactgctggaggagcacagcagaatcaaggtgggcgaccccgccgaggacttcggcaccttcttcagcgccgtgatcgacgccaagagcttcgccagaatcaagaagtggctggagcacgccagaagcagccccagcctgaccatcctggccggcggcaagtgcgacgacagcgtgggctacttcgtggagccctgcatcgtggagagcaaggacccccaggagcccatcatgaaggaggagatcttcggccccgtgctgagcgtgtacgtgtaccccgacgacaagtacaaggagaccctgcagctggtggacagcaccaccagctacggcctgaccggcgccgtgttcagccaggacaaggacgtggtgcaggaggccaccaaggtgctgagaaacgccgccggcaacttctacatcaacgacaagagcaccggcagcatcgtgggccagcagcccttcggcggcgccagagccagcggcaccaacgacaagcccggcggcccccactacatcctgagatggaccagcccccaggtgatcaaggagacccacaagcccctgggcgactggagctacgcctacatgcagtag

SEQ ID NO: 72438 - DNA, 1539 bp, Artificial Sequence
  Description of Artificial Sequence: Synthetic coding sequence
atgctgctgcccgcccccgccctgagaagagccctgctgagcagaccctggaccggcgccggcctgagatggaagcacaccagcagcctgaaggtggccaacgagcccgtgctggccttcacccagggcagccccgagagagacgccctgcagaaggccctgaaggacctgaagggcagaatggaggccatcccctgcgtggtgggcgacgaggaggtgtggaccagcgacgtgcagtaccaggtgagccccttcaaccacggccacaaggtggccaagttctgctacgccgacaagagcctgctgaacaaggccatcgaggccgccctggccgccagaaaggagtgggacctgaagcccatcgccgacagagcccagatcttcctgaaggccgccgacatgctgagcggccccagaagagccgagatcctggccaagaccatggtgggccagggcaagaccgtgatccaggccgagatcgacgccgccgccgagctgatcgacttcttcagattcaacgccaagtacgccgtggagctggagggccagcagcccatcagcgtgccccccagcaccaacagcaccgtgtacagaggcctggagggcttcgtggccgccatcagccccttcaacttcaccgccatcggcggcaacctggccggcgcccccgccctgatgggcaacgtggtgctgtggaagcccagcgacaccgccatgctggccagctacgccgtgtacagaatcctgagagaggccggcctgccccccaacatcatccagttcgtgcccgccgacggccccctgttcggcgacaccgtgaccagcagcgagcacctgtgcggcatcaacttcaccggcagcgtgcccaccttcaagcacctgtggaagcaggtggcccagaacctggacagattccacaccttccccagactggccggcgagtgcggcggcaagaacttccacttcgtgcacagaagcgccgacgtggagagcgtggtgagcggcaccctgagaagcgccttcgagtacggcggccagaagtgcagcgcctgcagcagactgtacgtgccccacagcctgtggccccagatcaagggcagactgctggaggagcacagcagaatcaaggtgggcgaccccgccgaggacttcggcaccttcttcagcgccgtgatcgacgccaaggagatcttcggccccgtgctgagcgtgtacgtgtaccccgacgacaagtacaaggagaccctgcagctggtggacagcaccaccagctacggcctgaccggcgccgtgttcagccaggacaaggacgtggtgcaggaggccaccaaggtgctgagaaacgccgccggcaacttctacatcaacgacaagagcaccggcagcatcgtgggccagcagcccttcggcggcgccagagccagcggcaccaacgacaagcccggcggcccccactacatcctgagatggaccagcccccaggtgatcaaggagacccacaagcccctgggcgactggagctacgcctacatgcagtag

SEQ ID NO: 72439 - DNA, 1647 bp, Artificial Sequence
  Description of Artificial Sequence: Synthetic coding sequence
atggccacctgcatctggctgagaagctgcggcgccagaagactgggcagcaccttccccggctgcagactgagacccagagccggcggcctggtgcccgccagcggccccgcccccggccccgcccagctgagatgctacgccggcagactggccggcctgagcgccgccctgctgagaaccgacagcttcgtgggcggcagatggctgcccgccgccgccaccttccccgtgcaggaccccgccagcggcgccgccctgggcatggtggccgactgcggcgtgagagaggccagagccgccgtgagagccgcctacgaggccttctgcagatggagagaggtgagcgccaaggagagaagcagcctgctgagaaagtggtacaacctgatgatccagaacaaggacgacctggccagaatcatcaccgccgagagcggcaagcccctgaaggaggcccacggcgagatcctgtacagcgccttcttcctggagtggttcagcgaggaggccagaagagtgtacggcgacatcatccacacccccgccaaggacagaagagccctggtgctgaagcagcccatcggcgtggccgccgtgatcaccccctggaacttccccagcgccatgatcaccagaaaggtgggcgccgccctggccgccggctgcaccgtggtggtgaagcccgccgaggacacccccttcagcgccctggccctggccgaggtgaaccagggcttcctgctggacctggaccccctgctgctggccagccaggccggcatccccagcggcgtgtacaacgtgatcccctgcagcagaaagaacgccaaggaggtgggcgaggccatctgcaccgaccccctggtgagcaagatcagcttcaccggcagcaccaccaccggcaagatcctgctgcaccacgccgccaacagcgtgaagagagtgagcatggagctgggcggcctggcccccttcatcgtgttcgacagcgccaacgtggaccaggccgtggccggcgccatggccagcaagttcagaaacaccggccagacctgcgtgtgcagcaaccagttcctggtgcagagaggcatccacgacgccttcgtgaaggccttcgccgaggccatgaagaagaacctgagagtgggcaacggcttcgaggagggcaccacccagggccccctgatcaacgagaaggccgtggagaaggtggagaagcaggtgaacgacgccgtgagcaagggcgccaccgtggtgaccggcggcaagagacaccagctgggcaagaacttcttcgagcccaccctgctgtgcaacgtgacccaggacatgctgtgcacccacgaggagaccttcggccccctggcccccgtgatcaagttcgacaccgaggaggaggccatcgccatcgccaacgccgccgacgtgggcctggccggctacttctacagccaggaccccgcccagatctggagagtggccgagcagctggaggtgggcatggtgggcgtgaacgagggcctgatcagcagcgtggagtgccccttcggcggcgtgaagcagagcggcctgggcagagagggcagcaagtacggcatcgacgagtacctggagctgaagtacgtgtgctacggcggcctgtag

SEQ ID NO: 72440 - DNA, 1608 bp, Artificial Sequence
  Description of Artificial Sequence: Synthetic coding sequence
atggccacctgcatctggctgagaagctgcggcgccagaagactgggcagcaccttccccggctgcagactgagacccagagccggcggcctggtgcccgccagcggccccgcccccggccccgcccagctgagatgctacgccggcagactggccggcctgagcgccgccctgctgagaaccgacagcttcgtgggcggcagatggctgcccgccgccgccaccttccccgtgcaggaccccgccagcggcgccgccctgggcatggtggccgactgcggcgtgagagaggccagagccgccgtgagagccgcctacgaggccttctgcagatggagagaggtgagcgccaaggagagaagcagcctgctgagaaagtggtacaacctgatgatccagaacaaggacgacctggccagaatcatcaccgccgagagcggcaagcccctgaaggaggcccacggcgagatcctgtacagcgccttcttcctggagtggttcagcgaggaggccagaagagtgtacggcgacatcatccacacccccgccaaggacagaagagccctggtgctgaagcagcccatcggcgtggccgccgtgatcaccccctggaacttccccagcgccatgatcaccagaaaggtgggcgccgccctggccgccggctgcaccgtggtggtgaagcccgccgaggacacccccttcagcgccctggccctggccgagctggccagccaggccggcatccccagcggcgtgtacaacgtgatcccctgcagcagaaagaacgccaaggaggtgggcgaggccatctgcaccgaccccctggtgagcaagatcagcttcaccggcagcaccaccaccggcaagatcctgctgcaccacgccgccaacagcgtgaagagagtgagcatggagctgggcggcctggcccccttcatcgtgttcgacagcgccaacgtggaccaggccgtggccggcgccatggccagcaagttcagaaacaccggccagacctgcgtgtgcagcaaccagttcctggtgcagagaggcatccacgacgccttcgtgaaggccttcgccgaggccatgaagaagaacctgagagtgggcaacggcttcgaggagggcaccacccagggccccctgatcaacgagaaggccgtggagaaggtggagaagcaggtgaacgacgccgtgagcaagggcgccaccgtggtgaccggcggcaagagacaccagctgggcaagaacttcttcgagcccaccctgctgtgcaacgtgacccaggacatgctgtgcacccacgaggagaccttcggccccctggcccccgtgatcaagttcgacaccgaggaggaggccatcgccatcgccaacgccgccgacgtgggcctggccggctacttctacagccaggaccccgcccagatctggagagtggccgagcagctggaggtgggcatggtgggcgtgaacgagggcctgatcagcagcgtggagtgccccttcggcggcgtgaagcagagcggcctgggcagagagggcagcaagtacggcatcgacgagtacctggagctgaagtacgtgtgctacggcggcctgtag

SEQ ID NO: 72441 - DNA, 1344 bp, Artificial Sequence
  Description of Artificial Sequence: Synthetic coding sequence
atggtggccgactgcggcgtgagagaggccagagccgccgtgagagccgcctacgaggccttctgcagatggagagaggtgagcgccaaggagagaagcagcctgctgagaaagtggtacaacctgatgatccagaacaaggacgacctggccagaatcatcaccgccgagagcggcaagcccctgaaggaggcccacggcgagatcctgtacagcgccttcttcctggagtggttcagcgaggaggccagaagagtgtacggcgacatcatccacacccccgccaaggacagaagagccctggtgctgaagcagcccatcggcgtggccgccgtgatcaccccctggaacttccccagcgccatgatcaccagaaaggtgggcgccgccctggccgccggctgcaccgtggtggtgaagcccgccgaggacacccccttcagcgccctggccctggccgagctggccagccaggccggcatccccagcggcgtgtacaacgtgatcccctgcagcagaaagaacgccaaggaggtgggcgaggccatctgcaccgaccccctggtgagcaagatcagcttcaccggcagcaccaccaccggcaagatcctgctgcaccacgccgccaacagcgtgaagagagtgagcatggagctgggcggcctggcccccttcatcgtgttcgacagcgccaacgtggaccaggccgtggccggcgccatggccagcaagttcagaaacaccggccagacctgcgtgtgcagcaaccagttcctggtgcagagaggcatccacgacgccttcgtgaaggccttcgccgaggccatgaagaagaacctgagagtgggcaacggcttcgaggagggcaccacccagggccccctgatcaacgagaaggccgtggagaaggtggagaagcaggtgaacgacgccgtgagcaagggcgccaccgtggtgaccggcggcaagagacaccagctgggcaagaacttcttcgagcccaccctgctgtgcaacgtgacccaggacatgctgtgcacccacgaggagaccttcggccccctggcccccgtgatcaagttcgacaccgaggaggaggccatcgccatcgccaacgccgccgacgtgggcctggccggctacttctacagccaggaccccgcccagatctggagagtggccgagcagctggaggtgggcatggtgggcgtgaacgagggcctgatcagcagcgtggagtgccccttcggcggcgtgaagcagagcggcctgggcagagagggcagcaagtacggcatcgacgagtacctggagctgaagtacgtgtgctacggcggcctgtag

SEQ ID NO: 72442 - DNA, 1608 bp, Artificial Sequence
  Description of Artificial Sequence: Synthetic coding sequence
atggccgccctgctggccgccgccgccgtgagagccagaatcctgcaggtgagcagcaaggtgaagagcagccccacctggtacagcgccagcagcttcagcagcagcgtgcccaccgtgaagctgttcatcggcggcaagttcgtggagagcaagagcgacaagtggatcgacatccacaaccccgccaccaacgaggtgatcggcagagtgccccaggccaccaaggccgagatggacgccgccatcgccagctgcaagagagccttccccgcctgggccgacaccagcgtgctgagcagacagcaggtgctgctgagataccagcagctgatcaaggagaacctgaaggagatcgccaagctgatcaccctggagcagggcaagaccctggccgacgccgagggcgacgtgttcagaggcctgcaggtggtggagcacgcctgcagcgtgaccagcctgatgatgggcgagaccatgcccagcatcaccaaggacatggacctgtacagctacagactgcccctgggcgtgtgcgccggcatcgcccccttcaacttccccgccatgatccccctgtggatgttccccatggccatggtgtgcggcaacaccttcctgatgaagcccagcgagagagtgcccggcgccaccatgctgctggccaagctgctgcaggacagcggcgcccccgacggcaccctgaacatcatccacggccagcacgaggccgtgaacttcatctgcgaccaccccgacatcaaggccatcagcttcgtgggcagcaacaaggccggcgagtacatcttcgagagaggcagcagacacggcaagagagtgcaggccaacatgggcgccaagaaccacggcgtggtgatgcccgacgccaacaaggagaacaccctgaaccagctggtgggcgccgccttcggcgccgccggccagagatgcatggccctgagcaccgccgtgctggtgggcgaggccaagaagtggctgcccgagctggtggagcacgccaagaacctgagagtgaacgccggcgaccagcccggcgccgacctgggccccctgatcaccccccaggccaaggagagagtgtgcaacctgatcgacagcggcaccaaggagggcgccagcatcctgctggacggcagaaagatcaaggtgaagggctacgagaacggcaacttcgtgggccccaccatcatcagcaacgtgaagcccaacatgacctgctacaaggaggagatcttcggccccgtgctggtggtgctggagaccgagaccctggacgaggccatccagatcgtgaacaacaacccctacggcaacggcaccgccatcttcaccaccaacggcgccaccgccagaaagtacgcccacctggtggacgtgggccaggtgggcgtgaacgtgcccatccccgtgcccctgcccatgttcagcttcaccggcagcagaagcagcttcagaggcgacaccaacttctacggcaagcagggcatccagttctacacccagctgaagaccatcaccagccagtggaaggaggaggacgccaccctgagcagccccgccgtggtgatgcccaccatgggcagatag

SEQ ID NO: 72443 - DNA, 1620 bp, Artificial Sequence
  Description of Artificial Sequence: Synthetic coding sequence
atgtggagactgcccagagccctgtgcgtgcacgccgccaagaccagcaagctgagcggcccctggagcagacccgccgccttcatgagcaccctgctgatcaaccagccccagtacgcctggctgaaggagctgggcctgagagaggagaacgagggcgtgtacaacggcagctggggcggcagaggcgaggtgatcaccacctactgccccgccaacaacgagcccatcgccagagtgagacaggccagcgtggccgactacgaggagaccgtgaagaaggccagagaggcctggaagatctgggccgacatccccgcccccaagagaggcgagatcgtgagacagatcggcgacgccctgagagagaagatccaggtgctgggcagcctggtgagcctggagatgggcaagatcctggtggagggcgtgggcgaggtgcaggagtacgtggacatctgcgactacgccgtgggcctgagcagaatgatcggcggccccatcctgcccagcgagagaagcggccacgccctgatcgagcagtggaaccccgtgggcctggtgggcatcatcaccgccttcaacttccccgtggccgtgtacggctggaacaacgccatcgccatgatctgcggcaacgtgtgcctgtggaagggcgcccccaccaccagcctgatcagcgtggccgtgaccaagatcatcgccaaggtgctggaggacaacaagctgcccggcgccatctgcagcctgacctgcggcggcgccgacatcggcaccgccatggccaaggacgagagagtgaacctgctgagcttcaccggcagcacccaggtgggcaagcaggtgggcctgatggtgcaggagagattcggcagaagcctgctggagctgggcggcaacaacgccatcatcgccttcgaggacgccgacctgagcctggtggtgcccagcgccctgttcgccgccgtgggcaccgccggccagagatgcaccaccgccagaagactgttcatccacgagagcatccacgacgaggtggtgaacagactgaagaaggcctacgcccagatcagagtgggcaacccctgggaccccaacgtgctgtacggccccctgcacaccaagcaggccgtgagcatgttcctgggcgccgtggaggaggccaagaaggagggcggcaccgtggtgtacggcggcaaggtgatggacagacccggcaactacgtggagcccaccatcgtgaccggcctgggccacgacgccagcatcgcccacaccgagaccttcgcccccatcctgtacgtgttcaagttcaagaacgaggaggaggtgttcgcctggaacaacgaggtgaagcagggcctgagcagcagcatcttcaccaaggacctgggcagaatcttcagatggctgggccccaagggcagcgactgcggcatcgtgaacgtgaacatccccaccagcggcgccgagatcggcggcgccttcggcggcgagaagcacaccggcggcggcagagagagcggcagcgacgcctggaagcagtacatgagaagaagcacctgcaccatcaactacagcaaggacctgcccctggcccagggcatcaagttccagtag

SEQ ID NO: 72444 - DNA, 1044 bp, Artificial Sequence
  Description of Artificial Sequence: Synthetic coding sequence
atgtggagactgcccagagccctgtgcgtgcacgccgccaagaccagcaagctgagcggcccctggagcagacccgccgccttcatgagcaccagcctgatcagcgtggccgtgaccaagatcatcgccaaggtgctggaggacaacaagctgcccggcgccatctgcagcctgacctgcggcggcgccgacatcggcaccgccatggccaaggacgagagagtgaacctgctgagcttcaccggcagcacccaggtgggcaagcaggtgggcctgatggtgcaggagagattcggcagaagcctgctggagctgggcggcaacaacgccatcatcgccttcgaggacgccgacctgagcctggtggtgcccagcgccctgttcgccgccgtgggcaccgccggccagagatgcaccaccgccagaagactgttcatccacgagagcatccacgacgaggtggtgaacagactgaagaaggcctacgcccagatcagagtgggcaacccctgggaccccaacgtgctgtacggccccctgcacaccaagcaggccgtgagcatgttcctgggcgccgtggaggaggccaagaaggagggcggcaccgtggtgtacggcggcaaggtgatggacagacccggcaactacgtggagcccaccatcgtgaccggcctgggccacgacgccagcatcgcccacaccgagaccttcgcccccatcctgtacgtgttcaagttcaagaacgaggaggaggtgttcgcctggaacaacgaggtgaagcagggcctgagcagcagcatcttcaccaaggacctgggcagaatcttcagatggctgggccccaagggcagcgactgcggcatcgtgaacgtgaacatccccaccagcggcgccgagatcggcggcgccttcggcggcgagaagcacaccggcggcggcagagagagcggcagcgacgcctggaagcagtacatgagaagaagcacctgcaccatcaactacagcaaggacctgcccctggcccagggcatcaagttccagtag

SEQ ID NO: 72445 - DNA, 1509 bp, Artificial Sequence
  Description of Artificial Sequence: Synthetic coding sequence
atgggcagccccggcagaggcgccggcctgtacttcagcagcagccagggcctgggcctgatccccagccccggcctgagcatgtggagactgcccagagccctgtgcgtgcacgccgccaagaccagcaagctgagcggcccctggagcagacccgccgccttcatgagcaccctgctgatcaaccagccccagtacgcctggctgaaggagctgggcctgagagaggagaacgagggcgtgtacaacggcagctggggcggcagaggcgaggtgatcaccacctactgccccgccaacaacgagcccatcgccagagtgagacaggccagcgtggccgactacgaggagaccgtgaagaaggccagagaggcctggaagatctgggccgacatccccgcccccaagagaggcgagatcgtgagacagatcggcgacgccctgagagagaagatccaggtgctgggcagcctggtgagcctggagatgggcaagatcctggtggagggcgtgggcgaggtgcaggagtacgtggacatctgcgactacgccgtgggcctgagcagaatgatcggcggccccatcctgcccagcgagagaagcggccacgccctgatcgagcagtggaaccccgtgggcctggtgggcatcatcaccgccttcaacttccccgtggccgtgtacggctggaacaacgccatcgccatgatctgcggcaacgtgtgcctgtggaagggcgcccccaccaccagcctgatcagcgtggccgtgaccaagatcatcgccaaggtgctggaggacaacaagctgcccggcgccatctgcagcctgacctgcggcggcgccgacatcggcaccgccatggccaaggacgagagagtgaacctgctgagcttcaccggcagcacccaggtgggcaagcaggtgggcctgatggtgcaggagagattcggcagaagcctgctggagctgggcggcaacaacgccatcatcgccttcgaggacgccgacctgagcctggtggtgcccagcgccctgttcgccgccgtgggcaccgccggccagagatgcaccaccgccagaagactggtgatggacagacccggcaactacgtggagcccaccatcgtgaccggcctgggccacgacgccagcatcgcccacaccgagaccttcgcccccatcctgtacgtgttcaagttcaagaacgaggaggaggtgttcgcctggaacaacgaggtgaagcagggcctgagcagcagcatcttcaccaaggacctgggcagaatcttcagatggctgggccccaagggcagcgactgcggcatcgtgaacgtgaacatccccaccagcggcgccgagatcggcggcgccttcggcggcgagaagcacaccggcggcggcagagagagcggcagcgacgcctggaagcagtacatgagaagaagcacctgcaccatcaactacagcaaggacctgcccctggcccagggcatcaagttccagtag

SEQ ID NO: 72446 - DNA, 1314 bp, Artificial Sequence
  Description of Artificial Sequence: Synthetic coding sequence
atggccggcaccaacgccctgctgatgctggagaacttcatcgacggcaagttcctgccctgcagcagctacatcgacagctacgaccccagcaccggcgaggtgtactgcagagtgcccaacagcggcaaggacgagatcgaggccgccgtgaaggccgccagagaggccttccccagctggagcagcagaagcccccaggagagaagcagagtgctgaaccaggtggccgacctgctggagcagagcctggaggagttcgcccaggccgagagcaaggaccagggcaagaccctggccctggccagaaccatggacatccccagaagcgtgcagaacttcagattcttcgccagcagcagcctgcaccacaccagcgagtgcacccagatggaccacctgggctgcatgcactacaccgtgagagcccccgtgggcgtgggcgtgccccccggcgtggtgaacatcgtgttcggcaccggccccagagtgggcgaggccctggtgagccaccccgaggtgcccctgatcagcttcaccggcagccagcccaccgccgagagaatcacccagctgagcgccccccactgcaagaagctgagcctggagctgggcggcaagaaccccgccatcatcttcgaggacgccaacctggacgagtgcatccccgccaccgtgagaagcagcttcgccaaccagggcgagatctgcctgtgcaccagcagaatcttcgtgcagaagagcatctacagcgagttcctgaagagattcgtggaggccaccagaaagtggaaggtgggcatccccagcgaccccctggtgagcatcggcgccctgatcagcaaggcccacctggagaaggtgagaagctacgtgaagagagccctggccgagggcgcccagatctggtgcggcgagggcgtggacaagctgagcctgcccgccagaaaccaggccggctacttcatgctgcccaccgtgatcaccgacatcaaggacgagagctgctgcatgaccgaggagatcttcggccccgtgacctgcgtggtgcccttcgacagcgaggaggaggtgatcgagagagccaacaacgtgaagtacggcctggccgccaccgtgtggagcagcaacgtgggcagagtgcacagagtggccaagaagctgcagagcggcctggtgtggaccaactgctggctgatcagagagctgaacctgcccttcggcggcatgaagagcagcggcatcggcagagagggcgccaaggacagctacgacttcttcaccgagatcaagaccatcaccgtgaagcactag

SEQ ID NO: 72447 - DNA, 1464 bp, Artificial Sequence
  Description of Artificial Sequence: Synthetic coding sequence
atggccggcaccaacgccctgctgatgctggagaacttcatcgacggcaagttcctgccctgcagcagctacatcgacagctacgaccccagcaccggcgaggtgtactgcagagtgcccaacagcggcaaggacgagatcgaggccgccgtgaaggccgccagagaggccttccccagctggagcagcagaagcccccaggagagaagcagagtgctgaaccaggtggccgacctgctggagcagagcctggaggagttcgcccaggccgagagcaaggaccagggcaagaccctggccctggccagaaccatggacatccccagaagcgtgcagaacttcagattcttcgccagcagcagcctgcaccacaccagcgagtgcacccagatggaccacctgggctgcatgcactacaccgtgagagcccccgtgggcgtggccggcctgatcagcccctggaacctgcccctgtacctgctgacctggaagatcgcccccgccatggccgccggcaacaccgtgatcgccaagcccagcgagctgaccagcgtgaccgcctggatgctgtgcaagctgctggacaaggccggcgtgccccccggcgtggtgaacatcgtgttcggcaccggccccagagtgggcgaggccctggtgagccaccccgaggtgcccctgatcagcttcaccggcagccagcccaccgccgagagaatcacccagctgagcgccccccactgcaagaagctgagcctggagctgggcggcaagaaccccgccatcatcttcgaggacgccaacctggacgagtgcatccccgccaccgtgagaagcagcttcgccaaccagggcgagatctgcctgtgcaccagcagaatcttcgtgcagaagagcatctacagcgagttcctgaagagattcgtggaggccaccagaaagtggaaggtgggcatccccagcgaccccctggtgagcatcggcgccctgatcagcaaggcccacctggagaaggtgagaagctacgtgaagagagccctggccgagggcgcccagatctggtgcggcgagggcgtggacaagctgagcctgcccgccagaaaccaggccggctacttcatgctgcccaccgtgatcaccgacatcaaggacgagagctgctgcatgaccgaggagatcttcggccccgtgacctgcgtggtgcccttcgacagcgaggaggaggtgatcgagagagccaacaacgtgaagtacggcctggccgccaccgtgtggagcagcaacgtgggcagagtgcacagagtggccaagaagctgcagagcggcctggtgtggaccaactgctggctgatcagagagctgaacctgcccttcggcggcatgaagagcagcggcatcggcagagagggcgccaaggacagctacgacttcttcaccgagatcaagaccatcaccgtgaagcactag

SEQ ID NO: 72448 - DNA, 1302 bp, Artificial Sequence
  Description of Artificial Sequence: Synthetic coding sequence
atggccggcaccaacgccctgctgatgctggagaacttcatcgacggcaagttcctgccctgcagcagctacatcgacagctacgaccccagcaccggcgaggtgtactgcagagtgcccaacagcggcaaggacgagatcgaggccgccgtgaaggccgccagagaggccttccccagctggagcagcagaagcccccaggagagaagcagagtgctgaaccaggtggccgacctgctggagcagagcctggaggagttcgcccaggccgagagcaaggaccagggcaagaccctggccctggccagaaccatggacatccccagaagcgtgcagaacttcagattcttcgccagcagcagcctgcaccacaccagcgagtgcacccagatggaccacctgggctgcatgcactacaccgtgagagcccccgtgggcgtggccggcctgatcagcccctggaacctgcccctgtacctgctgacctggaagatcgcccccgccatggccgccggcaacaccgtgatcgccaagcccagcgagctgaccagcgtgaccgcctggatgctgtgcaagctgctggacaaggccggcgtgccccccggcgtggtgaacatcgtgttcggcaccggccccagagtgggcgaggccctggtgagccaccccgaggtgcccctgatcagcttcaccggcagccagcccaccgccgagagaatcacccagctgagcgccccccactgcaagaagctgagcctggagctgggcggcaagaaccccgccatcatcttcgaggacgccaacctggacgagtgcatccccgccaccgtgagaagcagcttcgccaaccaggtgagaagctacgtgaagagagccctggccgagggcgcccagatctggtgcggcgagggcgtggacaagctgagcctgcccgccagaaaccaggccggctacttcatgctgcccaccgtgatcaccgacatcaaggacgagagctgctgcatgaccgaggagatcttcggccccgtgacctgcgtggtgcccttcgacagcgaggaggaggtgatcgagagagccaacaacgtgaagtacggcctggccgccaccgtgtggagcagcaacgtgggcagagtgcacagagtggccaagaagctgcagagcggcctggtgtggaccaactgctggctgatcagagagctgaacctgcccttcggcggcatgaagagcagcggcatcggcagagagggcgccaaggacagctacgacttcttcaccgagatcaagaccatcaccgtgaagcactag

SEQ ID NO: 72449 - DNA, 1557 bp, Artificial Sequence
  Description of Artificial Sequence: Synthetic coding sequence
atgttcctgagagccggcctggccgccctgagccccctgctgagaagcctgagacccagccccgtggccgccatgagcaccggcaccttcgtggtgagccagcccctgaactacagaggcggcgccagagtggagcccgccgacgccagcggcaccgagaaggccttcgagcccgccaccggcagagtgatcgccaccttcacctgcagcggcgagaaggaggtgaacctggccgtgcagaacgccaaggccgccttcaagatctggagccagaagagcggcatggagagatgcagaatcctgctggaggccgccagaatcatcagagagagagaggacgagatcgccaccatggagtgcatcaacaacggcaagagcatcttcgaggccagactggacatcgacatcagctggcagtgcctggagtactacgccggcctggccgccagcatggccggcgagcacatccagctgcccggcggcagcttcggctacaccagaagagagcccctgggcgtgtgcgtgggcatcggcgcctggaactaccccttccagatcgccagctggaagagcgcccccgccctggcctgcggcaacgccatggtgttcaagcccagccccttcacccccgtgagcgccctgctgctggccgagatctacagcgaggccggcgtgccccccggcctgttcaacgtggtgcagggcggcgccgccaccggccagttcctgtgccagcaccccgacgtggccaaggtgagcttcaccggcagcgtgcccaccggcatgaagatcatggagatgagcgccaagggcatcaagcccgtgaccctggagctgggcggcaagagccccctgatcatcttcagcgactgcgacatgaacaacgccgtgaagggcgccctgatggccaacttcctgacccagggccaggtgtgctgcaacggcaccagagtgttcgtgcagaaggagatcctggacaagttcaccgaggaggtggtgaagcagacccagagaatcaagatcggcgaccccctgctggaggacaccagaatgggccccctgatcaacagaccccacctggagagagtgctgggcttcgtgaaggtggccaaggagcagggcgccaaggtgctgtgcggcggcgacatctacgtgcccgaggaccccaagctgaaggacggctactacatgagaccctgcgtgctgaccaactgcagagacgacatgacctgcgtgaaggaggagatcttcggccccgtgatgagcatcctgagcttcgacaccgaggccgaggtgctggagagagccaacgacaccaccttcggcctggccgccggcgtgttcaccagagacatccagagagcccacagagtggtggccgagctgcaggccggcacctgcttcatcaacaactacaacgtgagccccgtggagctgcccttcggcggctacaagaagagcggcttcggcagagagaacggcagagtgaccatcgagtactacagccagctgaagaccgtgtgcgtggagatgggcgacgtggagagcgccttctag

SEQ ID NO: 72450 - DNA, 1275 bp, Artificial Sequence
  Description of Artificial Sequence: Synthetic coding sequence
atggagagatgcagaatcctgctggaggccgccagaatcatcagagagagagaggacgagatcgccaccatggagtgcatcaacaacggcaagagcatcttcgaggccagactggacatcgacatcagctggcagtgcctggagtactacgccggcctggccgccagcatggccggcgagcacatccagctgcccggcggcagcttcggctacaccagaagagagcccctgggcgtgtgcgtgggcatcggcgcctggaactaccccttccagatcgccagctggaagagcgcccccgccctggcctgcggcaacgccatggtgttcaagcccagccccttcacccccgtgagcgccctgctgctggccgagatctacagcgaggccggcgtgccccccggcctgttcaacgtggtgcagggcggcgccgccaccggccagttcctgtgccagcaccccgacgtggccaaggtgagcttcaccggcagcgtgcccaccggcatgaagatcatggagatgagcgccaagggcatcaagcccgtgaccctggagctgggcggcaagagccccctgatcatcttcagcgactgcgacatgaacaacgccgtgaagggcgccctgatggccaacttcctgacccagggccaggtgtgctgcaacggcaccagagtgttcgtgcagaaggagatcctggacaagttcaccgaggaggtggtgaagcagacccagagaatcaagatcggcgaccccctgctggaggacaccagaatgggccccctgatcaacagaccccacctggagagagtgctgggcttcgtgaaggtggccaaggagcagggcgccaaggtgctgtgcggcggcgacatctacgtgcccgaggaccccaagctgaaggacggctactacatgagaccctgcgtgctgaccaactgcagagacgacatgacctgcgtgaaggaggagatcttcggccccgtgatgagcatcctgagcttcgacaccgaggccgaggtgctggagagagccaacgacaccaccttcggcctggccgccggcgtgttcaccagagacatccagagagcccacagagtggtggccgagctgcaggccggcacctgcttcatcaacaactacaacgtgagccccgtggagctgcccttcggcggctacaagaagagcggcttcggcagagagaacggcagagtgaccatcgagtactacagccagctgaagaccgtgtgcgtggagatgggcgacgtggagagcgccttctag

SEQ ID NO: 72451 - DNA, 4017 bp, Artificial Sequence
  Description of Artificial Sequence: Synthetic coding sequence
atggacagagccagcgagctgctgttctacgtgaacggcagaaaggtgatcgagaagaacgtggaccccgagaccatgctgctgccctacctgagaaagaagctgagactgaccggcaccaagtacggctgcggcggcggcggctgcggcgcctgcaccgtgatgatcagcagatacaaccccatcaccaagagaatcagacaccaccccgccaacgcctgcctgatccccatctgcagcctgtacggcgccgccgtgaccaccgtggagggcatcggcagcacccacaccagaatccaccccgtgcaggagagaatcgccaagtgccacggcacccagtgcggcttctgcacccccggcatggtgatgagcatctacaccctgctgagaaaccaccccgagcccaccctggaccagctgaccgacgccctgggcggcaacctgtgcagatgcaccggctacagacccatcatcgacgcctgcaagaccttctgcaagaccagcggctgctgccagagcaaggagaacggcgtgtgctgcctggaccagggcatcaacggcctgcccgagttcgaggagggcagcaagaccagccccaagctgttcgccgaggaggagttcctgcccctggaccccacccaggagctgatcttcccccccgagctgatgatcatggccgagaagcagagccagagaaccagagtgttcggcagcgagagaatgatgtggttcagccccgtgaccctgaaggagctgctggagttcaagttcaagtacccccaggcccccgtgatcatgggcaacaccagcgtgggccccgaggtgaagttcaagggcgtgttccaccccgtgatcatcagccccgacagaatcgaggagctgagcgtggtgaaccacgcctacaacggcctgaccctgggcgccggcctgagcctggcccaggtgaaggacatcctggccgacgtggtgcagaagctgcccgaggagaagacccagatgtaccacgccctgctgaagcacctgggcaccctggccggcagccagatcagaaacatggccagcctgggcggccacatcatcagcagacaccccgacagcgacctgaaccccatcctggccgtgggcaactgcaccctgaacctgctgagcaaggagggcaagagacagatccccctgaacgagcagttcctgagcaagtgccccaacgccgacctgaagccccaggagatcctggtgagcgtgaacatcccctacagcagaaagtgggagttcgtgagcgccttcagacaggcccagagacaggagaacgccctggccatcgtgaacagcggcatgagagtgttcttcggcgagggcgacggcatcatcagagagctgtgcatcagctacggcggcgtgggccccgccaccatctgcgccaagaacagctgccagaagctgatcggcagacactggaacgagcagatgctggacatcgcctgcagactgatcctgaacgaggtgagcctgctgggcagcgcccccggcggcaaggtggagttcaagagaaccctgatcatcagcttcctgttcaagttctacctggaggtgagccagatcctgaagaagatggaccccgtgcactaccccagcctggccgacaagtacgagagcgccctggaggacctgcacagcaagcaccactgcagcaccctgaagtaccagaacatcggccccaagcagcaccccgaggaccccatcggccaccccatcatgcacctgagcggcgtgaagcacgccaccggcgaggccatctactgcgacgacatgcccctggtggaccaggagctgttcctgaccttcgtgaccagcagcagagcccacgccaagatcgtgagcatcgacctgagcgaggccctgagcatgcccggcgtggtggacatcatgaccgccgagcacctgagcgacgtgaacagcttctgcttcttcaccgaggccgagaagttcctggccaccgacaaggtgttctgcgtgggccagctggtgtgcgccgtgctggccgacagcgaggtgcaggccaagagagccgccaagagagtgaagatcgtgtaccaggacctggagcccctgatcctgaccatcgaggagagcatccagcacaacagcagcttcaagcccgagagaaagctggagtacggcaacgtggacgaggccttcaaggtggtggaccagatcctggagggcgagatccacatgggcggccaggagcacttctacatggagacccagagcatgctggtggtgcccaagggcgaggaccaggagatggacgtgtacgtgagcacccagttccccaagtacatccaggacatcgtggccagcaccctgaagctgcccgccaacaaggtgatgtgccacgtgagaagagtgggcggcgccttcggcggcaaggtgctgaagaccggcatcatcgccgccgtgaccgccttcgccgccaacaagcacggcagagccgtgagatgcgtgctggagagaggcgaggacatgctgatcaccggcggcagacacccctacctgggcaagtacaaggccggcttcatgaacgacggcagaatcctggccctggacatggagcactacagcaacgccggcgccagcctggacgagagcctgttcgtgatcgagatgggcctgctgaagatggacaacgcctacaagttccccaacctgagatgcagaggctgggcctgcagaaccaacctgcccagcaacaccgccttcagaggcttcggcttcccccaggccgccctgatcaccgagagctgcatcaccgaggtggccgccaagtgcggcctgagccccgagaaggtgagaatcatcaacatgtacaaggagatcgaccagaccccctacaagcaggagatcaacgccaagaacctgatccagtgctggagagagtgcatggccatgagcagctacagcctgagaaaggtggccgtggagaagttcaacgccgagaactactggaagaagaagggcctggccatggtgcccctgaagttccccgtgggcctgggcagcagagccgccggccaggccgccgccctggtgcacatctacctggacggcagcgtgctggtgacccacggcggcatcgagatgggccagggcgtgcacaccaagatgatccaggtggtgagcagagagctgagaatgcccatgagcaacgtgcacctgagaggcaccagcaccgagaccgtgcccaacgccaacatcagcggcggcagcgtggtggccgacctgaacggcctggccgtgaaggacgcctgccagaccctgctgaagagactggagcccatcatcagcaagaaccccaagggcacctggaaggactgggcccagaccgccttcgacgagagcatcaacctgagcgccgtgggctacttcagaggctacgagagcgacatgaactgggagaagggcgagggccagcccttcgagtacttcgtgtacggcgccgcctgcagcgaggtggagatcgactgcctgaccggcgaccacaagaacatcagaaccgacatcgtgatggacgtgggctgcagcatcaaccccgccatcgacatcggccagatcgagggcgccttcatccagggcatgggcctgtacaccatcgaggagctgaactacagcccccagggcatcctgcacaccagaggccccgaccagtacaagatccccgccatctgcgacatgcccaccgagctgcacatcgccctgctgccccccagccagaacagcaacaccctgtacagcagcaagggcctgggcgagagcggcgtgttcctgggctgcagcgtgttcttcgccatccacgacgccgtgagcgccgccagacaggagagaggcctgcacggccccctgaccctgaacagccccctgacccccgagaagatcagaatggcctgcgaggacaagttcaccaagatgatccccagagacgagcccggcagctacgtgccctggaacgtgcccatctag

SEQ ID NO: 72452 - DNA, 456 bp, Artificial Sequence
  Description of Artificial Sequence: Synthetic coding sequence
atgctgctgccctacctgagaaagaagctgagactgaccggcaccaagtacggctgcggcggcggcggctgcggcgcctgcaccgtgatgatcagcagatacaaccccatcaccaagagaatcagacaccaccccgccaacgcctgcctgatccccatctgcagcctgtacggcgccgccgtgaccaccgtggagggcatcggcagcacccacaccagaatccaccccgtgcaggagagaatcgccaagtgccacggcacccagtgcggcttctgcacccccggcatggtgatgagcatctacaccctgctgagaaaccaccccgagcccaccctggaccagctgaccgacgccctgggcggcaacctgtgcagatgcaccggctacagacccatcatcgacgcctgcaagaccttctgcaagaccagcggctgctgccagagcaaggagaactag

SEQ ID NO: 72453 - DNA, 858 bp, Artificial Sequence
  Description of Artificial Sequence: Synthetic coding sequence
atggacctgagcgccgccagccacagaatccccctgagcgacggcaacagcatccccatcatcggcctgggcacctacagcgagcccaagagcacccccaagggcgcctgcgccaccagcgtgaaggtggccatcgacaccggctacagacacatcgacggcgcctacatctaccagaacgagcacgaggtgggcgaggccatcagagagaagatcgccgagggcaaggtgagaagagaggacatcttctactgcggcaagctgtgggccaccaaccacgtgcccgagatggtgagacccaccctggagagaaccctgagagtgctgcagctggactacgtggacctgtacatcatcgaggtgcccatggccttcaagcccggcgacgagatctaccccagagacgagaacggcaagtggctgtaccacaagagcaacctgtgcgccacctgggaggtggagtgccacccctacttcacccagcccaagctgctgaagttctgccagcagcacgacatcgtgatcaccgcctacagccccctgggcaccagcagaaaccccatctgggtgaacgtgagcagcccccccctgctgaaggacgccctgctgaacagcctgggcaagagatacaacaagaccgccgcccagatcgtgctgagattcaacatccagagaggcgtggtggtgatccccaagagcttcaacctggagagaatcaaggagaacttccagatcttcgacttcagcctgaccgaggaggagatgaaggacatcgaggccctgaacaagaacgtgagattcgtggagctgctgatgtggagagaccaccccgagtaccccttccacgacgagtactag

SEQ ID NO: 72454 - DNA, 873 bp, Artificial Sequence
  Description of Artificial Sequence: Synthetic coding sequence
atggacctgagcgccgccagccacagaatccccctgagcgacggcaacagcatccccatcatcggcctgggcacctacagcgagcccaagagcacccccaagggcgcctgcgccaccagcgtgaaggtggccatcgacaccggctacagacacatcgacggcgcctacatctaccagaacgagcacgaggtgggcgaggccatcagagagaagatcgccgagggcaaggtgagaagagaggacatcttctactgcggcaagctgtgggccaccaaccacgtgcccgagatggtgagacccaccctggagagaaccctgagagtgctgcagctggactacgtggacctgtacatcatcgaggtgcccatggccttcaagcccggcgacgagatctaccccagagacgagaacggcaagtggctgtaccacaagagcaacctgtgcgccacctgggaggccatggaggcctgcaaggacgccggcctggtgaagagcctgggcgtgagcaacttcaacagaagacagctggagctgatcctgaacaagcccggcctgaagcacaagcccgtgagcaaccaggtggagtgccacccctacttcacccagcccaagctgctgaagttctgccagcagcacgacatcgtgatcaccgcctacagccccctgggcaccagcagaaaccccatctgggtgaacgtgagcagcccccccctgctgaaggacgccctgctgaacagcctgggcaagagatacaacaagaccgccgcccagatcgtgctgagattcaacatccagagaggcgtggtggtgatccccaagagcttcaacctggagagaatcaaggagaacttccaggtggccagaagcagctag

SEQ ID NO: 72455 - DNA, 978 bp, Artificial Sequence
  Description of Artificial Sequence: Synthetic coding sequence
atggccgccagctgcgtgctgctgcacaccggccagaagatgcccctgatcggcctgggcacctggaagagcgagcccggccaggtgaaggccgccgtgaagtacgccctgagcgtgggctacagacacatcgactgcgccgccatctacggcaacgagcccgagatcggcgaggccctgaaggaggacgtgggccccggcaaggccgtgcccagagaggagctgttcgtgaccagcaagctgtggaacaccaagcaccaccccgaggacgtggagcccgccctgagaaagaccctggccgacctgcagctggagtacctggacctgtacctgatgcactggccctacgccttcgagagaggcgacaaccccttccccaagaacgccgacggcaccatctgctacgacagcacccactacaaggagacctggaaggccctggaggccctggtggccaagggcctggtgcaggccctgggcctgagcaacttcaacagcagacagatcgacgacatcctgagcgtggccagcgtgagacccgccgtgctgcaggtggagtgccacccctacctggcccagaacgagctgatcgcccactgccaggccagaggcctggaggtgaccgcctacagccccctgggcagcagcgacagagcctggagagaccccgacgagcccgtgctgctggaggagcccgtggtgctggccctggccgagaagtacggcagaagccccgcccagatcctgctgagatggcaggtgcagagaaaggtgatctgcatccccaagagcatcacccccagcagaatcctgcagaacatcaaggtgttcgacttcaccttcagccccgaggagatgaagcagctgaacgccctgaacaagaactggagatacatcgtgcccatgctgaccgtggacggcaagagagtgcccagagacgccggccaccccctgtaccccttcaacgacccctactag

SEQ ID NO: 72456 - DNA, 978 bp, Artificial Sequence; identical to SEQ ID NO: 72455
  Description of Artificial Sequence: Synthetic coding sequence

SEQ ID NO: 72457 - DNA, 444 bp, Artificial Sequence
  Description of Artificial Sequence: Synthetic coding sequence
atggccgccagctgcgtgctgctgcacaccggccagaagatgcccctgatcggcctgggcacctggaagagcgagcccggccaggtgaaggccgccgtgaagtacgccctgagcgtgggctacagacacatcgactgcgccgccatctacggcaacgagcccgagatcggcgaggccctgaaggaggacgtgggccccggcaaggccgtgcccagagaggagctgttcgtgaccagcaagctgtggaacaccaagcaccaccccgaggacgtggagcccgccctgagaaagaccctggccgacctgcagctggagtacctggacctgtacctgatgcactggccctacgccttcgagagaggcgacaaccccttccccaagaacgccgacggcaccatctgctacgacagcacccactacaaggagacctggaaggccctgtag

SEQ ID NO: 72458 - DNA, 951 bp, Artificial Sequence
  Description of Artificial Sequence: Synthetic coding sequence
atggccagcagactgctgctgaacaacggcgccaagatgcccatcctgggcctgggcacctggaagagcccccccggccaggtgaccgaggccgtgaaggtggccatcgacgtgggctacagacacatcgactgcgcccacgtgtaccagaacgagaacgaggtgggcgtggccatccaggagaagctgagagagcaggtggtgaagagagaggagctgttcatcgtgagcaagctgtggtgcacctaccacgagaagggcctggtgaagggcgcctgccagaagaccctgagcgacctgaagctggactacctggacctgtacctgatccactggcccaccggcttcaagcccggcaaggagttcttccccctggacgagagcggcaacgtggtgcccagcgacaccaacatcctggacacctgggccgccatggaggagctggtggacgagggcctggtgaaggccatcggcatcagcaacttcaaccacctgcaggtggagatgatcctgaacaagcccggcctgaagtacaagcccgccgtgaaccagatcgagtgccacccctacctgacccaggagaagctgatccagtactgccagagcaagggcatcgtggtgaccgcctacagccccctgggcagccccgacagaccctgggccaagcccgaggaccccagcctgctggaggaccccagaatcaaggccatcgccgccaagcacaacaagaccaccgcccaggtgctgatcagattccccatgcagagaaacctggtggtgatccccaagagcgtgacccccgagagaatcgccgagaacttcaaggtgttcgacttcgagctgagcagccaggacatgaccaccctgctgagctacaacagaaactggagagtgtgcgccctgctgagctgcaccagccacaaggactaccccttccacgaggagttctag

SEQ ID NO: 72459 - DNA, 618 bp, Artificial Sequence
  Description of Artificial Sequence: Synthetic coding sequence
atgggcgtggtgagcctgttcctgtgcatcgtggagcagatcttcaccagcagcaagaagatccagttcagaggcatcttcatggccaaggtgcccaagagcaaggccctggaggccaccaagctggccatcgaggccggcttcagacacatcgacagcgcccacctgtacaacaacgaggagcaggtgggcctggccatcagaagcaagatcgccgacggcagcgtgaagagagaggacatcttctacaccagcaagctgtggtgcaacagccacagacccgagctggtgagacccgccctggagagaagcctgaagaacctgcagctggactacgtggacctgtacctgatccacttccccgtgagcgtgaagcccggcgaggaggtgatccccaaggacgagaacggcaagatcctgttcgacaccgtggacctgtgcgccacctgggaggccgtggagaagtgcaaggacgccggcctggccaagagcatcggcgtgagcaacttcaacagaagacagctggagatgatcctgaacaagcccggcctgaagtacaagcccgtgtgcaaccagcccagagacaacagcatcttcagcctgagccccgactggtag

SEQ ID NO: 72460 - DNA, 972 bp, Artificial Sequence
  Description of Artificial Sequence: Synthetic coding sequence
atggacagcaagtaccagtgcgtgaagctgaacgacggccacttcatgcccgtgctgggcttcggcacctacgcccccgccgaggtgcccaagagcaaggccctggaggccaccaagctggccatcgaggccggcttcagacacatcgacagcgcccacctgtacaacaacgaggagcaggtgggcctggccatcagaagcaagatcgccgacggcagcgtgaagagagaggacatcttctacaccagcaagctgtggtgcaacagccacagacccgagctggtgagacccgccctggagagaagcctgaagaacctgcagctggactacgtggacctgtacctgatccacttccccgtgagcgtgaagcccggcgaggaggtgatccccaaggacgagaacggcaagatcctgttcgacaccgtggacctgtgcgccacctgggaggccgtggagaagtgcaaggacgccggcctggccaagagcatcggcgtgagcaacttcaacagaagacagctggagatgatcctgaacaagcccggcctgaagtacaagcccgtgtgcaaccaggtggagtgccacccctacttcaaccagagaaagctgctggacttctgcaagagcaaggacatcgtgctggtggcctacagcgccctgggcagccacagagaggagccctgggtggaccccaacagccccgtgctgctggaggaccccgtgctgtgcgccctggccaagaagcacaagagaacccccgccctgatcgccctgagataccagctgcagagaggcgtggtggtgctggccaagagctacaacgagcagagaatcagacagaacgtgcaggtgttcgagttccagctgaccagcgaggagatgaaggccatcgacggcctgaacagaaacgtgagatacctgaccctggacatcttcgccggcccccccaactaccccttcagcgacgagtactag

SEQ ID NO: 72461 - DNA, 972 bp, Artificial Sequence; identical to SEQ ID NO: 72460
  Description of Artificial Sequence: Synthetic coding sequence

SEQ ID NO: 72462 - DNA, 747 bp, Artificial Sequence
  Description of Artificial Sequence: Synthetic coding sequence
tgaagcaagtaccagtgcgtgaagctgaacgacggccacttcatgcccgtgctgggcttcggcacctacgcccccgccgaggtgggcctggccatcagaagcaagatcgccgacggcagcgtgaagagagaggacatcttctacaccagcaagctgtggtgcaacagccacagacccgagctggtgagacccgccctggagagaagcctgaagaacctgcagctggactacgtggacctgtacctgatccacttccccgtgagcgtgaagcccggcgaggaggtgatccccaaggacgagaacggcaagatcctgttcgacaccgtggacctgtgcgccacctgggaggccgtggagaagtgcaaggacgccggcctggccaagagcatcggcgtgagcaacttcaacagaagacagctggagatgatcctgaacaagcccggcctgaagtacaagcccgtgtgcaaccaggtggagtgccacccctacttcaaccagagaaagctgctggacttctgcaagagcaaggacatcgtgctggtggcctacagcgccctgggcagccacagagaggagccctgggtggaccccaacagccccgtgctgctggaggaccccgtgctgtgcgccctggccaagaagcacaagagaacccccgccctgatcgccctgagataccagctgcagagaggcgtggtggtgctggccaagagctacaacgagcagagaatcagacagaacgtgtag

SEQ ID NO: 72463 - DNA, 972 bp, Artificial Sequence
  Description of Artificial Sequence: Synthetic coding sequence
atggacagcaagtaccagtgcgtgaagctgaacgacggccacttcatgcccgtgctgggcttcggcacctacgcccccgccgaggtgcccaagagcaaggccctggaggccgtgaagctggccatcgaggccggcttccaccacatcgacagcgcccacgtgtacaacaacgaggagcaggtgggcctggccatcagaagcaagatcgccgacggcagcgtgaagagagaggacatcttctacaccagcaagctgtggagcaacagccacagacccgagctggtgagacccgccctggagagaagcctgaagaacctgcagctggactacgtggacctgtacctgatccacttccccgtgagcgtgaagcccggcgaggaggtgatccccaaggacgagaacggcaagatcctgttcgacaccgtggacctgtgcgccacctgggaggccatggagaagtgcaaggacgccggcctggccaagagcatcggcgtgagcaacttcaaccacagactgctggagatgatcctgaacaagcccggcctgaagtacaagcccgtgtgcaaccaggtggagtgccacccctacttcaaccagagaaagctgctggacttctgcaagagcaaggacatcgtgctggtggcctacagcgccctgggcagccacagagaggagccctgggtggaccccaacagccccgtgctgctggaggaccccgtgctgtgcgccctggccaagaagcacaagagaacccccgccctgatcgccctgagataccagctgcagagaggcgtggtggtgctggccaagagctacaacgagcagagaatcagacagaacgtgcaggtgttcgagttccagctgaccagcgaggagatgaaggccatcgacggcctgaacagaaacgtgagatacctgaccctggacatcttcgccggcccccccaactaccccttcagcgacgagtactag

SEQ ID NO: 72464 - DNA, 972 bp, Artificial Sequence; identical to SEQ ID NO: 72463
  Description of Artificial Sequence: Synthetic coding sequence

SEQ ID NO: 72465 - DNA, 894 bp, Artificial Sequence
  Description of Artificial Sequence: Synthetic coding sequence
atggacagcaagtaccagtgcgtgaagctgaacgacggccacttcatgcccgtgctgggcttcggcacctacgcccccgccgaggtgcccaagagcaaggccctggaggccgtgaagctggccatcgaggccggcttccaccacatcgacagcgcccacgtgtacaacaacgaggagcaggtgggcctggccatcagaagcaagatcgccgacggcagcgtgaagagagaggacatcttctacaccagcaagctgtggagcaacagccacagacccgagctggtgagacccgccctggagagaagcctgaagaacctgcagctggactacgtggacctgtacctgatccacttccccgtgagcgtgaaggccatggagaagtgcaaggacgccggcctggccaagagcatcggcgtgagcaacttcaaccacagactgctggagatgatcctgaacaagcccggcctgaagtacaagcccgtgtgcaaccaggtggagtgccacccctacttcaaccagagaaagctgctggacttctgcaagagcaaggacatcgtgctggtggcctacagcgccctgggcagccacagagaggagccctgggtggaccccaacagccccgtgctgctggaggaccccgtgctgtgcgccctggccaagaagcacaagagaacccccgccctgatcgccctgagataccagctgcagagaggcgtggtggtgctggccaagagctacaacgagcagagaatcagacagaacgtgcaggtgttcgagttccagctgaccagcgaggagatgaaggccatcgacggcctgaacagaaacgtgagatacctgaccctggacatcttcgccggcccccccaactaccccttcagcgacgagtactag

SEQ ID NO: 72466 - DNA, 420 bp, Artificial Sequence
  Description of Artificial Sequence: Synthetic coding sequence
atggacagcaagtaccagtgcgtgaagctgaacgacggccacttcatgcccgtgctgggcttcggcacctacgcccccgccgaggtgcccaagagcaaggccctggaggccgtgaagctggccatcgaggccggcttccaccacatcgacagcgcccacgtgtacaacaacgaggagcaggtgggcctggccatcagaagcaagatcgccgacggcagcgtgaagagagaggacatcttctacaccagcaagctgtggagcaacagccacagacccgagctggtgagacccgccctggagagaagcctgaagaacctgcagctggactacgtggacctgtacctgatccacttccccgtgagcgtgaaggaggacatcggcatcctgacctggaagaagagccccaagcacaacagctag

SEQ ID NO: 72467 - DNA, 972 bp, Artificial Sequence
  Description of Artificial Sequence: Synthetic coding sequence
atggacagcaagcaccagtgcgtgaagctgaacgacggccacttcatgcccgtgctgggcttcggcacctacgccccccccgaggtgcccagaagcaaggccctggaggtgaccaagctggccatcgaggccggcttcagacacatcgacagcgcccacctgtacaacaacgaggagcaggtgggcctggccatcagaagcaagatcgccgacggcagcgtgaagagagaggacatcttctacaccagcaagctgtggagcaccttccacagacccgagctggtgagacccgccctggagaacagcctgaagaaggcccagctggactacgtggacctgtacctgatccacagccccatgagcctgaagcccggcgaggagctgagccccaccgacgagaacggcaaggtgatcttcgacatcgtggacctgtgcaccacctgggaggccatggagaagtgcaaggacgccggcctggccaagagcatcggcgtgagcaacttcaacagaagacagctggagatgatcctgaacaagcccggcctgaagtacaagcccgtgtgcaaccaggtggagtgccacccctacttcaacagaagcaagctgctggacttctgcaagagcaaggacatcgtgctggtggcctacagcgccctgggcagccagagagacaagagatgggtggaccccaacagccccgtgctgctggaggaccccgtgctgtgcgccctggccaagaagcacaagagaacccccgccctgatcgccctgagataccagctgcagagaggcgtggtggtgctggccaagagctacaacgagcagagaatcagacagaacgtgcaggtgttcgagttccagctgaccgccgaggacatgaaggccatcgacggcctggacagaaacctgcactacttcaacagcgacagcttcgccagccaccccaactacccctacagcgacgagtactag

SEQ ID NO: 72468 - DNA, 615 bp, Artificial Sequence
  Description of Artificial Sequence: Synthetic coding sequence
atgagcctgaagcccggcgaggagctgagccccaccgacgagaacggcaaggtgatcttcgacatcgtggacctgtgcaccacctgggaggccatggagaagtgcaaggacgccggcctggccaagagcatcggcgtgagcaacttcaacagaagacagctggagatgatcctgaacaagcccggcctgaagtacaagcccgtgtgcaaccaggtggagtgccacccctacttcaacagaagcaagctgctggacttctgcaagagcaaggacatcgtgctggtggcctacagcgccctgggcagccagagagacaagagatgggtggaccccaacagccccgtgctgctggaggaccccgtgctgtgcgccctggccaagaagcacaagagaacccccgccctgatcgccctgagataccagctgcagagaggcgtggtggtgctggccaagagctacaacgagcagagaatcagacagaacgtgcaggtgttcgagttccagctgaccgccgaggacatgaaggccatcgacggcctggacagaaacctgcactacttcaacagcgacagcttcgccagccaccccaactacccctacagcgacgagtactag

SEQ ID NO: 72469 - DNA, 972 bp, Artificial Sequence
  Description of Artificial Sequence: Synthetic coding sequence
atggaccccaagtaccagagagtggagctgaacgacggccacttcatgcccgtgctgggcttcggcacctacgccccccccgaggtgcccagaaacagagccgtggaggtgaccaagctggccatcgaggccggcttcagacacatcgacagcgcctacctgtacaacaacgaggagcaggtgggcctggccatcagaagcaagatcgccgacggcagcgtgaagagagaggacatcttctacaccagcaagctgtggtgcaccttcttccagccccagatggtgcagcccgccctggagagcagcctgaagaagctgcagctggactacgtggacctgtacctgctgcacttccccatggccctgaagcccggcgagacccccctgcccaaggacgagaacggcaaggtgatcttcgacaccgtggacctgagcgccacctgggaggtgatggagaagtgcaaggacgccggcctggccaagagcatcggcgtgagcaacttcaactgcagacagctggagatgatcctgaacaagcccggcctgaagtacaagcccgtgtgcaaccaggtggagtgccacccctacctgaaccagagcaagctgctggacttctgcaagagcaaggacatcgtgctggtggcccacagcgccctgggcacccagagacacaagctgtgggtggaccccaacagccccgtgctgctggaggaccccgtgctgtgcgccctggccaagaagcacaagcagacccccgccctgatcgccctgagataccagctgcagagaggcgtggtggtgctggccaagagctacaacgagcagagaatcagagagaacatccaggtgttcgagttccagctgaccagcgaggacatgaaggtgctggacggcctgaacagaaactacagatacgtggtgatggacttcctgatggaccaccccgactaccccttcagcgacgagtactag

SEQ ID NO: 72470 - DNA, 972 bp, Artificial Sequence; identical to SEQ ID NO: 72469
  Description of Artificial Sequence: Synthetic coding sequence

SEQ ID NO: 72471 - DNA, 381 bp, Artificial Sequence
  Description of Artificial Sequence: Synthetic coding sequence
atggaccccaagtaccagagagtggagctgaacgacggccacttcatgcccgtgctgggcttcggcacctacgccccccccgaggtgcccagaaacagagccgtggaggtgaccaagctggccatcgaggccggcttcagacacatcgacagcgcctacctgtacaacaacgaggagcaggtgggcctggccatcagaagcaagatcgccgacggcagcgtgaagagagaggacatcttctacaccagcaagctgtggtgcaccttcttccagccccagatggtgcagcccgccctggagagcagcctgaagaagctgcagctggactacgtggacctgtacctgctgcacttccccatggccctgaagagcaccacctag

SEQ ID NO: 72472 - DNA, 981 bp, Artificial Sequence
  Description of Artificial Sequence: Synthetic coding sequence
atggacctgagcgccgccagccacagaatccccctgagcgacggcaacagcatccccatcatcggcctgggcacctacagcgagcccaagagcacccccaagggcgcctgcgccaccagcgtgaaggtggccatcgacaccggctacagacacatcgacggcgcctacatctaccagaacgagcacgaggtgggcgaggccatcagagagaagatcgccgagggcaaggtgagaagagaggacatcttctactgcggcaagctgtgggccaccaaccacgtgcccgagatggtgagacccaccctggagagaaccctgagagtgctgcagctggactacgtggacctgtacatcatcgaggtgcccatggccttcaagcccggcgacgagatctaccccagagacgagaacggcaagtggctgtaccacaagagcaacctgtgcgccacctgggaggccatggaggcctgcaaggacgccggcctggtgaagagcctgggcgtgagcaacttcaacagaagacagctggagctgatcctgaacaagcccggcctgaagcacaagcccgtgagcaaccaggtggagtgccacccctacttcacccagcccaagctgctgaagttctgccagcagcacgacatcgtgatcaccgcctacagccccctgggcaccagcagaaaccccatctgggtgaacgtgagcagcccccccctgctgaaggacgccctgctgaacagcctgggcaagagatacaacaagaccgccgcccagatcgtgctgagattcaacatccagagaggcgtggtggtgatccccaagagcttcaacctggagagaatcaaggagaacttccagatcttcgacttcagcctgaccgaggaggagatgaaggacatcgaggccctgaacaagaacgtgagattcgtggagctgctgatgtggagagaccaccccgagtaccccttccacgacgagtactag

SEQ ID NO: 72473 - DNA, 441 bp, Artificial Sequence
  Description of Artificial Sequence: Synthetic coding sequence
atggccttcaagcccggcgacgagatctaccccagagacgagaacggcaagtggctgtaccacaagagcaacctgtgcgccacctgggaggccatggaggcctgcaaggacgccggcctggtgaagagcctgggcgtgagcaacttcaacagaagacagctggagctgatcctgaacaagcccggcctgaagcacaagcccgtgagcaaccaggtggagtgccacccctacttcacccagcccaagctgctgaagttctgccagcagcacgacatcgtgatcaccgcctacagccccctgggcaccagcagaaaccccatctggagacagctgcacaagctggccctgctggacctgcccatcctgagagtgaccctgcacagcgtgcacaccctgcacagcgagaagctggtgaccggcgacctgcagtgccccggctag

SEQ ID NO: 72474 - DNA, 672 bp, Artificial Sequence
  Description of Artificial Sequence: Synthetic coding sequence
atggcccacagattccccgccctgacccaggagcagaagaaggacagccagggcaagctgttcagaaacatcctgaaggagaagggcatcgtggtgggcatcaagctggaccagggcggcgcccccctggccggcaccaacaaggagaccaccatccagggcctggacggcctgagcgagagatgcgcccagtacaagaaggacggcgtggacttcggcaagtggagagccgtgctgagaatcgccgaccagtgccccagcagcctggccatccaggagaacgccaacgccctggccagatacgccagcatctgccagcagaacggcctggtgcccatcgtggagcccgaggtgatccccgacggcgaccacgacctggagcactgccagtacgtgaccgagaaggtgctggccgccgtgtacaaggccctgaacgaccaccacgtgtacctggagggcaccctgctgaagcccaacatggtgaccgccggccacgcctgcaccaagaagtacacccccgagcaggtggccatggccaccgtgaccgccctgcacagaaccgtgcccgccgccgtgcccggcatctgcttcctgagcggcggcatgagcgaggaggacgccaccctgaacctgaacgccatccccaccagagtgcagtgcccccccgcctag

SEQ ID NO: 72475 - DNA, 1095 bp, Artificial Sequence
  Description of Artificial Sequence: Synthetic coding sequence
atggcccacagattccccgccctgacccaggagcagaagaaggagctgagcgagatcgcccagagcatcgtggccaacggcaagggcatcctggccgccgacgagagcgtgggcaccatgggcaacagactgcagagaatcaaggtggagaacaccgaggagaacagaagacagttcagagagatcctgttcagcgtggacagcagcatcaaccagagcatcggcggcgtgatcctgttccacgagaccctgtaccagaaggacagccagggcaagctgttcagaaacatcctgaaggagaagggcatcgtggtgggcatcaagctggaccagggcggcgcccccctggccggcaccaacaaggagaccaccatccagggcctggacggcctgagcgagagatgcgcccagtacaagaaggacggcgtggacttcggcaagtggagagccgtgctgagaatcgccgaccagtgccccagcagcctggccatccaggagaacgccaacgccctggccagatacgccagcatctgccagcagaacggcctggtgcccatcgtggagcccgaggtgatccccgacggcgaccacgacctggagcactgccagtacgtgaccgagaaggtgctggccgccgtgtacaaggccctgaacgaccaccacgtgtacctggagggcaccctgctgaagcccaacatggtgaccgccggccacgcctgcaccaagaagtacacccccgagcaggtggccatggccaccgtgaccgccctgcacagaaccgtgcccgccgccgtgcccggcatctgcttcctgagcggcggcatgagcgaggaggacgccaccctgaacctgaacgccatcaacctgtgccccctgcccaagccctggaagctgagcttcagctacggcagagccctgcaggccagcgccctggccgcctggggcggcaaggccgccaacaaggaggccacccaggaggccttcatgaagagagccatggccaactgccaggccgccaagggccagtacgtgcacaccggcagcagcggcgccgccagcacccagagcctgttcaccgcctgctacacctactag

SEQ ID NO: 72476 - DNA, 951 bp, Artificial Sequence
  Description of Artificial Sequence: Synthetic coding sequence
atggcccacagattccccgccctgacccaggagcagaagaaggagctgagcgagatcgcccagagcatcgtggccaacggcaagggcatcctggccgccgacgagagcgtgggcaccatgggcaacagactgcagagaatcaaggtggagaacaccgaggagaacagaagacagttcagagagatcctgttcagcgtggacagcagcatcaaccagagcatcggcggcgtgatcctgttccacgagaccctgtaccagaaggacagccagggcaagctgttcagaaacatcctgaaggagaagggcatcgtggtgggcatcaagctggaccagggcggcgcccccctggccggcaccaacaaggagaccaccatccagggcctggacggcctgagcgagagatgcgcccagtacaagaaggacggcgtggacttcggcaagtggagagccgtgctgagaatcgccgaccagtgccccagcagcctggccatccaggagaacgccaacgccctggccagatacgccagcatctgccagcagaacggcctggtgcccatcgtggagcccgaggtgatccccgacggcgaccacgacctggagcactgccagtacgtgaccgagaaggtgctggccgccgtgtacaaggccctgaacgaccaccacgtgtacctggagggcaccctgctgaagcccaacatggtgaccgccggccacgcctgcaccaagaagtacacccccgagcaggtggccatggccaccgtgaccgccctgcacagaaccgtgcccgccgccgtgcccggcatctgcttcctgagcggcggcatgagcgaggaggacgccaccctgaacctgaacgccatcaacctgtgccccctgcccaagccctggaagctgagcttcagcggcgtggccagactgcagaccagaagacagcccagaagactgctgtag

SEQ ID NO: 72477 - DNA, 1947 bp, Artificial Sequence
  Description of Artificial Sequence: Synthetic coding sequence
atggtgagcctgccccccccccagagcgacgtgaccctgcccggccccaccagactggagggcgagagacagggcgacctgatgcaggcccccggcctgcccggcagccccgccccccagagcaagcacgccggcttcagctgcagcagcttcgtgagcgacggcccccccgagagaacccccagcctgcccccccacagccccagaatcgccagccccggccccgagcaggtgcagggccactgccccgccggccccggccccggccccttcagactgagccccagcgacaagtaccccggcttcggcttcgaggaggccgccgccagcagccccggcagattcctgaagggcagccacgcccccttccacccctacaagagacccttccacgaggacgtgttccccgaggccgagaccaccctggccctgaagggccacagcttcaagacccccggccccctggaggccttcgaggagatccccgtggacgtggccgaggccgaggccttcctgcccggcttcagcgccgaggcctggtgcaacggcctgccctaccccagccaggagcacggcccccaggtgctgggcagcgaggtgaaggtgaagccccccgtgctggagagcggcgccggcatgttctgctaccagccccccctgcagcacatgtactgcagcagccagccccccttccaccagtacagccccggcggcggcagctaccccatcccctacctgggcagcagccactaccagtaccagagaatggccccccaggccagcaccgacggccaccagcccctgttccccaagcccatctacagctacagcatcctgatcttcatggccctgaagaacagcaagaccggcagcctgcccgtgagcgagatctacaacttcatgaccgagcacttcccctacttcaagaccgcccccgacggctggaagaacagcgtgagacacaacctgagcctgaacaagtgcttcgagaaggtggagaacaagagcggcagcagcagcagaaagggctgcctgtgggccctgaaccccgccaagatcgacaagatgcaggaggagctgcagaagtggaagagaaaggaccccatcgccgtgagaaagagcatggccaagcccgaggagctggacagcctgatcggcgacaagagagagaagctgggcagccccctgctgggctgccccccccccggcctgagcggcagcggccccatcagacccctggccccccccgccggcctgagcccccccctgcacagcctgcaccccgcccccggccccatccccggcaagaaccccctgcaggacctgctgatgggccacacccccagctgctacggccagacctacctgcacctgagccccggcctggccccccccggccccccccagcccctgttcccccagcccgacggccacctggagctgagagcccagcccggcaccccccaggacagccccctgcccgcccacaccccccccagccacagcgccaagctgctggccgagcccagccccgccagaaccatgcacgacaccctgctgcccgacggcgacctgggcaccgacctggacgccatcaaccccagcctgaccgacttcgacttccagggcaacctgtgggagcagctgaaggacgacagcctggccctggaccccctggtgctggtgaccagcagccccaccagcagcagcatgccccccccccagccccccccccactgcttcccccccggcccctgcctgaccgagaccggcagcggcgccggcgacctggccgcccccggcagcggcggcagcggcgccctgggcgacctgcacctgaccaccctgtacagcgccttcatggagctggagcccaccccccccaccgcccccgccggccccagcgtgtacctgagccccagcagcaagcccgtggccctggcctag

SEQ ID NO: 72478 - DNA, 1095 bp, Artificial Sequence
  Description of Artificial Sequence: Synthetic coding sequence
atgccccacagctaccccgccctgagcgccgagcagaagaaggagctgagcgacatcgccctgagaatcgtggcccccggcaagggcatcctggccgccgacgagagcgtgggcagcatggccaagagactgagccagatcggcgtggagaacaccgaggagaacagaagactgtacagacaggtgctgttcagcgccgacgacagagtgaagaagtgcatcggcggcgtgatcttcttccacgagaccctgtaccagaaggacgacaacggcgtgcccttcgtgagaaccatccaggacaagggcatcgtggtgggcatcaaggtggacaagggcgtggtgcccctggccggcaccgacggcgagaccaccacccagggcctggacggcctgagcgagagatgcgcccagtacaagaaggacggcgccgacttcgccaagtggagatgcgtgctgaagatcagcgagagaacccccagcgccctggccatcctggagaacgccaacgtgctggccagatacgccagcatctgccagcagaacggcatcgtgcccatcgtggagcccgagatcctgcccgacggcgaccacgacctgaagagatgccagtacgtgaccgagaaggtgctggccgccgtgtacaaggccctgagcgaccaccacgtgtacctggagggcaccctgctgaagcccaacatggtgacccccggccacgcctgccccatcaagtacacccccgaggagatcgccatggccaccgtgaccgccctgagaagaaccgtgccccccgccgtgcccggcgtgaccttcctgagcggcggccagagcgaggaggaggccagcttcaacctgaacgccatcaacagatgccccctgcccagaccctgggccctgaccttcagctacggcagagccctgcaggccagcgccctgaacgcctggagaggccagagagacaacgccggcgccgccaccgaggagttcatcaagagagccgaggtgaacggcctggccgcccagggcaagtacgagggcagcggcgaggacggcggcgccgccgcccagagcctgtacatcgccaaccacgcctactag

SEQ ID NO: 72479 - DNA, 450 bp, Artificial Sequence
  Description of Artificial Sequence: Synthetic coding sequence
atgccccacagctaccccgccctgagcgccgagcagaagaaggagctgagcgacatcgccctgagaatcgtggcccccggcaagggcatcctggccgccgacgagagcgtgggcagcatggccaagagactgagccagatcggcgtggagaacaccgaggagaacagaagactgtacagacaggtgctgttcagcgccgacgacagagtgaagaagtgcatcggcggcgtgatcttcttccacgagaccctgtaccagaaggacgacaacggcgtgcccttcgtgagaaccatccaggacaagggcatcgtggtgggcatcaaggtggacaagggcgtggtgcccctggccggcaccgacggcgagaccaccacccagggcctggacggcctgagcgagagatgcgcccagtacaagaaggacggcgccgacttcgccaagtggagatag

SEQ ID NO: 72480 - DNA, 795 bp, Artificial Sequence
  Description of Artificial Sequence: Synthetic coding sequence
atgcccagcatcttcgcctaccagagcagcgaggtggactggtgcgagagcaacttccagtacagcgagctggtggccgagttctacaacaccttcagcaacatccccttcttcatcttcggccccctgatgatgctgctgatgcacccctacgcccagaagagaagcagatacatctacgtggtgtgggtgctgttcatgatcatcggcctgttcagcatgtacttccacatgaccctgagcttcctgggccagctgctggacgagatcgccatcctgtggctgctgggcagcggctacagcatctggatgcccagatgctacttccccagcttcctgggcggcaacagaagccagttcatcagactggtgttcatcaccaccgtggtgagcaccctgctgagcttcctgagacccaccgtgaacgcctacgccctgaacagcatcgccctgcacatcctgtacatcgtgtgccaggagtacagaaagaccagcaacaaggagctgagacacctgatcgaggtgagcgtggtgctgtgggccgtggccctgaccagctggatcagcgacagactgctgtgcagcttctggcagagaatccacttcttctacctgcacagcatctggcacgtgctgatcagcatcaccttcccctacggcatggtgaccatggccctggtggacgccaactacgagatgcccggcgagaccctgaaggtgagatactggcccagagacagctggcccgtgggcctgccctacgtggagatcagaggcgacgacaaggactgctag

SEQ ID NO: 72481 - DNA, 828 bp, Artificial Sequence
  Description of Artificial Sequence: Synthetic coding sequence
atgggcgccccccactggtgggaccagctgcaggccggcagcagcgaggtggactggtgcgaggacaactacaccatcgtgcccgccatcgccgagttctacaacaccatcagcaacgtgctgttcttcatcctgccccccatctgcatgtgcctgttcagacagtacgccacctgcttcaacagcggcatctacctgatctggaccctgctggtggtggtgggcatcggcagcgtgtacttccacgccaccctgagcttcctgggccagatgctggacgagctggccgtgctgtgggtgctgatgtgcgccctggccatgtggttccccagaagatacctgcccaagatcttcagaaacgacagaggcagattcaaggtggtggtgagcgtgctgagcgccgtgaccacctgcctggccttcgtgaagcccgccatcaacaacatcagcctgatgaccctgggcgtgccctgcaccgccctgctgatcgccgagctgaagagatgcgacaacatgagagtgttcaagctgggcctgttcagcggcctgtggtggaccctggccctgttctgctggatcagcgacagagccttctgcgagctgctgagcagcttcaacttcccctacctgcactgcatgtggcacatcctgatctgcctggccgcctacctgggctgcgtgtgcttcgcctacttcgacgccgccagcgagatccccgagcagggccccgtgatcaagttctggcccaacgagaagtgggccttcatcggcgtgccctacgtgagcctgctgtgcgccaacaagaagagcagcgtgaagatcacctag

SEQ ID NO: 72482 - DNA, 423 bp, Artificial Sequence
  Description of Artificial Sequence: Synthetic coding sequence
atgtgcctgttcagacagtacgccacctgcttcaacagcggcatctacctgatctggaccctgctggtggtggtgggcatcggcagcgtgtacttccacgccaccctgagcttcctgggccagatgctggacgagctggccgtgctgtgggtgctgatgtgcgccctggccatgtggttccccagaagatacctgcccaagatcttcagaaacgacagaggcagattcaaggtggtggtgagcgtgctgagcgccgtgaccacctgcctggccttcgtgaagcccgccatcaacaacatcagcctgatgaccctgggcgtgccctgcaccgccctgctgatcgccgagctgaagagacacgagagaaaccagagaagaagacacagaaagggcggccagcagggcggcggcgacaaggtgtag

SEQ ID NO: 72483 - DNA, 1587 bp, Artificial Sequence
  Description of Artificial Sequence: Synthetic coding sequence
atgcagggcccctgggtgctgctgctgctgggcctgagactgcagctgagcctgggcgtgatccccgccgaggaggagaaccccgccttctggaacagacaggccgccgaggccctggacgccgccaagaagctgcagcccatccagaaggtggccaagaacctgatcctgttcctgggcgacggcctgggcgtgcccaccgtgaccgccaccagaatcctgaagggccagaagaacggcaagctgggccccgagacccccctggccatggacagattcccctacctggccctgagcaagacctacaacgtggacagacaggtgcccgacagcgccgccaccgccaccgcctacctgtgcggcgtgaaggccaacttccagaccatcggcctgagcgccgccgccagattcaaccagtgcaacaccaccagaggcaacgaggtgatcagcgtgatgaacagagccaagcaggccggcaagagcgtgggcgtggtgaccaccaccagagtgcagcacgccagccccgccggcacctacgcccacaccgtgaacagaaactggtacagcgacgccgacatgcccgccagcgccagacaggagggctgccaggacatcgccacccagctgatcagcaacatggacatcgacgtgatcctgggcggcggcagaaagtacatgttccccatgggcacccccgaccccgagtaccccgccgacgccagccagaacggcatcagactggacggcaagaacctggtgcaggagtggctggccaagcaccagggcgcctggtacgtgtggaacagaaccgagctgatgcaggccagcctggaccagagcgtgacccacctgatgggcctgttcgagcccggcgacaccaagtacgagatccacagagaccccaccctggaccccagcctgatggagatgaccgaggccgccctgagactgctgagcagaaaccccagaggcttctacctgttcgtggagggcggcagaatcgaccacggccaccacgagggcgtggcctaccaggccctgaccgaggccgtgatgttcgacgacgccatcgagagagccggccagctgaccagcgaggaggacaccctgaccctggtgaccgccgaccacagccacgtgttcagcttcggcggctacaccctgagaggcagcagcatcttcggcctggcccccagcaaggcccaggacagcaaggcctacaccagcatcctgtacggcaacggccccggctacgtgttcaacagcggcgtgagacccgacgtgaacgagagcgagagcggcagccccgactaccagcagcaggccgccgtgcccctgagcagcgagacccacggcggcgaggacgtggccgtgttcgccagaggcccccaggcccacctggtgcacggcgtgcaggagcagagcttcgtggcccacgtgatggccttcgccgcctgcctggagccctacaccgcctgcgacctggccccccccgcctgcaccaccgacgccgcccaccccgtggccgccagcctgcccctgctggccggcaccctgctgctgctgggcgccagcgccgccccctag

SEQ ID NO: 72484 - DNA, 513 bp, Artificial Sequence
  Description of Artificial Sequence: Synthetic coding sequence
atggacagagccatcggccaggccggcagcctgaccagcagcgaggacaccctgaccgtggtgaccgccgaccacagccacgtgttcaccttcggcggctacacccccagaggcaacagcatcttcggcctggcccccatgctgagcgacaccgacaagaagcccttcaccgccatcctgtacggcaacggccccggctacaaggtggtgggcggcgagagagagaacgtgagcatggtggactacgcccacaacaactaccaggcccagagcgccgtgcccctgagacacgagacccacggcggcgaggacgtggccgtgttcagcaagggccccatggcccacctgctgcacggcgtgcacgagcagaactacgtgccccacgtgatggcctacgccgcctgcatcggcgccaacctgggccactgcgcccccgccagcagcgccggcagcctggccgccggccccctgctgctggccctggccctgtaccccctgagcgtgctgttctag

SEQ ID NO: 72485 - DNA, 513 bp, Artificial Sequence; identical to SEQ ID NO: 72484
  Description of Artificial Sequence: Synthetic coding sequence

SEQ ID NO: 72486 - DNA, 1575 bp, Artificial Sequence
  Description of Artificial Sequence: Synthetic coding sequence
atgatcagccccttcctggtgctggccatcggcacctgcctgaccaacagcctggtgcccgagaaggagaaggaccccaagtactggagagaccaggcccaggagaccctgaagtacgccctggagctgcagaagctgaacaccaacgtggccaagaacgtgatcatgttcctgggcgacggcatgggcgtgagcaccgtgaccgccgccagaatcctgaagggccagctgcaccacaaccccggcgaggagaccagactggagatggacaagttccccttcgtggccctgagcaagacctacaacaccaacgcccaggtgcccgacagcgccggcaccgccaccgcctacctgtgcggcgtgaaggccaacgagggcaccgtgggcgtgagcgccgccaccgagagaagcagatgcaacaccacccagggcaacgaggtgaccagcatcctgagatgggccaaggacgccggcaagagcgtgggcatcgtgaccaccaccagagtgaaccacgccacccccagcgccgcctacgcccacagcgccgacagagactggtacagcgacaacgagatgccccccgaggccctgagccagggctgcaaggacatcgcctaccagctgatgcacaacatcagagacatcgacgtgatcatgggcggcggcagaaagtacatgtaccccaagaacaagaccgacgtggagtacgagagcgacgagaaggccagaggcaccagactggacggcctggacctggtggacacctggaagagcttcaagcccagatacaagcacagccacttcatctggaacagaaccgagctgctgaccctggacccccacaacgtggactacctgctgggcctgttcgagcccggcgacatgcagtacgagctgaacagaaacaacgtgaccgaccccagcctgagcgagatggtggtggtggccatccagatcctgagaaagaaccccaagggcttcttcctgctggtggagggcggcagaatcgaccacggccaccacgagggcaaggccaagcaggccctgcacgaggccgtggagatggacagagccatcggccaggccggcagcctgaccagcagcgaggacaccctgaccgtggtgaccgccgaccacagccacgtgttcaccttcggcggctacacccccagaggcaacagcatcttcggcctggcccccatgctgagcgacaccgacaagaagcccttcaccgccatcctgtacggcaacggccccggctacaaggtggtgggcggcgagagagagaacgtgagcatggtggactacgcccacaacaactaccaggcccagagcgccgtgcccctgagacacgagacccacggcggcgaggacgtggccgtgttcagcaagggccccatggcccacctgctgcacggcgtgcacgagcagaactacgtgccccacgtgatggcctacgccgcctgcatcggcgccaacctgggccactgcgcccccgccagcagcgccggcagcctggccgccggccccctgctgctggccctggccctgtaccccctgagcgtgctgttctag

SEQ ID NO: 72487 - DNA, 1575 bp, Artificial Sequence; identical to SEQ ID NO: 72486
  Description of Artificial Sequence: Synthetic coding sequence

SEQ ID NO: 72488 - DNA, 1575 bp, Artificial Sequence; identical to SEQ ID NO: 72486
  Description of Artificial Sequence: Synthetic coding sequence

SEQ ID NO: 72489 - DNA, 1344 bp, Artificial Sequence
  Description of Artificial Sequence: Synthetic coding sequence
atgccctggagcttcagaagcagcacccccacctggctgagaatgagcagctgcagctgggagatgacctacaacaccaacgcccaggtgcccgacagcgccggcaccgccaccgcctacctgtgcggcgtgaaggccaacgagggcaccgtgggcgtgagcgccgccaccgagagaagcagatgcaacaccacccagggcaacgaggtgaccagcatcctgagatgggccaaggacgccggcaagagcgtgggcatcgtgaccaccaccagagtgaaccacgccacccccagcgccgcctacgcccacagcgccgacagagactggtacagcgacaacgagatgccccccgaggccctgagccagggctgcaaggacatcgcctaccagctgatgcacaacatcagagacatcgacgtgatcatgggcggcggcagaaagtacatgtaccccaagaacaagaccgacgtggagtacgagagcgacgagaaggccagaggcaccagactggacggcctggacctggtggacacctggaagagcttcaagcccagatacaagcacagccacttcatctggaacagaaccgagctgctgaccctggacccccacaacgtggactacctgctgggcctgttcgagcccggcgacatgcagtacgagctgaacagaaacaacgtgaccgaccccagcctgagcgagatggtggtggtggccatccagatcctgagaaagaaccccaagggcttcttcctgctggtggagggcggcagaatcgaccacggccaccacgagggcaaggccaagcaggccctgcacgaggccgtggagatggacagagccatcggccaggccggcagcctgaccagcagcgaggacaccctgaccgtggtgaccgccgaccacagccacgtgttcaccttcggcggctacacccccagaggcaacagcatcttcggcctggcccccatgctgagcgacaccgacaagaagcccttcaccgccatcctgtacggcaacggccccggctacaaggtggtgggcggcgagagagagaacgtgagcatggtggactacgcccacaacaactaccaggcccagagcgccgtgcccctgagacacgagacccacggcggcgaggacgtggccgtgttcagcaagggccccatggcccacctgctgcacggcgtgcacgagcagaactacgtgccccacgtgatggcctacgccgcctgcatcggcgccaacctgggccactgcgcccccgccagcagcgccggcagcctggccgccggccccctgctgctggccctggccctgtaccccctgagcgtgctgttctag

SEQ ID NO: 72490 - DNA, 1410 bp, Artificial Sequence
  Description of Artificial Sequence: Synthetic coding sequence
atgttcctgggcgacggcatgggcgtgagcaccgtgaccgccgccagaatcctgaagggccagctgcaccacaaccccggcgaggagaccagactggagatggacaagttccccttcgtggccctgagcaagacctacaacaccaacgcccaggtgcccgacagcgccggcaccgccaccgcctacctgtgcggcgtgaaggccaacgagggcaccgtgggcgtgagcgccgccaccgagagaagcagatgcaacaccacccagggcaacgaggtgaccagcatcctgagatgggccaaggacgccggcaagagcgtgggcatcgtgaccaccaccagagtgaaccacgccacccccagcgccgcctacgcccacagcgccgacagagactggtacagcgacaacgagatgccccccgaggccctgagccagggctgcaaggacatcgcctaccagctgatgcacaacatcagagacatcgacgtgatcatgggcggcggcagaaagtacatgtaccccaagaacaagaccgacgtggagtacgagagcgacgagaaggccagaggcaccagactggacggcctggacctggtggacacctggaagagcttcaagcccagatacaagcacagccacttcatctggaacagaaccgagctgctgaccctggacccccacaacgtggactacctgctgggcctgttcgagcccggcgacatgcagtacgagctgaacagaaacaacgtgaccgaccccagcctgagcgagatggtggtggtggccatccagatcctgagaaagaaccccaagggcttcttcctgctggtggagggcggcagaatcgaccacggccaccacgagggcaaggccaagcaggccctgcacgaggccgtggagatggacagagccatcggccaggccggcagcctgaccagcagcgaggacaccctgaccgtggtgaccgccgaccacagccacgtgttcaccttcggcggctacacccccagaggcaacagcatcttcggcctggcccccatgctgagcgacaccgacaagaagcccttcaccgccatcctgtacggcaacggccccggctacaaggtggtgggcggcgagagagagaacgtgagcatggtggactacgcccacaacaactaccaggcccagagcgccgtgcccctgagacacgagacccacggcggcgaggacgtggccgtgttcagcaagggccccatggcccacctgctgcacggcgtgcacgagcagaactacgtgccccacgtgatggcctacgccgcctgcatcggcgccaacctgggccactgcgcccccgccagcagcgccggcagcctggccgccggccccctgctgctggccctggccctgtaccccctgagcgtgctgttctag

SEQ ID NO: 72491 - DNA, 1608 bp, Artificial Sequence
  Description of Artificial Sequence: Synthetic coding sequence
atgctgggcccctgcatgctgctgctgctgctgctgctgggcctgagactgcagctgagcctgggcatcatccccgtggaggaggagaaccccgacttctggaacagagaggccgccgaggccctgggcgccgccaagaagctgcagcccgcccagaccgccgccaagaacctgatcatcttcctgggcgacggcatgggcgtgagcaccgtgaccgccgccagaatcctgaagggccagaagaaggacaagctgggccccgagatccccctggccatggacagattcccctacgtggccctgagcaagacctacaacgtggacaagcacgtgcccgacagcggcgccaccgccaccgcctacctgtgcggcgtgaagggcaacttccagaccatcggcctgagcgccgccgccagattcaaccagtgcaacaccaccagaggcaacgaggtgatcagcgtgatgaacagagccaagaaggccggcaagagcgtgggcgtggtgaccaccaccagagtgcagcacgccagccccgccggcacctacgcccacaccgtgaacagaaactggtacagcgacgccgacgtgcccgccagcgccagacaggagggctgccaggacatcgccacccagctgatcagcaacatggacatcgacgtgatcctgggcggcggcagaaagtacatgttcagaatgggcacccccgaccccgagtaccccgacgactacagccagggcggcaccagactggacggcaagaacctggtgcaggagtggctggccaagagacagggcgccagatacgtgtggaacagaaccgagctgatgcaggccagcctggaccccagcgtgacccacctgatgggcctgttcgagcccggcgacatgaagtacgagatccacagagacagcaccctggaccccagcctgatggagatgaccgaggccgccctgagactgctgagcagaaaccccagaggcttcttcctgttcgtggagggcggcagaatcgaccacggccaccacgagagcagagcctacagagccctgaccgagaccatcatgttcgacgacgccatcgagagagccggccagctgaccagcgaggaggacaccctgagcctggtgaccgccgaccacagccacgtgttcagcttcggcggctaccccctgagaggcagcagcatcttcggcctggcccccggcaaggccagagacagaaaggcctacaccgtgctgctgtacggcaacggccccggctacgtgctgaaggacggcgccagacccgacgtgaccgagagcgagagcggcagccccgagtacagacagcagagcgccgtgcccctggacgaggagacccacgccggcgaggacgtggccgtgttcgccagaggcccccaggcccacctggtgcacggcgtgcaggagcagaccttcatcgcccacgtgatggccttcgccgcctgcctggagccctacaccgcctgcgacctggccccccccgccggcaccaccgacgccgcccaccccggcagaagcgtggtgcccgccctgctgcccctgctggccggcaccctgctgctgctggagaccgccaccgccccctag

SEQ ID NO: 72492 - DNA, 1599 bp, Artificial Sequence
  Description of Artificial Sequence: Synthetic coding sequence
atgcagggcccctgggtgctgctgctgctgggcctgagactgcagctgagcctgggcatcatccccgtggaggaggagaaccccgacttctggaacagacaggccgccgaggccctgggcgccgccaagaagctgcagcccgcccagaccgccgccaagaacctgatcatcttcctgggcgacggcatgggcgtgagcaccgtgaccgccgccagaatcctgaagggccagaagaaggacaagctgggccccgagaccttcctggccatggacagattcccctacgtggccctgagcaagacctacagcgtggacaagcacgtgcccgacagcggcgccaccgccaccgcctacctgtgcggcgtgaagggcaacttccagaccatcggcctgagcgccgccgccagattcaaccagtgcaacaccaccagaggcaacgaggtgatcagcgtgatgaacagagccaagaaggccggcaagagcgtgggcgtggtgaccaccaccagagtgcagcacgccagccccgccggcgcctacgcccacaccgtgaacagaaactggtacagcgacgccgacgtgcccgccagcgccagacaggagggctgccaggacatcgccacccagctgatcagcaacatggacatcgacgtgatcctgggcggcggcagaaagtacatgttccccatgggcacccccgaccccgagtaccccgacgactacagccagggcggcaccagactggacggcaagaacctggtgcaggagtggctggccaagcaccagggcgccagatacgtgtggaacagaaccgagctgctgcaggccagcctggaccccagcgtgacccacctgatgggcctgttcgagcccggcgacatgaagtacgagatccacagagacagcaccctggaccccagcctgatggagatgaccgaggccgccctgctgctgctgagcagaaaccccagaggcttcttcctgttcgtggagggcggcagaatcgaccacggccaccacgagagcagagcctacagagccctgaccgagaccatcatgttcgacgacgccatcgagagagccggccagctgaccagcgaggaggacaccctgagcctggtgaccgccgaccacagccacgtgttcagcttcggcggctaccccctgagaggcagcagcatcttcggcctggcccccggcaaggccagagacagaaaggcctacaccgtgctgctgtacggcaacggccccggctacgtgctgaaggacggcgccagacccgacgtgaccgagagcgagagcggcagccccgagtacagacagcagagcgccgtgcccctggacggcgagacccacgccggcgaggacgtggccgtgttcgccagaggcccccaggcccacctggtgcacggcgtgcaggagcagaccttcatcgcccacgtgatggccttcgccgcctgcctggagccctacaccgcctgcgacctggcccccagagccggcaccaccgacgccgcccaccccggccccagcgtggtgcccgccctgctgcccctgctggccggcaccctgctgctgctgggcaccgccaccgccccctag

SEQ ID NO: 72493 - DNA, 474 bp, Artificial Sequence
  Description of Artificial Sequence: Synthetic coding sequence
atggacagattcctggtgaagggcgcccagggcggcctgctgagaaagcaggaggagcaggagcccaccggcgaggagcccgccgtgctgggcggcgacaaggagagcaccagaaagagacccagaagagaggcccccggcaacggcggccacagcgccggccccagctggagacacatcagagccgagggcctggactgcagctacaccgtgctgttcggcaaggccgaggccgacgagatcttccaggagctggagaaggaggtggagtacttcaccggcatcaagatggccgtgaccaccagcggcagcaccgagatgatgaaggagaactggcccctgggcgcccccctgcccctgagccccagcgtgcccgccgagaccctgagcagcggcatcagaatccccgtgggcaaggccccccccggcggctggagatggagcggctgcagatggcccaccggcgcctactag

SEQ ID NO: 72494 - DNA, 2958 bp, Artificial Sequence
  Description of Artificial Sequence: Synthetic coding sequence
atgatcagacacgccggcgcccccgccagaggcgaccccaccggccccgtgcccgtggtgggcaagggcgaggaggaggaggaggaggacggcatgagactgtgcctgcccgccaaccccaagaactgcctgccccacagaagaggcatcagcatcctggagaagctgatcaagacctgccccgtgtggctgcagctgagcctgggccaggccgaggtggccagaatcctgcacagagtggtggccggcatgttcctggtgagaagagacagcagcagcaagcagctggtgctgtgcgtgcacttccccagcctgaacgagagcagcgccgaggtgctggagtacaccatcaaggaggagaagagcatcctgtacctggagggcagcgccctggtgttcgaggacatcttcagactgatcgccttctactgcgtgagcagagacctgctgcccttcaccctgagactgccccaggccatcctggaggccagcagcttcaccgacctggagaccatcgccaacctgggcctgggcttctgggacagcagcctgaaccccccccaggagagaggcaagcccgccgagccccccagagacagagcccccggcttccccctggtgagcagcctgagacccaccgcccacgacgccaactgcgcctgcgagatcgagctgagcgtgggcaacgacagactgtggttcgtgaaccccatcttcatcgaggactgcagcagcgccctgcccaccgaccagccccccctgggcaactgccccgccagacccctgccccccaccagcgacgccaccagccccaccagcagatgggcccccagaagaccccccccccccccccccgtgctgcccctgcagccctgcagccccgcccagccccccgtgctgcccgccctggcccccgcccccgcctgccccctgcccaccagcccccccgtgcccgccccccacgtgaccccccacgcccccggcccccccgaccaccccaaccagccccccatgatgacctgcgagagactgccctgccccaccgccggcctgggccccctgagagaggaggccatgaagcccggcgccgccagcagccccctgcagcaggtgcccgccccccccctgcccgccaagaagaacctgcccaccgccccccccagaagaagagtgagcgagagagtgagcctggaggaccagagccccggcatggccgccgagggcgaccagctgagcctgcccccccagggcaccagcgacggccccgaggacacccccagagagagcaccgagcagggccaggacaccgaggtgaaggccagcgacccccacagcatgcccgagctgcccagaaccgccaagcagccccccgtgcccccccccagaaagaagagaatcagcagacagctggccagcaccctgcccgcccccctggagaacgccgagctgtgcacccaggccatggccctggagacccccacccccggcccccccagagagggccagagccccgccagccaggccggcacccagcacccccccgcccaggccaccgcccacagccagagcagccccgagttcaagggcagcctggccagcctgagcgacagcctgggcgtgagcgtgatggccaccgaccaggacagctacagcaccagcagcaccgaggaggagctggagcagttcagcagccccagcgtgaagaagaagcccagcatgatcctgggcaaggccagacacagactgagcttcgccagcttcagcagcatgttccacgccttcctgagcaacaacagaaagctgtacaagaaggtggtggagctggcccaggacaagggcagctacttcggcagcctggtgcaggactacaaggtgtacagcctggagatgatggccagacagaccagcagcaccgagatgctgcaggagatcagaaccatgatgacccagctgaagagctacctgctgcagagcaccgagctgaaggccctggtggaccccgccctgcacagcgaggaggagctggaggccatcgtggagagcgccctgtacaagtgcgtgctgaagcccctgaaggaggccatcaacagctgcctgcaccagatccacagcaaggacggcagcctgcagcagctgaaggagaaccagctggtgatcctggccaccaccaccaccgacctgggcgtgaccaccagcgtgcccgaggtgcccatgatggagaagatcctgcagaagttcaccagcatgcacaaggcctacagccccgagaagaagatcagcatcctgctgaagacctgcaagctgatctacgacagcatggccctgggcaaccccggcaagccctacggcgccgacgacttcctgcccgtgctgatgtacgtgctggccagaagcaacctgaccgagatgctgctgaacgtggagtacatgatggagctgatggaccccgccctgcagctgggcgagggcagctactacctgaccaccacctacggcgccctggagcacatcaagagctacgacaagatcaccgtgaccagacagctgagcgtggaggtgcaggacagcatccacagatgggagagaagaagaaccctgaacaaggccagagccagcagaagcagcgtgcaggacttcatctgcgtgagctacctggagcccgagcagcaggccagaaccctggccagcagagccgacacccaggcccaggccctgtgcgcccagtgcgccgagaagttcgccgtggagagaccccaggcccacagactgttcgtgctggtggacggcagatgcttccagctggccgacgacgccctgccccactgcatcaagggctacctgctgagaagcgagcccaagagagacttccacttcgtgtacagacccctggacggcggcggcggcggcggcggcggcagccccccctgcctggtggtgagagagcccaacttcctgtag

SEQ ID NO: 72495 - DNA, 786 bp, Artificial Sequence
  Description of Artificial Sequence: Synthetic coding sequence
atggacagattcctggtgaagggcgcccagggcggcctgctgagaaagcaggaggagcaggagcccaccggcgaggagcccgccgtgctgggcggcgacaaggagagcaccagaaagagacccagaagagaggcccccggcaacggcggccacagcgccggccccagctggagacacatcagagccgagggcctggactgcagctacaccgtgctgttcggcaaggccgaggccgacgagatcttccaggagctggagaaggaggtggagtacttcaccggcgccctggccagagtgcaggtgttcggcaagtggcacagcgtgcccagaaagcaggccacctacggcgacgccggcctgacctacaccttcagcggcctgaccctgagccccaagccctggatccccgtgctggagagaatcagagaccacgtgagcggcgtgaccggccagaccttcaacttcgtgctgatcaacagatacaaggacggctgcgaccacatcggcgagcacagagacgacgagagagagctggcccccggcagccccatcgccagcgtgagcttcggcgcctgcagagacttcgtgttcagacacaaggacagcagaggcaagagccccagcagaagagtggccgtggtgagactgcccctggcccacggcagcctgctgatgatgaaccaccccaccaacacccactggtaccacagcctgcccgtgagaaagaaggtgctggcccccagagtgaacctgaccttcagaaagatcctgctgaccaagaagtag

SEQ ID NO: 72496 - DNA, 786 bp, Artificial Sequence; identical to SEQ ID NO: 72495
  Description of Artificial Sequence: Synthetic coding sequence

SEQ ID NO: 72497 - DNA, 786 bp, Artificial Sequence; identical to SEQ ID NO: 72495
  Description of Artificial Sequence: Synthetic coding sequence

SEQ ID NO: 72498 - DNA, 453 bp, Artificial Sequence
  Description of Artificial Sequence: Synthetic coding sequence
atggacagattcctggtgaagggcgcccagggcggcctgctgagaaagcaggaggagcaggagcccaccggcgaggagcccgccgtgctgggcggcgacaaggagagcaccagaaagagacccagaagagaggcccccggcaacggcggccacagcgccggccccagctggagacacatcagagccgagggcctggactgcagctacaccgtgctgttcggcaaggccgaggccgacgagatcttccaggagctggagaaggaggtggagtacttcaccggcgccctggccagagtgcaggtgttcggcaagtggcacagcgtgcccagaaagcaggccacctacggcgacgccggcctgacctacaccttcagcggcctgaccctgagccccaagccctggatccccgtgctggagagaatcagagaccacgtgagcggcgtgaccggctag

SEQ ID NO: 72499 - DNA, 366 bp, Artificial Sequence
  Description of Artificial Sequence: Synthetic coding sequence
atggacagattcctggtgaagggcgcccagggcggcctgctgagaaagcaggaggagcaggagcccaccggcgaggagcccgccgtgctgggcggcgacaaggagagcaccagaaagagacccagaagagaggcccccggcaacggcggccacagcgccggccccagctggagacacatcagagccgagggcctggactgcagctacaccgtgctgttcggcaaggccgaggccgacgagatcttccaggagctggagaaggaggtggagtacttcaccggcgccctggccagagtgcaggtgttcggcaagtggcacagcgtgcccagaaagcaggccacctacggcgacgccggcctgacctag

SEQ ID NO: 72500 - DNA, 483 bp, Artificial Sequence
  Description of Artificial Sequence: Synthetic coding sequence
atggacagattcctggtgaagggcgcccagggcggcctgctgagaaagcaggaggagcaggagcccaccggcgaggagcccgccgtgctgggcggcgacaaggagagcaccagaaagagacccagaagagaggcccccggcaacggcggccacagcgccggccccagctggagacacatcagagccgagggcctggactgcagctacaccgtgctgttcggcaaggccgaggccgacgagatcttccaggagctggagaaggaggtggagtacttcaccggcgccctggccagagtgcaggtgttcggcaagtggcacagcgtgcccagaaagcaggccacctacggcgacgccggcctgacctacaccttcagcggcctgaccctgagccccaagccctggatccccgtgctggagagaatcagagaccacgtgagcggcgtgaccggccagaccttcaacttcgtgctgatcaacagatag

SEQ ID NO: 72501 - DNA, 861 bp, Artificial Sequence
  Description of Artificial Sequence: Synthetic coding sequence
atggaggagaagagaagaagagccagagtgcagggcgcctgggccgcccccgtgaagagccaggccatcgcccagcccgccaccaccgccaagagccacctgcaccagaagcccggccagacctggaagaacaaggagcaccacctgagcgacagagagttcgtgttcaaggagccccagcaggtggtgagaagagcccccgagcccagagtgatcgacagagagggcgtgtacgagatcagcctgagccccaccggcgtgagcagagtgtgcctgtaccccggcttcgtggacgtgaaggaggccgactggatcctggagcagctgtgccaggacgtgccctggaagcagagaaccggcatcagagaggacatcacctaccagcagcccagactgaccgcctggtacggcgagctgccctacacctacagcagaatcaccatggagcccaacccccactggcaccccgtgctgagaaccctgaagaacagaatcgaggagaacaccggccacaccttcaacagcctgctgtgcaacctgtacagaaacgagaaggacagcgtggactggcacagcgacgacgagcccagcctgggcagatgccccatcatcgccagcctgagcttcggcgccaccagaaccttcgagatgagaaagaagcccccccccgaggagaacggcgactacacctacgtggagagagtgaagatccccctggaccacggcaccctgctgatcatggagggcgccacccaggccgactggcagcacagagtgcccaaggagtaccacagcagagagcccagagtgaacctgaccttcagaaccgtgtaccccgaccccagaggcgccccctggtag

SEQ ID NO: 72502 - DNA, 513 bp, Artificial Sequence
  Description of Artificial Sequence: Synthetic coding sequence
atggaggagaagagaagaagagccagagtgcagggcgcctgggccgcccccgtgaagagccaggccatcgcccagcccgccaccaccgccaagagccacctgcaccagaagcccggccagacctggaagaacaaggagcaccacctgagcgacagagagttcgtgttcaaggagccccagcaggtggtgagaagagcccccgagcccagagtgatcgaggagggcgtgtacgagatcagcctgagccccaccggcgtgagcagagtgtgcctgtaccccggcttcgtggacgtgaaggaggccgactggatcctggagcagctgtgccaggacgtgccctggaagcagagaaccggcatcagagaggacagcatcctgcagctgaccttcaagaagagcgcccccgtgagcggcaccgccaccgccccccagagctgctggtacgagagacccagccccccccacatccccggccccgccatcctgaccagaaccagactgtgggccccctag

SEQ ID NO: 72503 - DNA, 183 bp, Artificial Sequence
  Description of Artificial Sequence: Synthetic coding sequence
atggaggagaagagaagaagagccagagtgcagggcgcctgggccgcccccgtgaagagccaggccatcgcccagcccgccaccaccgccaagagccacctgcaccagaagcccggccagacctggaagaacaaggagcaccacctgagcgacagagagttcgtgttcaaggagccccagtag

SEQ ID NO: 72504 - DNA, 909 bp, Artificial Sequence
  Description of Artificial Sequence: Synthetic coding sequence
atggccgccgccgccgccgagacccccgaggtgctgagagagtgcggctgcaagggcatcagaacctgcctgatctgcgagagacagagaggcagcgaccccccctgggagctgccccccgccaagacctacagattcatctactgcagcgacaccggctgggccgtgggcaccgaggagagcgacttcgagggctgggccttccccttccccggcgtgatgctgatcgaggacttcgtgaccagagaggaggaggccgagctggtgagactgatggacagagacccctggaagctgagccagagcggcagaagaaagcaggactacggccccaaggtgaacttcagaaagcagaagctgaagaccgagggcttctgcggcctgcccagcttcagcagagaggtggtgagaagaatgggcctgtaccccggcctggagggcttcagacccgtggagcagtgcaacctggactactgccccgagagaggcagcgccatcgacccccacctggacgacgcctggctgtggggcgagagactggtgagcctgaacctgctgagccccaccgtgctgagcatgtgcagagaggcccccggcagcctgctgctgtgcagcgcccccagcgccgcccccgaggccctggtggacagcgtgatcgcccccagcagaagcgtgctgtgccaggaggtggaggtggccatccccctgcccgccagaagcctgctggtgctgaccggcgccgccagacaccagtggaagcacgccatccacagaagacacatcgaggccagaagagtgtgcgtgaccttcagagagctgagcgccgagttcggccccggcggcagacagcaggagctgggccaggagctgctgagaatcgccctgagcttccagggcagacccgtgtag

SEQ ID NO: 72505 - DNA, 1377 bp, Artificial Sequence
  Description of Artificial Sequence: Synthetic coding sequence
atggccgccgccagcggctacaccgacctgagagagaagctgaagagcatgaccagcagagacaactacaaggccggcagcagagaggccgccgccgccgccgccgccgccgtggccgccgccgccgccgccgccgccgccgccgagccctaccccgtgagcggcgccaagagaaagtaccaggaggacagcgaccccgagagaagcgactacgaggagcagcagctgcagaaggaggaggaggccagaaaggtgaagagcggcatcagacagatgagactgttcagccaggacgagtgcgccaagatcgaggccagaatcgacgaggtggtgagcagagccgagaagggcctgtacaacgagcacaccgtggacagagcccccctgagaaacaagtacttcttcggcgagggctacacctacggcgcccagctgcagaagagaggccccggccaggagagactgtacccccccggcgacgtggacgagatccccgagtgggtgcaccagctggtgatccagaagctggtggagcacagagtgatccccgagggcttcgtgaacagcgccgtgatcaacgactaccagcccggcggctgcatcgtgagccacgtggaccccatccacatcttcgagagacccatcgtgagcgtgagcttcttcagcgacagcgccctgtgcttcggctgcaagttccagttcaagcccatcagagtgagcgagcccgtgctgagcctgcccgtgagaagaggcagcgtgaccgtgctgagcggctacgccgccgacgagatcacccactgcatcagaccccaggacatcaaggagagaagagccgtgatcatcctgagaaagaccagactggacgcccccagactggagaccaagagcctgagcagcagcgtgctgccccccagctacgccagcgacagactgagcggcaacaacagagaccccgccctgaagcccaagagaagccacagaaaggccgaccccgacgccgcccacagacccagaatcctggagatggacaaggaggagaacagaagaagcgtgctgctgcccacccacagaagaagaggcagcttcagcagcgagaactactggagaaagagctacgagagcagcgaggactgcagcgaggccgccggcagccccggcaacagcggcagcagcctgagaagctgccccagcttctgcttcgagggcttcgtgttcgtgcactggggcgtgttcgtgttctgcttcctgttcttcctgatcctgtacatcttcccctggttctgctgcctgctgggcctgaagaacagaatcggccaggacctgggcagccacatcctgggcatcccccccggctggaagggctgctggcaccagtag

SEQ ID NO: 72506 - DNA, 1185 bp, Artificial Sequence
  Description of Artificial Sequence: Synthetic coding sequence
atggccgccgccagcggctacaccgacctgagagagaagctgaagagcatgaccagcagagacaactacaaggccggcagcagagaggccgccgccgccgccgccgccgccgtggccgccgccgccgccgccgccgccgccgccgagccctaccccgtgagcggcgccaagagaaagtaccaggaggacagcgaccccgagagaagcgactacgaggagcagcagctgcagaaggaggaggaggccagaaaggtgaagagcggcatcagacagatgagactgttcagccaggacgagtgcgccaagatcgaggccagaatcgacgaggtggtgagcagagccgagaagggcctgtacaacgagcacaccgtggacagagcccccctgagaaacaagtacttcttcggcgagggctacacctacggcgcccagctgcagaagagaggccccggccaggagagactgtacccccccggcgacgtggacgagatccccgagtgggtgcaccagctggtgatccagaagctggtggagcacagagtgatccccgagggcttcgtgaacagcgccgtgatcaacgactaccagcccggcggctgcatcgtgagccacgtggaccccatccacatcttcgagagacccatcgtgagcgtgagcttcttcagcgacagcgccctgtgcttcggctgcaagttccagttcaagcccatcagagtgagcgagcccgtgctgagcctgcccgtgagaagaggcagcgtgaccgtgctgagcggctacgccgccgacgagatcacccactgcatcagaccccaggacatcaaggagagaagagccgtgatcatcctgagaaagaccagactggacgcccccagactggagaccaagagcctgagcagcagcgtgctgccccccagctacgccagcgacagactgagcggcaacaacagagaccccgccctgaagcccaagagaagccacagaaaggccgaccccgacgccgcccacagacccagaatcctggagatggacaaggaggagaacagaagaagcgtgctgctgcccacccacagaagaagaggcagcttcagcagcgagaactactggagaaagagctacgagagcagcgaggactgcagcgaggccgccggcagccccgccagaaaggtgaagatgagaagacactag

SEQ ID NO: 72507 - DNA, 1152 bp, Artificial Sequence
  Description of Artificial Sequence: Synthetic coding sequence
atgagaagatgcagaagaccctgccccgccggcagaggcgagggcggcggcggcagaagccccgccgccgccgccgccgtggccgccgccgccgccgccgccgccgccgccgagccctaccccgtgagcggcgccaagagaaagtaccaggaggacagcgaccccgagagaagcgactacgaggagcagcagctgcagaaggaggaggaggccagaaaggtgaagagcggcatcagacagatgagactgttcagccaggacgagtgcgccaagatcgaggccagaatcgacgaggtggtgagcagagccgagaagggcctgtacaacgagcacaccgtggacagagcccccctgagaaacaagtacttcttcggcgagggctacacctacggcgcccagctgcagaagagaggccccggccaggagagactgtacccccccggcgacgtggacgagatccccgagtgggtgcaccagctggtgatccagaagctggtggagcacagagtgatccccgagggcttcgtgaacagcgccgtgatcaacgactaccagcccggcggctgcatcgtgagccacgtggaccccatccacatcttcgagagacccatcgtgagcgtgagcttcttcagcgacagcgccctgtgcttcggctgcaagttccagttcaagcccatcagagtgagcgagcccgtgctgagcctgcccgtgagaagaggcagcgtgaccgtgctgagcggctacgccgccgacgagatcacccactgcatcagaccccaggacatcaaggagagaagagccgtgatcatcctgagaaagaccagactggacgcccccagactggagaccaagagcctgagcagcagcgtgctgccccccagctacgccagcgacagactgagcggcaacaacagagaccccgccctgaagcccaagagaagccacagaaaggccgaccccgacgccgcccacagacccagaatcctggagatggacaaggaggagaacagaagaagcgtgctgctgcccacccacagaagaagaggcagcttcagcagcgagaactactggagaaagagctacgagagcagcgaggactgcagcgaggccgccggcagccccgccagaaaggtgaagatgagaagacactag

SEQ ID NO: 72508 - DNA, 717 bp, Artificial Sequence
  Description of Artificial Sequence: Synthetic coding sequence
atggaggagcaggacgccagagtgcccgccctggagcccttcagagtggagcaggccccccccgtgatctactacgtgcccgacttcatcagcaaggaggaggaggagtacctgctgagacaggtgttcaacgcccccaagcccaagtggacccagctgagcggcagaaagctgcagaactggggcggcctgccccaccccagaggcatggtgcccgagagactgcccccctggctgcagagatacgtggacaaggtgagcaacctgagcctgttcggcggcctgcccgccaaccacgtgctggtgaaccagtacctgcccggcgagggcatcatgccccacgaggacggccccctgtactaccccaccgtgagcaccatcagcctgggcagccacaccgtgctggacttctacgagcccagaagacccgaggacgacgaccccaccgagcagcccagacccccccccagacccaccaccagcctgctgctggagcccagaagcctgctggtgctgagaggccccgcctacaccagactgctgcacggcatcgccgccgccagagtggacgccctggacgccgccagcagcccccccaacgccgccgcctgccccagcgccagacccggcgcctgcctggtgagaggcaccagagtgagcctgaccatcagaagagtgcccagagtgctgagagccggcctgctgctgggcaagtag

SEQ ID NO: 72509 - DNA, 801 bp, Artificial Sequence
  Description of Artificial Sequence: Synthetic coding sequence
atggccggcagaggcatgggcatgctgaacctggagatcggcggcgacgccggcggcagaatcggctgcaaggagctggtgctgatggaggagcaggacgccagagtgcccgccctggagcccttcagagtggagcaggccccccccgtgatctactacgtgcccgacttcatcagcaaggaggaggaggagtacctgctgagacaggtgttcaacgcccccaagcccaagtggacccagctgagcggcagaaagctgcagaactggggcggcctgccccaccccagaggcatggtgcccgagagactgcccccctggctgcagagatacgtggacaaggtgagcaacctgagcctgttcggcggcctgcccgccaaccacgtgctggtgaaccagtacctgcccggcgagggcatcatgccccacgaggacggccccctgtactaccccaccgtgagcaccatcagcctgggcagccacaccgtgctggacttctacgagcccagaagacccgaggacgacgaccccaccgagcagcccagacccccccccagacccaccaccagcctgctgctggagcccagaagcctgctggtgctgagaggccccgcctacaccagactgctgcacggcatcgccgccgccagagtggacgccctggacgccgccagcagcccccccaacgccgccgcctgccccagcgccagacccggcgcctgcctggtgagaggcaccagagtgagcctgaccatcagaagagtgcccagagtgctgagagccggcctgctgctgggcaagtag

SEQ ID NO: 72510 - DNA, 717 bp, Artificial Sequence; identical to SEQ ID NO: 72508
  Description of Artificial Sequence: Synthetic coding sequence

SEQ ID NO: 72511 - DNA, 666 bp, Artificial Sequence
  Description of Artificial Sequence: Synthetic coding sequence
atggccggcaccggcctgctggccctgagaaccctgcccggccccagctgggtgagaggcagcggccccagcgtgctgagcagactgcaggacgccgccgtggtgagacccggcttcctgagcaccgccgaggaggagaccctgagcagagagctggagcccgagctgagaagaagaagatacgagtacgaccactgggacgccgccatccacggcttcagagagaccgagaagagcagatggagcgaggccagcagagccatcctgcagagagtgcaggccgccgccttcggccccggccagaccctgctgagcagcgtgcacgtgctggacctggaggccagaggctacatcaagccccacgtggacagcatcaagttctgcggcgccaccatcgccggcctgagcctgctgagccccagcgtgatgagactggtgcacacccaggagcccggcgagtggctggagctgctgctggagcccggcagcctgtacatcctgagaggcagcgccagatacgacttcagccacgagatcctgagagacgaggagagcttcttcggcgagagaagaatccccagaggcagaagaatcagcgtgatctgcagaagcctgcccgagggcatgggccccggcgagagcggccagcccccccccgcctgctag

SEQ ID NO: 72512 - DNA, 1995 bp, Artificial Sequence
  Description of Artificial Sequence: Synthetic coding sequence
atggacagcaaccaccagagcaactacaagctgagcaagaccgagaagaagttcctgagaaagcagatcaaggccaagcacaccctgctgagacacgagggcatcgagaccgtgagctacgccacccagagcctggtggtggccaacggcggcctgggcaacggcgtgagcagaaaccagctgctgcccgtgctggagaagtgcggcctggtggacgccctgctgatgccccccaacaagccctacagcttcgccagatacagaaccaccgaggagagcaagagagcctacgtgaccctgaacggcaaggaggtggtggacgacctgggccagaagatcaccctgtacctgaacttcgtggagaaggtgcagtggaaggagctgagaccccaggccctgccccccggcctgatggtggtggaggagatcatcagcagcgaggaggagaagatgctgctggagagcgtggactggaccgaggacaccgacaaccagaacagccagaagagcctgaagcacagaagagtgaagcacttcggctacgagttccactacgagaacaacaacgtggacaaggacaagcccctgagcggcggcctgcccgacatctgcgagagcttcctggagaagtggctgagaaagggctacatcaagcacaagcccgaccagatgaccatcaaccagtacgagcccggccagggcatccccgcccacatcgacacccacagcgccttcgaggacgagatcgtgagcctgagcctgggcagcgagatcgtgatggacttcaagcaccccgacggcatcgccgtgcccgtgatgctgcccagaagaagcctgctggtgatgaccggcgagagcagatacctgtggacccacggcatcacctgcagaaagttcgacaccgtgcaggccagcgagagcctgaagagcggcatcatcaccagcgacgtgggcgacctgaccctgagcaagagaggcctgagaaccagcttcaccttcagaaaggtgagacagaccccctgcaactgcagctaccccctggtgtgcgacagccagagaaaggagaccccccccagcttccccgagagcgacaaggaggccagcagactggagcaggagtacgtgcaccaggtgtacgaggagatcgccggccacttcagcagcaccagacacaccccctggccccacatcgtggagttcctgaaggccctgcccagcggcagcatcgtggccgacatcggctgcggcaacggcaagtacctgggcatcaacaaggagctgtacatgatcggctgcgacagaagccagaacctggtggacatctgcagagagagacagttccaggccttcgtgtgcgacgccctggccgtgcccgtgagaagcggcagctgcgacgcctgcatcagcatcgccgtgatccaccacttcgccaccgccgagagaagagtggccgccctgcaggagatcgtgagactgctgagacccggcggcaaggccctgatctacgtgtgggccatggagcaggagtacaacaagcagaagagcaagtacctgagaggcaacagaaacagccagggcaagaaggaggagatgaacagcgacaccagcgtgcagagaagcctggtggagcagatgagagacatgggcagcagagacagcgccagcagcgtgcccagaatcaacgacagccaggagggcggctgcaacagcagacaggtgagcaacagcaagctgcccgtgcacgtgaacagaaccagcttctacagccaggacgtgctggtgccctggcacctgaagggcaaccccgacaagggcaagcccgtggagcccttcggccccatcggcagccaggaccccagccccgtgttccacagatactaccacgtgttcagagagggcgagctggagggcgcctgcagaaccgtgagcgacgtgagaatcctgcagagctactacgaccagggcaactggtgcgtgatcctgcagaaggcctag

SEQ ID NO: 72513 - DNA, 2004 bp, Artificial Sequence
  Description of Artificial Sequence: Synthetic coding sequence
atgttcgccatggacagcaaccaccagagcaactacaagctgagcaagaccgagaagaagttcctgagaaagcagatcaaggccaagcacaccctgctgagacacgagggcatcgagaccgtgagctacgccacccagagcctggtggtggccaacggcggcctgggcaacggcgtgagcagaaaccagctgctgcccgtgctggagaagtgcggcctggtggacgccctgctgatgccccccaacaagccctacagcttcgccagatacagaaccaccgaggagagcaagagagcctacgtgaccctgaacggcaaggaggtggtggacgacctgggccagaagatcaccctgtacctgaacttcgtggagaaggtgcagtggaaggagctgagaccccaggccctgccccccggcctgatggtggtggaggagatcatcagcagcgaggaggagaagatgctgctggagagcgtggactggaccgaggacaccgacaaccagaacagccagaagagcctgaagcacagaagagtgaagcacttcggctacgagttccactacgagaacaacaacgtggacaaggacaagcccctgagcggcggcctgcccgacatctgcgagagcttcctggagaagtggctgagaaagggctacatcaagcacaagcccgaccagatgaccatcaaccagtacgagcccggccagggcatccccgcccacatcgacacccacagcgccttcgaggacgagatcgtgagcctgagcctgggcagcgagatcgtgatggacttcaagcaccccgacggcatcgccgtgcccgtgatgctgcccagaagaagcctgctggtgatgaccggcgagagcagatacctgtggacccacggcatcacctgcagaaagttcgacaccgtgcaggccagcgagagcctgaagagcggcatcatcaccagcgacgtgggcgacctgaccctgagcaagagaggcctgagaaccagcttcaccttcagaaaggtgagacagaccccctgcaactgcagctaccccctggtgtgcgacagccagagaaaggagaccccccccagcttccccgagagcgacaaggaggccagcagactggagcaggagtacgtgcaccaggtgtacgaggagatcgccggccacttcagcagcaccagacacaccccctggccccacatcgtggagttcctgaaggccctgcccagcggcagcatcgtggccgacatcggctgcggcaacggcaagtacctgggcatcaacaaggagctgtacatgatcggctgcgacagaagccagaacctggtggacatctgcagagagagacagttccaggccttcgtgtgcgacgccctggccgtgcccgtgagaagcggcagctgcgacgcctgcatcagcatcgccgtgatccaccacttcgccaccgccgagagaagagtggccgccctgcaggagatcgtgagactgctgagacccggcggcaaggccctgatctacgtgtgggccatggagcaggagtacaacaagcagaagagcaagtacctgagaggcaacagaaacagccagggcaagaaggaggagatgaacagcgacaccagcgtgcagagaagcctggtggagcagatgagagacatgggcagcagagacagcgccagcagcgtgcccagaatcaacgacagccaggagggcggctgcaacagcagacaggtgagcaacagcaagctgcccgtgcacgtgaacagaaccagcttctacagccaggacgtgctggtgccctggcacctgaagggcaaccccgacaagggcaagcccgtggagcccttcggccccatcggcagccaggaccccagccccgtgttccacagatactaccacgtgttcagagagggcgagctggagggcgcctgcagaaccgtgagcgacgtgagaatcctgcagagctactacgaccagggcaactggtgcgtgatcctgcagaaggcctag

SEQ ID NO: 72514 - DNA, 1995 bp, Artificial Sequence; identical to SEQ ID NO: 72512
  Description of Artificial Sequence: Synthetic coding sequence

SEQ ID NO: 72515 - DNA, 675 bp, Artificial Sequence
  Description of Artificial Sequence: Synthetic coding sequence
atggacagcaaccaccagagcaactacaagctgagcaagaccgagaagaagttcctgagaaagcagatcaaggccaagcacaccctgctgagacacgagggcatcgagaccgtgagctacgccacccagagcctggtggtggccaacggcggcctgggcaacggcgtgagcagaaaccagctgctgcccgtgctggagaagtgcggcctggtggacgccctgctgatgccccccaacaagccctacagcttcgccagatacagaaccaccgaggagagcaagagagcctacgtgaccctgaacggcaaggaggtggtggacgacctgggccagaagatcaccctgtacctgaacttcgtggagaaggtgcagtggaaggagctgagaccccaggccctgccccccggcctgatggtggtggaggagatcatcagcagcgaggaggagaagatgctgctggagagcgtggactggaccgaggacaccgacaaccagaacagccagaagagcctgaagcacagaagagtgaagcacttcggctacgagttccactacgagaacaacaacgtggacaaggacaagcccctgagcggcggcctgcccgacatctgcgagagcttcctggagaagtggctgagaaaggccgagaagaacctggaggtgggcatccactag

SEQ ID NO: 72516 - DNA, 1338 bp, Artificial Sequence
  Description of Artificial Sequence: Synthetic coding sequence
atgaagaaccccgaggcccagcaggacgtgagcgtgagccagggcttcagaatgctgttctacaccatgaagcccagcgagaccagcttccagaccctggaggaggtgcccgactacgtgaagaaggccacccccttcttcatcagcctgatgctgctggagctggtggtgagctggatcctgaagggcaagccccccggcagactggacgacgccctgaccagcatcagcgccggcgtgctgagcagactgcccagcctgttcttcagaagcatcgagctgaccagctacatctacatctgggagaactacagactgttcaacctgccctgggacagcccctggacctggtacagcgccttcctgggcgtggacttcggctactactggttccacagaatggcccacgaggtgaacatcatgtgggccggccaccagacccaccacagcagcgaggactacaacctgagcaccgccctgagacagagcgtgctgcagatctacaccagctggatcttctacagccccctggccctgttcatcccccccagcgtgtacgccgtgcacctgcagttcaacctgctgtaccagttctggatccacaccgaggtgatcaacaacctgggccccctggagctgatcctgaacacccccagccaccacagagtgcaccacggcagaaacagatactgcatcgacaagaactacgccggcgtgctgatcatctgggacaagatcttcggcaccttcgaggccgagaacgagaaggtggtgtacggcctgacccaccccatcaacaccttcgagcccatcaaggtgcagttccaccacctgttcagcatctggaccaccttctgggccacccccggcttcttcaacaagttcagcgtgatcttcaagggccccggctggggccccggcaagcccagactgggcctgagcgaggagatccccgaggtgaccggcaaggaggtgcccttcagcagcagcagcagccagctgctgaagatctacaccgtggtgcagttcgccctgatgctggccttctacgaggagaccttcgccgacaccgccgccctgagccaggtgaccctgctgctgagagtgtgcttcatcatcctgaccctgaccagcatcggcttcctgctggaccagagacccaaggccgccatcatggagaccctgagatgcctgatgttcctgatgctgtacagattcggccacctgaagcccctggtgcccagcctgagcagcgccttcgagatcgtgttcagcatctgcatcgccttctggggcgtgagaagcatgaagcagctgaccagccacccctggaagtag

SEQ ID NO: 72517 - DNA, 1977 bp, Artificial Sequence
  Description of Artificial Sequence: Synthetic coding sequence
atggccgaggccgccgccgccgccggcggcaccggcctgggcgccggcgccagctacggcagcgccgccgacagagacagagaccccgaccccgacagagccggcagaagactgagagtgctgagcggccacctgctgggcagacccagagaggccctgagcaccaacgagtgcaaggccagaagagccgccagcgccgccaccgccgcccccaccgccacccccgccgcccaggagagcggcaccatccccaagaagagacaggaggtgatgaagtggaacggctggggctacaacgacagcaagttcatcttcaacaagaagggccagatcgagctgaccggcaagagataccccctgagcggcatgggcctgcccaccttcaaggagtggatccagaacaccctgggcgtgaacgtggagcacaagaccaccagcaaggccagcctgaaccccagcgacaccccccccagcgtggtgaacgaggacttcctgcacgacctgaaggagaccaacatcagctacagccaggaggccgacgacagagtgttcagagcccacggccactgcctgcacgagatcttcctgctgagagagggcatgttcgagagaatccccgacatcgtgctgtggcccacctgccacgacgacgtggtgaagatcgtgaacctggcctgcaagtacaacctgtgcatcatccccatcggcggcggcaccagcgtgagctacggcctgatgtgccccgccgacgagaccagaaccatcatcagcctggacaccagccagatgaacagaatcctgtgggtggacgagaacaacctgaccgcccacgtggaggccggcatcaccggccaggagctggagagacagctgaaggagagcggctactgcaccggccacgagcccgacagcctggagttcagcaccgtgggcggctgggtgagcaccagagccagcggcatgaagaagaacatctacggcaacatcgaggacctggtggtgcacatcaagatggtgacccccagaggcatcatcgagaagagctgccagggccccagaatgagcaccggccccgacatccaccacttcatcatgggcagcgagggcaccctgggcgtgatcaccgaggccaccatcaagatcagacccgtgcccgagtaccagaagtacggcagcgtggccttccccaacttcgagcagggcgtggcctgcctgagagagatcgccaagcagagatgcgcccccgccagcatcagactgatggacaacaagcagttccagttcggccacgccctgaagccccaggtgagcagcatcttcaccagcttcctggacggcctgaagaagttctacatcaccaagttcaagggcttcgaccccaaccagctgagcgtggccaccctgctgttcgagggcgacagagagaaggtgctgcagcacgagaagcaggtgtacgacatcgccgccaagttcggcggcctggccgccggcgaggacaacggccagagaggctacctgctgacctacgtgatcgcctacatcagagacctggccctggagtactacgtgctgggcgagagcttcgagaccagcgccccctgggacagagtggtggacctgtgcagaaacgtgaaggagagaatcaccagagagtgcaaggagaagggcgtgcagttcgcccccttcagcacctgcagagtgacccagacctacgacgccggcgcctgcatctacttctacttcgccttcaactacagaggcatcagcgaccccctgaccgtgttcgagcagaccgaggccgccgccagagaggagatcctggccaacggcggcagcctgagccaccaccacggcgtgggcaagctgagaaagcagtggctgaaggagagcatcagcgacgtgggcttcggcatgctgaagagcgtgaaggagtacgtggaccccaacaacatcttcggcaacagaaacctgctgtag

SEQ ID NO: 72518 - DNA, 966 bp, Artificial Sequence
  Description of Artificial Sequence: Synthetic coding sequence
atggaccccaagtacccctggagcaagtgcggccacaagaccaccagcaaggccagcctgaaccccagcgacaccccccccagcgtggtgaacgaggacttcctgcacgacctgaaggagaccaacatcagctacagccaggaggccgacgacagagtgttcagagcccacggccactgcctgcacgagatcttcctgctgagagagggcatgttcgagagaatccccgacatcgtgctgtggcccacctgccacgacgacgtggtgaagatcgtgaacctggcctgcaagtacaacctgtgcatcatccccatcggcggcggcaccagcgtgagctacggcctgatgtgccccgccgacgagaccagaaccatcatcagcctggacaccagccagatgaacagaatcctgtgggtggacgagaacaacctgaccgcccacgtggaggccggcatcaccggccaggagctggagagacagctgaaggagagcggctactgcaccggccacgagcccgacagcctggagttcagcaccgtgggcggctgggtgagcaccagagccagcggcatgaagaagaacatctacggcaacatcgaggacctggtggtgcacatcaagatggtgacccccagaggcatcatcgagaagagctgccagggccccagaatgagcaccggccccgacatccaccacttcatcatgggcagcgagggcaccctgggcgtgatcaccgaggccaccatcaagatcagacccgtgcccgagtaccagaagtacggcagcgtggccttccccaacttcgagcagggcgtggcctgcctgagagagatcgccaagcagagatgcgcccccgccagcatcagactgatggacaacaagcagttccagttcggccacgccctgaagccccaggtgagcagcatcttcaccagcttcctggacggcctgaagaagttctactag

SEQ ID NO: 72519 - DNA, 1176 bp, Artificial Sequence
  Description of Artificial Sequence: Synthetic coding sequence
atggacatggccagcgagagcgtgggcggcaagatcctgttcgccaccgacgacttcttcgcccccgccgagaacctgatcaagagcgacagcccctgcttcaaggagcacgagtacaccgagttcggcaagtggatggacggctgggagaccagaagaaagagaatccccggccacgactggtgcgtgctgagactgggcatccagggcgtgatcagaggcttcgacgtggacgtgagctacttcaccggcgactacgcccccagagtgagcatccaggccgccaacctggaggaggacaagctgcccgagatccccgagagaggcaccagaaccggcgccgccgccacccccgaggagttcgaggccatcgccgagctgaagagcgacgactggagctacctggtgcccatgaccgagctgaagcccggcaaccccgccagcggccacaactacttcctggtgaacagccagcagagatggacccacatcagactgaacatcttccccgacggcggcatcgccagactgagagtgttcggcaccggccagaaggactggaccgccaccgaccccaaggagcccgccgacctggtggccatcgccttcggcggcgtgtgcgtgggcttcagcaacgccaagttcggccaccccaacaacatcatcggcgtgggcggcgccaagagcatggccgacggctgggagaccgccagaagactggacagaccccccatcctggagaacgacgagaacggcatcctgctggtgcccggctgcgagtgggccgtgttcagactggcccaccccggcgtgatcaccagaatcgagatcgacaccaagtacttcgagggcaacgcccccgacagctgcaaggtggacggctgcatcctgaccacccaggaggaggaggccgtgatcagacagaagtggatcctgcccgcccacaagtggaagcccctgctgcccgtgaccaagctgagccccaaccagagccacctgttcgacagcctgaccctggagctgcaggacgtgatcacccacgccagactgaccatcgtgcccgacggcggcgtgagcagactgagactgagaggcttccccagcagcatctgcctgctgagacccagagagaagcccatgctgaagttcagcgtgagcttcaaggccaacccctag

SEQ ID NO: 72520 - DNA, 486 bp, Artificial Sequence
  Description of Artificial Sequence: Synthetic coding sequence
ggcagaaaggccagcgagaagaccggcggcagagagggcgagcccgccgacagaggcctgcagctgggcggcaaggccttcggcctgctgaaggcccagcaggaggagagactggacgagatcaacaagcagttcctggacgaccccaagtacagcagcgacgaggacctgcccagcaagctggagggcttcaaggagaagtacatggagttcgacctgaacggcaacggcgacatcgacatcatgagcctgaagagaatgctggagaagctgggcgtgcccaagacccacctggagctgaagaagctgatcggcgaggtgagcagcggcagcggcgagaccttcagctaccccgacttcctgagaatgatgctgggcaagagaagcgccatcctgaagatgatcctgatgtacgaggagaaggccagagagaaggagaagcccaccggcccccccgccaagaaggccatcagcgagctgccctag

SEQ ID NO: 72521 - DNA, 282 bp, Artificial Sequence
  Description of Artificial Sequence: Synthetic coding sequence
atggagttcgacctgaacggcaacggcgacatcgacatcatgagcctgaagagaatgctggagaagctgggcgtgcccaagacccacctggagctgaagaagctgatcggcgaggtgagcagcggcagcggcgagaccttcagctaccccgacttcctgagaatgatgctgggcaagagaagcgccatcctgaagatgatcctgatgtacgaggagaaggccagagagaaggagaagcccaccggcccccccgccaagaaggccatcagcgagctgccctag

SEQ ID NO: 72522 - DNA, 444 bp, Artificial Sequence
  Description of Artificial Sequence: Synthetic coding sequence
atgagccagaccagagacctgcagggcggcaaggccttcggcctgctgaaggcccagcaggaggagagactggacgagatcaacaagcagttcctggacgaccccaagtacagcagcgacgaggacctgcccagcaagctggagggcttcaaggagaagtacatggagttcgacctgaacggcaacggcgacatcgacatcatgagcctgaagagaatgctggagaagctgggcgtgcccaagacccacctggagctgaagaagctgatcggcgaggtgagcagcggcagcggcgagaccttcagctaccccgacttcctgagaatgatgctgggcaagagaagcgccatcctgaagatgatcctgatgtacgaggagaaggccagagagaaggagaagcccaccggcccccccgccaagaaggccatcagcgagctgccctag

SEQ ID NO: 72523 - DNA, 282 bp, Artificial Sequence; identical to SEQ ID NO: 72521
  Description of Artificial Sequence: Synthetic coding sequence

SEQ ID NO: 72524 - DNA, 444 bp, Artificial Sequence; identical to SEQ ID NO: 72522
  Description of Artificial Sequence: Synthetic coding sequence

SEQ ID NO: 72525 - DNA, 486 bp, Artificial Sequence; identical to SEQ ID NO: 72520
  Description of Artificial Sequence: Synthetic coding sequence

SEQ ID NO: 72526 - DNA, 444 bp, Artificial Sequence; identical to SEQ ID NO: 72522
  Description of Artificial Sequence: Synthetic coding sequence

SEQ ID NO: 72527 - DNA, 444 bp, Artificial Sequence; identical to SEQ ID NO: 72522
  Description of Artificial Sequence: Synthetic coding sequence

SEQ ID NO: 72528 - DNA, 282 bp, Artificial Sequence; identical to SEQ ID NO: 72521
  Description of Artificial Sequence: Synthetic coding sequence

SEQ ID NO: 72529 - DNA, 282 bp, Artificial Sequence; identical to SEQ ID NO: 72521
  Description of Artificial Sequence: Synthetic coding sequence

SEQ ID NO: 72530 - DNA, 486 bp, Artificial Sequence; identical to SEQ ID NO: 72520
  Description of Artificial Sequence: Synthetic coding sequence

SEQ ID NO: 72531 - DNA, 282 bp, Artificial Sequence; identical to SEQ ID NO: 72521
  Description of Artificial Sequence: Synthetic coding sequence

SEQ ID NO: 72532 - DNA, 282 bp, Artificial Sequence; identical to SEQ ID NO: 72521
  Description of Artificial Sequence: Synthetic coding sequence

SEQ ID NO: 72533 - DNA, 444 bp, Artificial Sequence; identical to SEQ ID NO: 72522
  Description of Artificial Sequence: Synthetic coding sequence

SEQ ID NO: 72534 - DNA, 486 bp, Artificial Sequence; identical to SEQ ID NO: 72520
  Description of Artificial Sequence: Synthetic coding sequence

SEQ ID NO: 72535 - DNA, 444 bp, Artificial Sequence; identical to SEQ ID NO: 72522
  Description of Artificial Sequence: Synthetic coding sequence

SEQ ID NO: 72536 - DNA, 486 bp, Artificial Sequence; identical to SEQ ID NO: 72520
  Description of Artificial Sequence: Synthetic coding sequence

SEQ ID NO: 72537 - DNA, 486 bp, Artificial Sequence; identical to SEQ ID NO: 72520
  Description of Artificial Sequence: Synthetic coding sequence

SEQ ID NO: 72538 - DNA, 282 bp, Artificial Sequence; identical to SEQ ID NO: 72521
  Description of Artificial Sequence: Synthetic coding sequence

SEQ ID NO: 72539 - DNA, 1062 bp, Artificial Sequence
  Description of Artificial Sequence: Synthetic coding sequence
atgagcaagccccccgacctgctgctgagactgctgagaggcgcccccagacagagagtgtgcaccctgttcatcatcggcttcaagttcaccttcttcgtgagcatcatgatctactggcacgtggtgggcgagcccaaggagaagggccagctgtacaacctgcccgccgagatcccctgccccaccctgaccccccccaccccccccagccacggccccacccccggcaacatcttcttcctggagaccagcgacagaaccaaccccaacttcctgttcatgtgcagcgtggagagcgccgccagaacccaccccgagagccacgtgctggtgctgatgaagggcctgcccggcggcaacgccagcctgcccagacacctgggcatcagcctgctgagctgcttccccaacgtgcagatgctgcccctggacctgagagagctgttcagagacacccccctggccgactggtacgccgccgtgcagggcagatgggagccctacctgctgcccgtgctgagcgacgccagcagaatcgccctgatgtggaagttcggcggcatctacctggacaccgacttcatcgtgctgaagaacctgagaaacctgaccaacgtgctgggcacccagagcagatacgtgctgaacggcgccttcctggccttcgagagaagacacgagttcatggccctgtgcatgagagacttcgtggaccactacaacggctggatctggggccaccagggcccccagctgctgaccagagtgttcaagaagtggtgcagcatcagaagcctggccgagagcagagcctgcagaggcgtgaccaccctgccccccgaggccttctaccccatcccctggcaggactggaagaagtacttcgaggacatcaaccccgaggagctgcccagactgctgagcgccacctacgccgtgcacgtgtggaacaagaagagccagggcaccagattcgaggccaccagcagagccctgctggcccagctgcacgccagatactgccccaccacccacgaggccatgaagatgtacctgtag

SEQ ID NO: 72540 - DNA, 1062 bp, Artificial Sequence; identical to SEQ ID NO: 72539
  Description of Artificial Sequence: Synthetic coding sequence

SEQ ID NO: 72541 - DNA, 1062 bp, Artificial Sequence; identical to SEQ ID NO: 72539
  Description of Artificial Sequence: Synthetic coding sequence

SEQ ID NO: 72542 - DNA, 1311 bp, Artificial Sequence
  Description of Artificial Sequence: Synthetic coding sequence
atgagcaagccccccgacctgctgctgagactgctgagaggcgcccccagacagagagtgtgcaccctgttcatcatcggcttcaagttcaccttcttcgtgagcatcatgatctactggcacgtggtgggcgagcccaaggagaagggccagctgtacaacctgcccgccgagatcccctgccccaccctgaccccccccaccccccccagccacggccccacccccggcaacatcttcttcctggagaccagcgacagaaccaaccccaacttcctgttcatgtgcagcgtggagagcgccgccagaacccaccccgagagccacgtgctggtgctgatgaagggcctgcccggcggcaacgccagcctgcccagacacctgggcatcagcctgctgagctgcttccccaacgtgcagatgctgcccctggacctgagagagctgttcagagacacccccctggccgactggtacgccgccgtgcagggcagatgggagccctacctgctgcccgtgctgagcgacgccagcagaatcgccctgatgtggaagttcggcggcatctacctggacaccgacttcatcgtgctgaagaacctgagaaacctgaccaacgtgctgggcacccagagcagatacgtgctgaacggcgccttcctggccttcgagagaagacacgagttcatggccctgtgcatgagagacttcgtggaccactacaacggctggatctggggccaccagggcccccagctgctgaccagagtgttcaagaagtggtgcagcatcagaagcctggccgagagcagagcctgcagaggcgtgaccaccctgccccccgaggccttctaccccatcccctggcaggactggaagaagtacttcgaggacatcaaccccgaggagctgcccagactgctgagcgccacctacgccgtgcacgtgtggaacaagaagagccagggcaccgccggccccgccgcctgccccctgctgccccacgacgccagaggccacgagaacgtgctggtgagaggcccccccggccacctgcccaacctgctgctgatgggccactgggccgccctgcccggcgaggccagactgagagccagagagagagaggccagagccgccaccggcctgagacaggccgtggaggagctgtgggagcaggcccagtgggaggccgtggacacccccagaaccgtgagctgcctggaggccggcctgacccacggcgccatcgccagcggcggcagaagcgtgagcgcccccggcctgctggacaacagacaggagggctag

SEQ ID NO: 72543 - DNA, 309 bp, Artificial Sequence
  Description of Artificial Sequence: Synthetic coding sequence
atggccctgctgaaggccaacaaggacctgatcagcgccggcctgaaggagttcagcgtgctgctgaaccagcaggtgttcaacgaccccctggtgagcgaggaggacatggtgaccgtggtggaggactggatgaacttctacatcaactactacagacagcaggtgaccggcgagccccaggagagagacaaggccctgcaggagctgagacaggagctgaacaccctggccaaccccttcctggccaagtacagagacttcctgaagagccacgagctgcccagccaccccccccccagcagctag

SEQ ID NO: 72544 - DNA, 1488 bp, Artificial Sequence
  Description of Artificial Sequence: Synthetic coding sequence
atgagcatgctggtggtgttcctgctgctgtggggcgtgacctggggccccgtgaccgaggccgccatcttctacgagacccagcccagcctgtgggccgagagcgagagcctgctgaagcccctggccaacgtgaccctgacctgccaggcccacctggagacccccgacttccagctgttcaagaacggcgtggcccaggagcccgtgcacctggacagccccgccatcaagcaccagttcctgctgaccggcgacacccagggcagatacagatgcagaagcggcctgagcaccggctggacccagctgagcaagctgctggagctgaccggccccaagagcctgcccgccccctggctgagcatggcccccgtgagctggatcacccccggcctgaagaccaccgccgtgtgcagaggcgtgctgagaggcgtgaccttcctgctgagaagagagggcgaccacgagttcctggaggtgcccgaggcccaggaggacgtggaggccaccttccccgtgcaccagcccggcaactacagctgcagctacagaaccgacggcgagggcgccctgagcgagcccagcgccaccgtgaccatcgaggagctggccgccccccccccccccgtgctgatgcaccacggcgagagcagccaggtgctgcaccccggcaacaaggtgaccctgacctgcgtggcccccctgagcggcgtggacttccagctgagaagaggcgagaaggagctgctggtgcccagaagcagcaccagccccgacagaatcttcttccacctgaacgccgtggccctgggcgacggcggccactacacctgcagatacagactgcacgacaaccagaacggctggagcggcgacagcgcccccgtggagctgatcctgagcgacgagaccctgcccgcccccgagttcagccccgagcccgagagcggcagagccctgagactgagatgcctggcccccctggagggcgccagattcgccctggtgagagaggacagaggcggcagaagagtgcacagattccagagccccgccggcaccgaggccctgttcgagctgcacaacatcagcgtggccgacagcgccaactacagctgcgtgtacgtggacctgaagccccccttcggcggcagcgcccccagcgagagactggagctgcacgtggacggccccccccccagaccccagctgagagccacctggagcggcgccgtgctggccggcagagacgccgtgctgagatgcgagggccccatccccgacgtgaccttcgagctgctgagagagggcgagaccaaggccgtgaagaccgtgagaacccccggcgccgccgccaacctggagctgatcttcgtgggcccccagcacgccggcaactacagatgcagatacagaagctgggtgccccacaccttcgagagcgagctgagcgaccccgtggagctgctggtggccgagagctag

SEQ ID NO: 72545 - DNA, 1059 bp, Artificial Sequence
  Description of Artificial Sequence: Synthetic coding sequence
atgagaagcctgggcgccctgctgctgctgctgagcgcctgcctggccgtgagcgccggccccgtgcccaccccccccgacaacatccaggtgcaggagaacttcaacatcagcagaatctacggcaagtggtacaacctggccatcggcagcacctgcccctggctgaagaagatcatggacagaatgaccgtgagcaccctggtgctgggcgagggcgccaccgaggccgagatcagcatgaccagcaccagatggagaaagggcgtgtgcgaggagaccagcggcgcctacgagaagaccgacaccgacggcaagttcctgtaccacaagagcaagtggaacatcaccatggagagctacgtggtgcacaccaactacgacgagtacgccatcttcctgaccaagaagttcagcagacaccacggccccaccatcaccgccaagctgtacggcagagccccccagctgagagagaccctgctgcaggacttcagagtggtggcccagggcgtgggcatccccgaggacagcatcttcaccatggccgacagaggcgagtgcgtgcccggcgagcaggagcccgagcccatcctgatccccagagtgagaagagccgtgctgccccaggaggaggagggcagcggcggcggccagctggtgaccgaggtgaccaagaaggaggacagctgccagctgggctacagcgccggcccctgcatgggcatgaccagcagatacttctacaacggcaccagcatggcctgcgagaccttccagtacggcggctgcatgggcaacggcaacaacttcgtgaccgagaaggagtgcctgcagacctgcagaaccgtggccgcctgcaacctgcccatcgtgagaggcccctgcagagccttcatccagctgtgggccttcgacgccgtgaagggcaagtgcgtgctgttcccctacggcggctgccagggcaacggcaacaagttctacagcgagaaggagtgcagagagtactgcggcgtgcccggcgacggcgacgaggagctgctgagattcagcaactag

SEQ ID NO: 72546 - DNA, 813 bp, Artificial Sequence
  Description of Artificial Sequence: Synthetic coding sequence
atggacagaatgaccgtgagcaccctggtgctgggcgagggcgccaccgaggccgagatcagcatgaccagcaccagatggagaaagggcgtgtgcgaggagaccagcggcgcctacgagaagaccgacaccgacggcaagttcctgtaccacaagagcaagtggaacatcaccatggagagctacgtggtgcacaccaactacgacgagtacgccatcttcctgaccaagaagttcagcagacaccacggccccaccatcaccgccaagctgtacggcagagccccccagctgagagagaccctgctgcaggacttcagagtggtggcccagggcgtgggcatccccgaggacagcatcttcaccatggccgacagaggcgagtgcgtgcccggcgagcaggagcccgagcccatcctgatccccagagtgagaagagccgtgctgccccaggaggaggagggcagcggcggcggccagctggtgaccgaggtgaccaagaaggaggacagctgccagctgggctacagcgccggcccctgcatgggcatgaccagcagatacttctacaacggcaccagcatggcctgcgagaccttccagtacggcggctgcatgggcaacggcaacaacttcgtgaccgagaaggagtgcctgcagacctgcagaaccgtgggcgagtgcggcagcccccccctgtgcgccctgcacccccaggaccccgtgccccccgtgaaccacctgagaatcgagaaggtggccaacagaggccacagcagcggcagaacccccggcggcttcctgaagagctag

SEQ ID NO: 72547 - DNA, 897 bp, Artificial Sequence
  Description of Artificial Sequence: Synthetic coding sequence
atggtgagaatggtgcccgtgctgctgagcctgctgctgctgctgggccccgccgtgccccaggagaaccaggacggcagatacagcctgacctacatctacaccggcctgagcaagcacgtggaggacgtgcccgccttccaggccctgggcagcctgaacgacctgcagttcttcagatacaacagcaaggacagaaagagccagcccatgggcctgtggagacaggtggagggcatggaggactggaagcaggacagccagctgcagaaggccagagaggacatcttcatggagaccctgaaggacatcgtggagtactacaacgacagcaacggcagccacgtgctgcagggcagattcggctgcgagatcgagaacaacagaagcagcggcgccttctggaagtactactacgacggcaaggactacatcgagttcaacaaggagatccccgcctgggtgcccttcgaccccgccgcccagatcaccaagcagaagtgggaggccgagcccgtgtacgtgcagagagccaaggcctacctggaggaggagtgccccgccaccctgagaaagtacctgaagtacagcaagaacatcctggacagacaggacccccccagcgtggtggtgaccagccaccaggcccccggcgagaagaagaagctgaagtgcctggcctacgacttctaccccggcaagatcgacgtgcactggaccagagccggcgaggtgcaggagcccgagctgagaggcgacgtgctgcacaacggcaacggcacctaccagagctgggtggtggtggccgtgcccccccaggacaccgccccctacagctgccacgtgcagcacagcagcctggcccagcccctggtggtgccctgggaggccagctag

SEQ ID NO: 72548 - DNA, 1104 bp, Artificial Sequence
  Description of Artificial Sequence: Synthetic coding sequence
atgaagagcctggtgctgctgctgtgcctggcccagctgtggggctgccacagcgccccccacggccccggcctgatctacagacagcccaactgcgacgaccccgagaccgaggaggccgccctggtggccatcgactacatcaaccagaacctgccctggggctacaagcacaccctgaaccagatcgacgaggtgaaggtgtggccccagcagcccagcggcgagctgttcgagatcgagatcgacaccctggagaccacctgccacgtgctggaccccacccccgtggccagatgcagcgtgagacagctgaaggagcacgccgtggagggcgactgcgacttccagctgctgaagctggacggcaagttcagcgtggtgtacgccaagtgcgacagcagccccgacagcgccgaggacgtgagaaaggtgtgccaggactgccccctgctggcccccctgaacgacaccagagtggtgcacgccgccaaggccgccctggccgccttcaacgcccagaacaacggcagcaacttccagctggaggagatcagcagagcccagctggtgcccctgccccccagcacctacgtggagttcaccgtgagcggcaccgactgcgtggccaaggaggccaccgaggccgccaagtgcaacctgctggccgagaagcagtacggcttctgcaaggccaccctgagcgagaagctgggcggcgccgaggtggccgtgacctgcatggtgttccagacccagcccgtgagcagccagccccagcccgagggcgccaacgaggccgtgcccacccccgtggtggaccccgacgccccccccagcccccccctgggcgcccccggcctgccccccgccggcagcccccccgacagccacgtgctgctggccgccccccccggccaccagctgcacagagcccactacgacctgagacacaccttcatgggcgtggtgagcctgggcagccccagcggcgaggtgagccaccccagaaagaccagaaccgtggtgcagcccagcgtgggcgccgccgccggccccgtggtgcccccctgccccggcagaatcagacacttcaaggtgtag

SEQ ID NO: 72549 - DNA, 1302 bp, Artificial Sequence
  Description of Artificial Sequence: Synthetic coding sequence
atgttcgccggctgcttcttcttcctgctgaaccagagcagaaaccaccccgtgagcctgtgcaacagcagcggcagactgcagcagatcaacaaggcccaccaccccccctgggtgtacctgagccagcagagcacctgggtgggccccgaggccagcaaccacctgcacgcctgccagggcctgagcggcgccgccatgaagagcctggtgctgctgctgtgcctggcccagctgtggggctgccacagcgccccccacggccccggcctgatctacagacagcccaactgcgacgaccccgagaccgaggaggccgccctggtggccatcgactacatcaaccagaacctgccctggggctacaagcacaccctgaaccagatcgacgaggtgaaggtgtggccccagcagcccagcggcgagctgttcgagatcgagatcgacaccctggagaccacctgccacgtgctggaccccacccccgtggccagatgcagcgtgagacagctgaaggagcacgccgtggagggcgactgcgacttccagctgctgaagctggacggcaagttcagcgtggtgtacgccaagtgcgacagcagccccgacagcgccgaggacgtgagaaaggtgtgccaggactgccccctgctggcccccctgaacgacaccagagtggtgcacgccgccaaggccgccctggccgccttcaacgcccagaacaacggcagcaacttccagctggaggagatcagcagagcccagctggtgcccctgccccccagcacctacgtggagttcaccgtgagcggcaccgactgcgtggccaaggaggccaccgaggccgccaagtgcaacctgctggccgagaagcagtacggcttctgcaaggccaccctgagcgagaagctgggcggcgccgaggtggccgtgacctgcatggtgttccagacccagcccgtgagcagccagccccagcccgagggcgccaacgaggccgtgcccacccccgtggtggaccccgacgccccccccagcccccccctgggcgcccccggcctgccccccgccggcagcccccccgacagccacgtgctgctggccgccccccccggccaccagctgcacagagcccactacgacctgagacacaccttcatgggcgtggtgagcctgggcagccccagcggcgaggtgagccaccccagaaagaccagaaccgtggtgcagcccagcgtgggcgccgccgccggccccgtggtgcccccctgccccggcagaatcagacacttcaaggtgtag

SEQ ID NO: 72550 - DNA, 4425 bp, Artificial Sequence
  Description of Artificial Sequence: Synthetic coding sequence
atgggcaagaacaagctgctgcaccccagcctggtgctgctgctgctggtgctgctgcccaccgacgccagcgtgagcggcaagccccagtacatggtgctggtgcccagcctgctgcacaccgagaccaccgagaagggctgcgtgctgctgagctacctgaacgagaccgtgaccgtgagcgccagcctggagagcgtgagaggcaacagaagcctgttcaccgacctggaggccgagaacgacgtgctgcactgcgtggccttcgccgtgcccaagagcagcagcaacgaggaggtgatgttcctgaccgtgcaggtgaagggccccacccaggagttcaagaagagaaccaccgtgatggtgaagaacgaggacagcctggtgttcgtgcagaccgacaagagcatctacaagcccggccagaccgtgaagttcagagtggtgagcatggacgagaacttccaccccctgaacgagctgatccccctggtgtacatccaggaccccaagggcaacagaatcgcccagtggcagagcttccagctggagggcggcctgaagcagttcagcttccccctgagcagcgagcccttccagggcagctacaaggtggtggtgcagaagaagagcggcggcagaaccgagcaccccttcaccgtggaggagttcgtgctgcccaagttcgaggtgcaggtgaccgtgcccaagatcatcaccatcctggaggaggagatgaacgtgagcgtgtgcggcctgtacacctacggcaagcccgtgcccggccacgtgaccgtgagcatctgcagaaagtacagcgacgccagcgactgccacggcgaggacagccaggccttctgcgagaagttcagcggccagctgaacagccacggctgcttctaccagcaggtgaagaccaaggtgttccagctgaagagaaaggagtacgagatgaagctgcacaccgaggcccagatccaggaggagggcaccgtggtggagctgaccggcagacagagcagcgagatcaccagaaccatcaccaagctgagcttcgtgaaggtggacagccacttcagacagggcatccccttcttcggccaggtgagactggtggacggcaagggcgtgcccatccccaacaaggtgatcttcatcagaggcaacgaggccaactactacagcaacgccaccaccgacgagcacggcctggtgcagttcagcatcaacaccaccaacgtgatgggcaccagcctgaccgtgagagtgaactacaaggacagaagcccctgctacggctaccagtgggtgagcgaggagcacgaggaggcccaccacaccgcctacctggtgttcagccccagcaagagcttcgtgcacctggagcccatgagccacgagctgccctgcggccacacccagaccgtgcaggcccactacatcctgaacggcggcaccctgctgggcctgaagaagctgagcttctactacctgatcatggccaagggcggcatcgtgagaaccggcacccacggcctgctggtgaagcaggaggacatgaagggccacttcagcatcagcatccccgtgaagagcgacatcgcccccgtggccagactgctgatctacgccgtgctgcccaccggcgacgtgatcggcgacagcgccaagtacgacgtggagaactgcctggccaacaaggtggacctgagcttcagccccagccagagcctgcccgccagccacgcccacctgagagtgaccgccgccccccagagcgtgtgcgccctgagagccgtggaccagagcgtgctgctgatgaagcccgacgccgagctgagcgccagcagcgtgtacaacctgctgcccgagaaggacctgaccggcttccccggccccctgaacgaccaggacaacgaggactgcatcaacagacacaacgtgtacatcaacggcatcacctacacccccgtgagcagcaccaacgagaaggacatgtacagcttcctggaggacatgggcctgaaggccttcaccaacagcaagatcagaaagcccaagatgtgcccccagctgcagcagtacgagatgcacggccccgagggcctgagagtgggcttctacgagagcgacgtgatgggcagaggccacgccagactggtgcacgtggaggagccccacaccgagaccgtgagaaagtacttccccgagacctggatctgggacctggtggtggtgaacagcgccggcgtggccgaggtgggcgtgaccgtgcccgacaccatcaccgagtggaaggccggcgccttctgcctgagcgaggacgccggcctgggcatcagcagcaccgccagcctgagagccttccagcccttcttcgtggagctgaccatgccctacagcgtgatcagaggcgaggccttcaccctgaaggccaccgtgctgaactacctgcccaagtgcatcagagtgagcgtgcagctggaggccagccccgccttcctggccgtgcccgtggagaaggagcaggccccccactgcatctgcgccaacggcagacagaccgtgagctgggccgtgacccccaagagcctgggcaacgtgaacttcaccgtgagcgccgaggccctggagagccaggagctgtgcggcaccgaggtgcccagcgtgcccgagcacggcagaaaggacaccgtgatcaagcccctgctggtggagcccgagggcctggagaaggagaccaccttcaacagcctgctgtgccccagcggcggcgaggtgagcgaggagctgagcctgaagctgccccccaacgtggtggaggagagcgccagagccagcgtgagcgtgctgggcgacatcctgggcagcgccatgcagaacacccagaacctgctgcagatgccctacggctgcggcgagcagaacatggtgctgttcgcccccaacatctacgtgctggactacctgaacgagacccagcagctgacccccgagatcaagagcaaggccatcggctacctgaacaccggctaccagagacagctgaactacaagcactacgacggcagctacagcaccttcggcgagagatacggcagaaaccagggcaacacctggctgaccgccttcgtgctgaagaccttcgcccaggccagagcctacatcttcatcgacgaggcccacatcacccaggccctgatctggctgagccagagacagaaggacaacggctgcttcagaagcagcggcagcctgctgaacaacgccatcaagggcggcgtggaggacgaggtgaccctgagcgcctacatcaccatcgccctgctggagatccccctgaccgtgacccaccccgtggtgagaaacgccctgttctgcctggagagcgcctggaagaccgcccaggagggcgaccacggcagccacgtgtacaccaaggccctgctggcctacgccttcgccctggccggcaaccaggacaagagaaaggaggtgctgaagagcctgaacgaggaggccgtgaagaaggacaacagcgtgcactgggagagaccccagaagcccaaggcccccgtgggccacttctacgagccccaggcccccagcgccgaggtggagatgaccagctacgtgctgctggcctacctgaccgcccagcccgcccccaccagcgaggacctgaccagcgccaccaacatcgtgaagtggatcaccaagcagcagaacgcccagggcggcttcagcagcacccaggacaccgtggtggccctgcacgccctgagcaagtacggcgccgccaccttcaccagaaccggcaaggccgcccaggtgaccatccagagcagcggcaccttcagcagcaagttccaggtggacaacaacaacagactgctgctgcagcaggtgagcctgcccgagctgcccggcgagtacagcatgaaggtgaccggcgagggctgcgtgtacctgcagaccagcctgaagtacaacatcctgcccgagaaggaggagttccccttcgccctgggcgtgcagaccctgccccagacctgcgacgagcccaaggcccacaccagcttccagatcagcctgagcgtgagctacaccggcagcagaagcgccagcaacatggccatcgtggacgtgaagatggtgagcggcttcatccccctgaagcccaccgtgaagatgctggagagaagcaaccacgtgagcagaaccgaggtgagcagcaaccacgtgctgatctacctggacaaggtgagcaaccagaccctgagcctgttcttcaccgtgctgcaggacgtgcccgtgagagacctgaagcccgccatcgtgaaggtgtacgactactacgagaccgacgagttcgccatcgccgagtacaacgccccctgcagcaaggacctgggcaacgcctag

SEQ ID NO: 72551 - DNA, 507 bp, Artificial Sequence
  Description of Artificial Sequence: Synthetic coding sequence
atgggcaagaacaagctgctgcaccccagcctggtgctgctgctgctggtgctgctgcccaccgacgccagcgtgagcggcaagccccagtacatggtgctggtgcccagcctgctgcacaccgagaccaccgagaagggctgcgtgctgctgagctacctgaacgagaccgtgaccgtgagcgccagcctggagagcgtgagaggcaacagaagcctgttcaccgacctggaggccgagaacgacgtgctgcactgcgtggccttcgccgtgcccaagagcagcagcaacgaggaggtgatgttcctgaccgtgcaggtgaagggccccacccaggagttcaagaagagaaccaccgtgatggtgaagaacgaggacagcctggtgttcgtgcagaccgacaagagcatctacaagcccggccagaccgtgaagttcagagtggtgagcatggacgagaacttccaccccctgaacgagctgatccccctggtgtacatccagtag

SEQ ID NO: 72552 - DNA, 4470 bp, Artificial Sequence
  Description of Artificial Sequence: Synthetic coding sequence
agagtgcagtacgtgtgcagcccccccgcccccagcttctgcaacatgggcaagaacaagctgctgcaccccagcctggtgctgctgctgctggtgctgctgcccaccgacgccagcgtgagcggcaagccccagtacatggtgctggtgcccagcctgctgcacaccgagaccaccgagaagggctgcgtgctgctgagctacctgaacgagaccgtgaccgtgagcgccagcctggagagcgtgagaggcaacagaagcctgttcaccgacctggaggccgagaacgacgtgctgcactgcgtggccttcgccgtgcccaagagcagcagcaacgaggaggtgatgttcctgaccgtgcaggtgaagggccccacccaggagttcaagaagagaaccaccgtgatggtgaagaacgaggacagcctggtgttcgtgcagaccgacaagagcatctacaagcccggccagaccgtgaagttcagagtggtgagcatggacgagaacttccaccccctgaacgagctgatccccctggtgtacatccaggaccccaagggcaacagaatcgcccagtggcagagcttccagctggagggcggcctgaagcagttcagcttccccctgagcagcgagcccttccagggcagctacaaggtggtggtgcagaagaagagcggcggcagaaccgagcaccccttcaccgtggaggagttcgtgctgcccaagttcgaggtgcaggtgaccgtgcccaagatcatcaccatcctggaggaggagatgaacgtgagcgtgtgcggcctgtacacctacggcaagcccgtgcccggccacgtgaccgtgagcatctgcagaaagtacagcgacgccagcgactgccacggcgaggacagccaggccttctgcgagaagttcagcggccagctgaacagccacggctgcttctaccagcaggtgaagaccaaggtgttccagctgaagagaaaggagtacgagatgaagctgcacaccgaggcccagatccaggaggagggcaccgtggtggagctgaccggcagacagagcagcgagatcaccagaaccatcaccaagctgagcttcgtgaaggtggacagccacttcagacagggcatccccttcttcggccaggtgagactggtggacggcaagggcgtgcccatccccaacaaggtgatcttcatcagaggcaacgaggccaactactacagcaacgccaccaccgacgagcacggcctggtgcagttcagcatcaacaccaccaacgtgatgggcaccagcctgaccgtgagagtgaactacaaggacagaagcccctgctacggctaccagtgggtgagcgaggagcacgaggaggcccaccacaccgcctacctggtgttcagccccagcaagagcttcgtgcacctggagcccatgagccacgagctgccctgcggccacacccagaccgtgcaggcccactacatcctgaacggcggcaccctgctgggcctgaagaagctgagcttctactacctgatcatggccaagggcggcatcgtgagaaccggcacccacggcctgctggtgaagcaggaggacatgaagggccacttcagcatcagcatccccgtgaagagcgacatcgcccccgtggccagactgctgatctacgccgtgctgcccaccggcgacgtgatcggcgacagcgccaagtacgacgtggagaactgcctggccaacaaggtggacctgagcttcagccccagccagagcctgcccgccagccacgcccacctgagagtgaccgccgccccccagagcgtgtgcgccctgagagccgtggaccagagcgtgctgctgatgaagcccgacgccgagctgagcgccagcagcgtgtacaacctgctgcccgagaaggacctgaccggcttccccggccccctgaacgaccaggacaacgaggactgcatcaacagacacaacgtgtacatcaacggcatcacctacacccccgtgagcagcaccaacgagaaggacatgtacagcttcctggaggacatgggcctgaaggccttcaccaacagcaagatcagaaagcccaagatgtgcccccagctgcagcagtacgagatgcacggccccgagggcctgagagtgggcttctacgagagcgacgtgatgggcagaggccacgccagactggtgcacgtggaggagccccacaccgagaccgtgagaaagtacttccccgagacctggatctgggacctggtggtggtgaacagcgccggcgtggccgaggtgggcgtgaccgtgcccgacaccatcaccgagtggaaggccggcgccttctgcctgagcgaggacgccggcctgggcatcagcagcaccgccagcctgagagccttccagcccttcttcgtggagctgaccatgccctacagcgtgatcagaggcgaggccttcaccctgaaggccaccgtgctgaactacctgcccaagtgcatcagagtgagcgtgcagctggaggccagccccgccttcctggccgtgcccgtggagaaggagcaggccccccactgcatctgcgccaacggcagacagaccgtgagctgggccgtgacccccaagagcctgggcaacgtgaacttcaccgtgagcgccgaggccctggagagccaggagctgtgcggcaccgaggtgcccagcgtgcccgagcacggcagaaaggacaccgtgatcaagcccctgctggtggagcccgagggcctggagaaggagaccaccttcaacagcctgctgtgccccagcggcggcgaggtgagcgaggagctgagcctgaagctgccccccaacgtggtggaggagagcgccagagccagcgtgagcgtgctgggcgacatcctgggcagcgccatgcagaacacccagaacctgctgcagatgccctacggctgcggcgagcagaacatggtgctgttcgcccccaacatctacgtgctggactacctgaacgagacccagcagctgacccccgagatcaagagcaaggccatcggctacctgaacaccggctaccagagacagctgaactacaagcactacgacggcagctacagcaccttcggcgagagatacggcagaaaccagggcaacacctggctgaccgccttcgtgctgaagaccttcgcccaggccagagcctacatcttcatcgacgaggcccacatcacccaggccctgatctggctgagccagagacagaaggacaacggctgcttcagaagcagcggcagcctgctgaacaacgccatcaagggcggcgtggaggacgaggtgaccctgagcgcctacatcaccatcgccctgctggagatccccctgaccgtgacccaccccgtggtgagaaacgccctgttctgcctggagagcgcctggaagaccgcccaggagggcgaccacggcagccacgtgtacaccaaggccctgctggcctacgccttcgccctggccggcaaccaggacaagagaaaggaggtgctgaagagcctgaacgaggaggccgtgaagaaggacaacagcgtgcactgggagagaccccagaagcccaaggcccccgtgggccacttctacgagccccaggcccccagcgccgaggtggagatgaccagctacgtgctgctggcctacctgaccgcccagcccgcccccaccagcgaggacctgaccagcgccaccaacatcgtgaagtggatcaccaagcagcagaacgcccagggcggcttcagcagcacccaggacaccgtggtggccctgcacgccctgagcaagtacggcgccgccaccttcaccagaaccggcaaggccgcccaggtgaccatccagagcagcggcaccttcagcagcaagttccaggtggacaacaacaacagactgctgctgcagcaggtgagcctgcccgagctgcccggcgagtacagcatgaaggtgaccggcgagggctgcgtgtacctgcagaccagcctgaagtacaacatcctgcccgagaaggaggagttccccttcgccctgggcgtgcagaccctgccccagacctgcgacgagcccaaggcccacaccagcttccagatcagcctgagcgtgagctacaccggcagcagaagcgccagcaacatggccatcgtggacgtgaagatggtgagcggcttcatccccctgaagcccaccgtgaagatgctggagagaagcaaccacgtgagcagaaccgaggtgagcagcaaccacgtgctgatctacctggacaaggtgagcaaccagaccctgagcctgttcttcaccgtgctgcaggacgtgcccgtgagagacctgaagcccgccatcgtgaaggtgtacgactactacgagaccgacgagttcgccatcgccgagtacaacgccccctgcagcaaggacctgggcaacgcctag

SEQ ID NO: 72553 - DNA, 4365 bp, Artificial Sequence
  Description of Artificial Sequence: Synthetic coding sequence
atgtgggcccagctgctgctgggcatgctggccctgagccccgccatcgccgaggagctgcccaactacctggtgaccctgcccgccagactgaacttccccagcgtgcagaaggtgtgcctggacctgagccccggctacagcgacgtgaagttcaccgtgaccctggagaccaaggacaagacccagaagctgctggagtacagcggcctgaagaagagacacctgcactgcatcagcttcctggtgcccccccccgccggcggcaccgaggaggtggccaccatcagagtgagcggcgtgggcaacaacatcagcttcgaggagaagaagaaggtgctgatccagagacagggcaacggcaccttcgtgcagaccgacaagcccctgtacacccccggccagcaggtgtacttcagaatcgtgaccatggacagcaacttcgtgcccgtgaacgacaagtacagcatggtggagctgcaggaccccaacagcaacagaatcgcccagtggctggaggtggtgcccgagcagggcatcgtggacctgagcttccagctggcccccgaggccatgctgggcacctacaccgtggccgtggccgagggcaagaccttcggcaccttcagcgtggaggagtacgtgctgcccaagttcaaggtggaggtggtggagcccaaggagctgagcaccgtgcaggagagcttcctggtgaagatctgctgcagatacacctacggcaagcccatgctgggcgccgtgcaggtgagcgtgtgccagaaggccaacacctactggtacagagaggtggagagagagcagctgcccgacaagtgcagaaacctgagcggccagaccgacaagaccggctgcttcagcgcccccgtggacatggccaccttcgacctgatcggctacgcctacagccaccagatcaacatcgtggccaccgtggtggaggagggcaccggcgtggaggccaacgccacccagaacatctacatcagcccccagatgggcagcatgaccttcgaggacaccagcaacttctaccaccccaacttccccttcagcggcaagatcagagtgagaggccacgacgacagcttcctgaagaaccacctggtgttcctggtgatctacggcaccaacggcaccttcaaccagaccctggtgaccgacaacaacggcctggcccccttcaccctggagaccagcggctggaacggcaccgacgtgagcctggagggcaagttccagatggaggacctggtgtacaaccccgagcaggtgcccagatactaccagaacgcctacctgcacctgagacccttctacagcaccaccagaagcttcctgggcatccacagactgaacggccccctgaagtgcggccagccccaggaggtgctggtggactactacatcgaccccgccgacgccagccccgaccaggagatcagcttcagctactacctgatcggcaagggcagcctggtgatggagggccagaagcacctgaacagcaagaagaagggcctgaaggccagcttcagcctgagcctgaccttcaccagcagactggcccccgaccccagcctggtgatctacgccatcttccccagcggcggcgtggtggccgacaagatccagttcagcgtggagatgtgcttcgacaaccaggtgagcctgggcttcagccccagccagcagctgcccggcgccgaggtggagctgcagctgcaggccgcccccggcagcctgtgcgccctgagagccgtggacgagagcgtgctgctgctgagacccgacagagagctgagcaacagaagcgtgtacggcatgttccccttctggtacggccactacccctaccaggtggccgagtacgaccagtgccccgtgagcggcccctgggacttcccccagcccctgatcgaccccatgccccagggccacagcagccagagaagcatcatctggagacccagcttcagcgagggcaccgacctgttcagcttcttcagagacgtgggcctgaagatcctgagcaacgccaagatcaagaagcccgtggactgcagccacagaagccccgagtacagcaccgccatgggcgccggcggcggccaccccgaggccttcgagagcagcacccccctgcaccaggccgaggacagccaggtgagacagtacttccccgagacctggctgtgggacctgttccccatcggcaacagcggcaaggaggccgtgcacgtgaccgtgcccgacgccatcaccgagtggaaggccatgagcttctgcaccagccagagcagaggcttcggcctgagccccaccgtgggcctgaccgccttcaagcccttcttcgtggacctgaccctgccctacagcgtggtgagaggcgagagcttcagactgaccgccaccatcttcaactacctgaaggactgcatcagagtgcagaccgacctggccaagagccacgagtaccagctggagagctgggccgacagccagaccagcagctgcctgtgcgccgacgacgccaagacccaccactggaacatcaccgccgtgaagctgggccacatcaacttcaccatcagcaccaagatcctggacagcaacgagccctgcggcggccagaagggcttcgtgccccagaagggcagaagcgacaccctgatcaagcccgtgctggtgaagcccgagggcgtgctggtggagaagacccacagcagcctgctgtgccccaagggcaaggtggccagcgagagcgtgagcctggagctgcccgtggacatcgtgcccgacagcaccaaggcctacgtgaccgtgctgggcgacatcatgggcaccgccctgcagaacctggacggcctggtgcagatgcccagcggctgcggcgagcagaacatggtgctgttcgcccccatcatctacgtgctgcagtacctggagaaggccggcctgctgaccgaggagatcagaagcagagccgtgggcttcctggagatcggctaccagaaggagctgatgtacaagcacagcaacggcagctacagcgccttcggcgagagagacggcaacggcaacacctggctgaccgccttcgtgaccaagtgcttcggccaggcccagaagttcatcttcatcgaccccaagaacatccaggacgccctgaagtggatggccggcaaccagctgcccagcggctgctacgccaacgtgggcaacctgctgcacaccgccatgaagggcggcgtggacgacgaggtgagcctgaccgcctacgtgaccgccgccctgctggagatgggcaaggacgtggacgaccccatggtgagccagggcctgagatgcctgaagaacagcgccaccagcaccaccaacctgtacacccaggccctgctggcctacatcttcagcctggccggcgagatggacatcagaaacatcctgctgaagcagctggaccagcaggccatcatcagcggcgagagcatctactggagccagaagcccacccccagcagcaacgccagcccctggagcgagcccgccgccgtggacgtggagctgaccgcctacgccctgctggcccagctgaccaagcccagcctgacccagaaggagatcgccaaggccaccagcatcgtggcctggctggccaagcagcacaacgcctacggcggcttcagcagcacccaggacaccgtggtggccctgcaggccctggccaagtacgccaccaccgcctacatgcccagcgaggagatcaacctggtggtgaagagcaccgagaacttccagagaaccttcaacatccagagcgtgaacagactggtgttccagcaggacaccctgcccaacgtgcccggcatgtacaccctggaggccagcggccagggctgcgtgtacgtgcagaccgtgctgagatacaacatcctgccccccaccaacatgaagaccttcagcctgagcgtggagatcggcaaggccagatgcgagcagcccaccagccccagaagcctgaccctgaccatccacaccagctacgtgggcagcagaagcagcagcaacatggccatcgtggaggtgaagatgctgagcggcttcagccccatggagggcaccaaccagctgctgctgcagcagcccctggtgaagaaggtggagttcggcaccgacaccctgaacatctacctggacgagctgatcaagaacacccagacctacaccttcaccatcagccagagcgtgctggtgaccaacctgaagcccgccaccatcaaggtgtacgactactacctgcccgacgagcaggccaccatccagtacagcgacccctgcgagtag

SEQ ID NO: 72554 - DNA, 4365 bp, Artificial Sequence
  Description of Artificial Sequence: Synthetic coding sequence
atgtgggcccagctgctgctgggcatgctggccctgagccccgccatcgccgaggagctgcccaactacctggtgaccctgcccgccagactgaacttccccagcgtgcagaaggtgtgcctggacctgagccccggctacagcgacgtgaagttcaccgtgaccctggagaccaaggacaagacccagaagctgctggagtacagcggcctgaagaagagacacctgcactgcatcagcttcctggtgcccccccccgccggcggcaccgaggaggtggccaccatcagagtgagcggcgtgggcaacaacatcagcttcgaggagaagaagaaggtgctgatccagagacagggcaacggcaccttcgtgcagaccgacaagcccctgtacacccccggccagcaggtgtacttcagaatcgtgaccatggacagcaacttcgtgcccgtgaacgacaaggtgagctgggaggagggccaggaccccaacagcaacagaatcgcccagtggctggaggtggtgcccgagcagggcatcgtggacctgagcttccagctggcccccgaggccatgctgggcacctacaccgtggccgtggccgagggcaagaccttcggcaccttcagcgtggaggagtacgtgctgcccaagttcaaggtggaggtggtggagcccaaggagctgagcaccgtgcaggagagcttcctggtgaagatctgctgcagatacacctacggcaagcccatgctgggcgccgtgcaggtgagcgtgtgccagaaggccaacacctactggtacagagaggtggagagagagcagctgcccgacaagtgcagaaacctgagcggccagaccgacaagaccggctgcttcagcgcccccgtggacatggccaccttcgacctgatcggctacgcctacagccaccagatcaacatcgtggccaccgtggtggaggagggcaccggcgtggaggccaacgccacccagaacatctacatcagcccccagatgggcagcatgaccttcgaggacaccagcaacttctaccaccccaacttccccttcagcggcaagatcagagtgagaggccacgacgacagcttcctgaagaaccacctggtgttcctggtgatctacggcaccaacggcaccttcaaccagaccctggtgaccgacaacaacggcctggcccccttcaccctggagaccagcggctggaacggcaccgacgtgagcctggagggcaagttccagatggaggacctggtgtacaaccccgagcaggtgcccagatactaccagaacgcctacctgcacctgagacccttctacagcaccaccagaagcttcctgggcatccacagactgaacggccccctgaagtgcggccagccccaggaggtgctggtggactactacatcgaccccgccgacgccagccccgaccaggagatcagcttcagctactacctgatcggcaagggcagcctggtgatggagggccagaagcacctgaacagcaagaagaagggcctgaaggccagcttcagcctgagcctgaccttcaccagcagactggcccccgaccccagcctggtgatctacgccatcttccccagcggcggcgtggtggccgacaagatccagttcagcgtggagatgtgcttcgacaaccaggtgagcctgggcttcagccccagccagcagctgcccggcgccgaggtggagctgcagctgcaggccgcccccggcagcctgtgcgccctgagagccgtggacgagagcgtgctgctgctgagacccgacagagagctgagcaacagaagcgtgtacggcatgttccccttctggtacggccactacccctaccaggtggccgagtacgaccagtgccccgtgagcggcccctgggacttcccccagcccctgatcgaccccatgccccagggccacagcagccagagaagcatcatctggagacccagcttcagcgagggcaccgacctgttcagcttcttcagagacgtgggcctgaagatcctgagcaacgccaagatcaagaagcccgtggactgcagccacagaagccccgagtacagcaccgccatgggcgccggcggcggccaccccgaggccttcgagagcagcacccccctgcaccaggccgaggacagccaggtgagacagtacttccccgagacctggctgtgggacctgttccccatcggcaacagcggcaaggaggccgtgcacgtgaccgtgcccgacgccatcaccgagtggaaggccatgagcttctgcaccagccagagcagaggcttcggcctgagccccaccgtgggcctgaccgccttcaagcccttcttcgtggacctgaccctgccctacagcgtggtgagaggcgagagcttcagactgaccgccaccatcttcaactacctgaaggactgcatcagagtgcagaccgacctggccaagagccacgagtaccagctggagagctgggccgacagccagaccagcagctgcctgtgcgccgacgacgccaagacccaccactggaacatcaccgccgtgaagctgggccacatcaacttcaccatcagcaccaagatcctggacagcaacgagccctgcggcggccagaagggcttcgtgccccagaagggcagaagcgacaccctgatcaagcccgtgctggtgaagcccgagggcgtgctggtggagaagacccacagcagcctgctgtgccccaagggcaaggtggccagcgagagcgtgagcctggagctgcccgtggacatcgtgcccgacagcaccaaggcctacgtgaccgtgctgggcgacatcatgggcaccgccctgcagaacctggacggcctggtgcagatgcccagcggctgcggcgagcagaacatggtgctgttcgcccccatcatctacgtgctgcagtacctggagaaggccggcctgctgaccgaggagatcagaagcagagccgtgggcttcctggagatcggctaccagaaggagctgatgtacaagcacagcaacggcagctacagcgccttcggcgagagagacggcaacggcaacacctggctgaccgccttcgtgaccaagtgcttcggccaggcccagaagttcatcttcatcgaccccaagaacatccaggacgccctgaagtggatggccggcaaccagctgcccagcggctgctacgccaacgtgggcaacctgctgcacaccgccatgaagggcggcgtggacgacgaggtgagcctgaccgcctacgtgaccgccgccctgctggagatgggcaaggacgtggacgaccccatggtgagccagggcctgagatgcctgaagaacagcgccaccagcaccaccaacctgtacacccaggccctgctggcctacatcttcagcctggccggcgagatggacatcagaaacatcctgctgaagcagctggaccagcaggccatcatcagcggcgagagcatctactggagccagaagcccacccccagcagcaacgccagcccctggagcgagcccgccgccgtggacgtggagctgaccgcctacgccctgctggcccagctgaccaagcccagcctgacccagaaggagatcgccaaggccaccagcatcgtggcctggctggccaagcagcacaacgcctacggcggcttcagcagcacccaggacaccgtggtggccctgcaggccctggccaagtacgccaccaccgcctacatgcccagcgaggagatcaacctggtggtgaagagcaccgagaacttccagagaaccttcaacatccagagcgtgaacagactggtgttccagcaggacaccctgcccaacgtgcccggcatgtacaccctggaggccagcggccagggctgcgtgtacgtgcagaccgtgctgagatacaacatcctgccccccaccaacatgaagaccttcagcctgagcgtggagatcggcaaggccagatgcgagcagcccaccagccccagaagcctgaccctgaccatccacaccagctacgtgggcagcagaagcagcagcaacatggccatcgtggaggtgaagatgctgagcggcttcagccccatggagggcaccaaccagctgctgctgcagcagcccctggtgaagaaggtggagttcggcaccgacaccctgaacatctacctggacgagctgatcaagaacacccagacctacaccttcaccatcagccagagcgtgctggtgaccaacctgaagcccgccaccatcaaggtgtacgactactacctgcccgacgagcaggccaccatccagtacagcgacccctgcgagtag

SEQ ID NO: 72555 - DNA, 3015 bp, Artificial Sequence
  Description of Artificial Sequence: Synthetic coding sequence
agcttcctgggcatccacagactgaacggccccctgaagtgcggccagccccaggaggtgctggtggactactacatcgaccccgccgacgccagccccgaccaggagatcagcttcagctactacctgatcggcaagggcagcctggtgatggagggccagaagcacctgaacagcaagaagaagggcctgaaggccagcttcagcctgagcctgaccttcaccagcagactggcccccgaccccagcctggtgatctacgccatcttccccagcggcggcgtggtggccgacaagatccagttcagcgtggagatgtgcttcgacaaccaggtgagcctgggcttcagccccagccagcagctgcccggcgccgaggtggagctgcagctgcaggccgcccccggcagcctgtgcgccctgagagccgtggacgagagcgtgctgctgctgagacccgacagagagctgagcaacagaagcgtgtacggcatgttccccttctggtacggccactacccctaccaggtggccgagtacgaccagtgccccgtgagcggcccctgggacttcccccagcccctgatcgaccccatgccccagggccacagcagccagagaagcatcatctggagacccagcttcagcgagggcaccgacctgttcagcttcttcagagacgtgggcctgaagatcctgagcaacgccaagatcaagaagcccgtggactgcagccacagaagccccgagtacagcaccgccatgggcgccggcggcggccaccccgaggccttcgagagcagcacccccctgcaccaggccgaggacagccaggtgagacagtacttccccgagacctggctgtgggacctgttccccatcggcaacagcggcaaggaggccgtgcacgtgaccgtgcccgacgccatcaccgagtggaaggccatgagcttctgcaccagccagagcagaggcttcggcctgagccccaccgtgggcctgaccgccttcaagcccttcttcgtggacctgaccctgccctacagcgtggtgagaggcgagagcttcagactgaccgccaccatcttcaactacctgaaggactgcatcagagtgcagaccgacctggccaagagccacgagtaccagctggagagctgggccgacagccagaccagcagctgcctgtgcgccgacgacgccaagacccaccactggaacatcaccgccgtgaagctgggccacatcaacttcaccatcagcaccaagatcctggacagcaacgagccctgcggcggccagaagggcttcgtgccccagaagggcagaagcgacaccctgatcaagcccgtgctggtgaagcccgagggcgtgctggtggagaagacccacagcagcctgctgtgccccaagggcaaggtggccagcgagagcgtgagcctggagctgcccgtggacatcgtgcccgacagcaccaaggcctacgtgaccgtgctgggcgacatcatgggcaccgccctgcagaacctggacggcctggtgcagatgcccagcggctgcggcgagcagaacatggtgctgttcgcccccatcatctacgtgctgcagtacctggagaaggccggcctgctgaccgaggagatcagaagcagagccgtgggcttcctggagatcggctaccagaaggagctgatgtacaagcacagcaacggcagctacagcgccttcggcgagagagacggcaacggcaacacctggctgaccgccttcgtgaccaagtgcttcggccaggcccagaagttcatcttcatcgaccccaagaacatccaggacgccctgaagtggatggccggcaaccagctgcccagcggctgctacgccaacgtgggcaacctgctgcacaccgccatgaagggcggcgtggacgacgaggtgagcctgaccgcctacgtgaccgccgccctgctggagatgggcaaggacgtggacgaccccatggtgagccagggcctgagatgcctgaagaacagcgccaccagcaccaccaacctgtacacccaggccctgctggcctacatcttcagcctggccggcgagatggacatcagaaacatcctgctgaagcagctggaccagcaggccatcatcagcggcgagagcatctactggagccagaagcccacccccagcagcaacgccagcccctggagcgagcccgccgccgtggacgtggagctgaccgcctacgccctgctggcccagctgaccaagcccagcctgacccagaaggagatcgccaaggccaccagcatcgtggcctggctggccaagcagcacaacgcctacggcggcttcagcagcacccaggacaccgtggtggccctgcaggccctggccaagtacgccaccaccgcctacatgcccagcgaggagatcaacctggtggtgaagagcaccgagaacttccagagaaccttcaacatccagagcgtgaacagactggtgttccagcaggacaccctgcccaacgtgcccggcatgtacaccctggaggccagcggccagggctgcgtgtacgtgcagaccgtgctgagatacaacatcctgccccccaccaacatgaagaccttcagcctgagcgtggagatcggcaaggccagatgcgagcagcccaccagccccagaagcctgaccctgaccatccacaccagctacgtgggcagcagaagcagcagcaacatggccatcgtggaggtgaagatgctgagcggcttcagccccatggagggcaccaaccagctgctgctgcagcagcccctggtgaagaaggtggagttcggcaccgacaccctgaacatctacctggacgagctgatcaagaacacccagacctacaccttcaccatcagccagagcgtgctggtgaccaacctgaagcccgccaccatcaaggtgtacgactactacctgcccgacgagcaggccaccatccagtacagcgacccctgcgagtag

SEQ ID NO: 72556 - DNA, 1830 bp, Artificial Sequence
  Description of Artificial Sequence: Synthetic coding sequence
atgaagtgggtggagagcatcttcctgatcttcctgctgaacttcaccgagagcagaaccctgcacagaaacgagtacggcatcgccagcatcctggacagctaccagtgcaccgccgagatcagcctggccgacctggccaccatcttcttcgcccagttcgtgcaggaggccacctacaaggaggtgagcaagatggtgaaggacgccctgaccgccatcgagaagcccaccggcgacgagcagagcagcggctgcctggagaaccagctgcccgccttcctggaggagctgtgccacgagaaggagatcctggagaagtacggccacagcgactgctgcagccagagcgaggagggcagacacaactgcttcctggcccacaagaagcccacccccgccagcatccccctgttccaggtgcccgagcccgtgaccagctgcgaggcctacgaggaggacagagagaccttcatgaacaagttcatctacgagatcgccagaagacaccccttcctgtacgcccccaccatcctgctgtgggccgccagatacgacaagatcatccccagctgctgcaaggccgagaacgccgtggagtgcttccagaccaaggccgccaccgtgaccaaggagctgagagagagcagcctgctgaaccagcacgcctgcgccgtgatgaagaacttcggcaccagaaccttccaggccatcaccgtgaccaagctgagccagaagttcaccaaggtgaacttcaccgagatccagaagctggtgctggacgtggcccacgtgcacgagcactgctgcagaggcgacgtgctggactgcctgcaggacggcgagaagatcatgagctacatctgcagccagcaggacaccctgagcaacaagatcaccgagtgctgcaagctgaccaccctggagagaggccagtgcatcatccacgccgagaacgacgagaagcccgagggcctgagccccaacctgaacagattcctgggcgacagagacttcaaccagttcagcagcggcgagaagaacatcttcctggccagcttcgtgcacgagtacagcagaagacacccccagctggccgtgagcgtgatcctgagagtggccaagggctaccaggagctgctggagaagtgcttccagaccgagaaccccctggagtgccaggacaagggcgaggaggagctgcagaagtacatccaggagagccaggccctggccaagagaagctgcggcctgttccagaagctgggcgagtactacctgcagaacgccttcctggtggcctacaccaagaaggccccccagctgaccagcagcgagctgatggccatcaccagaaagatggccgccaccgccgccacctgctgccagctgagcgaggacaagctgctggcctgcggcgagggcgccgccgacatcatcatcggccacctgtgcatcagacacgagatgacccccgtgaaccccggcgtgggccagtgctgcaccagcagctacgccaacagaagaccctgcttcagcagcctggtggtggacgagacctacgtgccccccgccttcagcgacgacaagttcatcttccacaaggacctgtgccaggcccagggcgtggccctgcagaccatgaagcaggagttcctgatcaacctggtgaagcagaagccccagatcaccgaggagcagctggaggccgtgatcgccgacttcagcggcctgctggagaagtgctgccagggccaggagcaggaggtgtgcttcgccgaggagggccagaagctgatcagcaagaccagagccgccctgggcgtgtag

SEQ ID NO: 72557 - DNA, 3735 bp, Artificial Sequence
  Description of Artificial Sequence: Synthetic coding sequence
atgaacaaccagaaggtggtggccgtgctgctgcaggagtgcaagcaggtgctggaccagctgctgctggaggcccccgacgtgagcgaggaggacaagagcgaggaccagagatgcagagccctgctgcccagcgagctgagaaccctgatccaggaggccaaggagatgaagtggcccttcgtgcccgagaagtggcagtacaagcaggccgtgggccccgaggacaagaccaacctgaaggacgtgatcggcgccggcctgcagcagctgctggccagcctgagagccagcatcctggccagagactgcgccgccgccgccgccatcgtgttcctggtggacagattcctgtacggcctggacgtgagcggcaagctgctgcaggtggccaagggcctgcacaagctgcagcccgccacccccatcgccccccaggtggtgatcagacaggccagaatcagcgtgaacagcggcaagctgctgaaggccgagtacatcctgagcagcctgatcagcaacaacggcgccaccggcacctggctgtacagaaacgagagcgacaaggtgctggtgcagagcgtgtgcatccagatcagaggccagatcctgcagaagctgggcatgtggtacgaggccgccgagctgatctgggccagcatcgtgggctacctggccctgccccagcccgacaagaagggcctgagcaccagcctgggcatcctggccgacatcttcgtgagcatgagcaagaacgactacgagaagttcaagaacaacccccagatcaacctgagcctgctgaaggagttcgaccaccacctgctgagcgccgccgaggcctgcaagctggccgccgccttcagcgcctacacccccctgttcgtgctgaccgccgtgaacatcagaggcacctgcctgctgagctacagcagcagcaacgactgcccccccgagctgaagaacctgcacctgtgcgaggccaaggaggccttcgagatcggcctgctgaccaagagagacgacgagcccgtgaccggcaagcaggagctgcacagcttcgtgaaggccgccttcggcctgaccaccgtgcacagaagactgcacggcgagaccggcaccgtgcacgccgccagccagctgtgcaaggaggccatgggcaagctgtacaacttcagcaccagcagcagaagccaggacagagaggccctgagccaggaggtgatgagcgtgatcgcccaggtgaaggagcacctgcaggtgcagagcttcagcaacgtggacgacagaagctacgtgcccgagagcttcgagtgcagactggacaagctgatcctgcacggccagggcgacttccagaagatcctggacacctacagccagcaccacaccagcgtgtgcgaggtgttcgagagcgactgcggcaacaacaagaacgagcagaaggacgccaagaccggcgtgtgcatcaccgccctgaagaccgagatcaagaacatcgacaccgtgagcaccacccaggagaagccccactgccagagagacaccggcatcagcagcagcctgatgggcaagaacgtgcagagagagctgagaagaggcggcagaagaaactggacccacagcgacgccttcagagtgagcctggaccaggacgtggagaccgagaccgagcccagcgactacagcaacggcgagggcgccgtgttcaacaagagcctgagcggcagccagaccagcagcgcctggagcaacctgagcggcttcagcagcagcgccagctgggaggaggtgaactaccacgtggacgacagaagcgccagaaaggagcccggcaaggagcacctggtggacacccagtgcagcaccgccctgagcgaggagctggagaacgacagagagggcagagccatgcacagcctgcacagccagctgcacgacctgagcctgcaggagcccaacaacgacaacctggagcccagccagaaccagccccagcagcagatgcccctgacccccttcagcccccacaacacccccggcatcttcctggcccccggcgccggcctgctggagggcgcccccgagggcatccaggaggtgagaaacatgggccccagaaacaccagcgcccacagcagacccagctacagaagcgccagctggagcagcgacagcggcagacccaagaacatgggcacccaccccagcgtgcagaaggaggaggccttcgagatcatcgtggagttccccgagaccaactgcgacgtgaaggacagacagggcaaggagcagggcgaggagatcagcgagagaggcgccggccccaccttcaaggccagccccagctgggtggaccccgagggcgagaccgccgagagcaccgaggacgcccccctggacttccacagagtgctgcacaacagcctgggcaacatcagcatgctgccctgcagcagcttcacccccaactggcccgtgcagaaccccgacagcagaaagagcggcggccccgtggccgagcagggcatcgaccccgacgccagcaccgtggacgaggagggccagctgctggacagcatggacgtgccctgcaccaacggccacggcagccacagactgtgcatcctgagacagccccccggccagagagccgagacccccaacagcagcgtgagcggcaacatcctgttccccgtgctgagcgaggactgcaccaccaccgaggagggcaaccagcccggcaacatgctgaactgcagccagaacagcagcagcagcagcgtgtggtggctgaagagccccgccttcagcagcggcagcagcgagggcgacagcccctggagctacctgaacagcagcggcagcagctgggtgagcctgcccggcaagatgagaaaggagatcctggaggccagaaccctgcagcccgacgacttcgagaagctgctggccggcgtgagacacgactggctgttccagagactggagaacaccggcgtgttcaagcccagccagctgcacagagcccacagcgccctgctgctgaagtacagcaagaagagcgagctgtggaccgcccaggagaccatcgtgtacctgggcgactacctgaccgtgaagaagaagggcagacagagaaacgccttctgggtgcaccacctgcaccaggaggagatcctgggcagatacgtgggcaaggactacaaggagcagaagggcctgtggcaccacttcaccgacgtggagagacagatgaccgcccagcactacgtgaccgagttcaacaagagactgtacgagcagaacatccccacccagatcttctacatccccagcaccatcctgctgatcctggaggacaagaccatcaagggctgcatcagcgtggagccctacatcctgggcgagttcgtgaagctgagcaacaacaccaaggtggtgaagaccgagtacaaggccaccgagtacggcctggcctacggccacttcagctacgagttcagcaaccacagagacgtggtggtggacctgcagggctgggtgaccggcaacggcaagggcctgatctacctgaccgacccccagatccacagcgtggaccagaaggtgttcaccaccaacttcggcaagagaggcatcttctacttcttcaacaaccagcacgtggagtgcaacgagatctgccacagactgagcctgaccagacccagcatggagaagccctgcacctag

SEQ ID NO: 72558 - DNA, 429 bp, Artificial Sequence
  Description of Artificial Sequence: Synthetic coding sequence
atgaacaaccagaaggtggtggccgtgctgctgcaggagtgcaaggccctgctgcccagcgagctgagaaccctgatccaggaggccaaggagatgaagtggcccttcgtgcccgagaagtggcagtacaagcaggccgtgggccccgaggacaagaccaacctgaaggacgtgatcggcgccggcctgcagcagctgctggccagcctgagagccagcatcctggccagagactgcgccgccgccgccgccatcgtgttcctggtggacagattcctgtacggcctggacgtgagcggcaagctgctgcaggtggccaagggcctgcacaagctgcagcccgccacccccatcgccccccaggtggtgatcagacaggccagaatcagcgtgaacagcggcagccaccccgccaagcacagcatgtag

SEQ ID NO: 72559 - DNA, 3735 bp, Artificial Sequence; identical to SEQ ID NO: 72557
  Description of Artificial Sequence: Synthetic coding sequence

SEQ ID NO: 72560 - DNA, 3501 bp, Artificial Sequence
  Description of Artificial Sequence: Synthetic coding sequence
atgtgcagaaagagaaccagagccagaaccagcgccgccgaggccagcctgagagccagcatcctggccagagactgcgccgccgccgccgccatcgtgttcctggtggacagattcctgtacggcctggacgtgagcggcaagctgctgcaggtggccaagggcctgcacaagctgcagcccgccacccccatcgccccccaggtggtgatcagacaggccagaatcagcgtgaacagcggcaagctgctgaaggccgagtacatcctgagcagcctgatcagcaacaacggcgccaccggcacctggctgtacagaaacgagagcgacaaggtgctggtgcagagcgtgtgcatccagatcagaggccagatcctgcagaagctgggcatgtggtacgaggccgccgagctgatctgggccagcatcgtgggctacctggccctgccccagcccgacaagaagggcctgagcaccagcctgggcatcctggccgacatcttcgtgagcatgagcaagaacgactacgagaagttcaagaacaacccccagatcaacctgagcctgctgaaggagttcgaccaccacctgctgagcgccgccgaggcctgcaagctggccgccgccttcagcgcctacacccccctgttcgtgctgaccgccgtgaacatcagaggcacctgcctgctgagctacagcagcagcaacgactgcccccccgagctgaagaacctgcacctgtgcgaggccaaggaggccttcgagatcggcctgctgaccaagagagacgacgagcccgtgaccggcaagcaggagctgcacagcttcgtgaaggccgccttcggcctgaccaccgtgcacagaagactgcacggcgagaccggcaccgtgcacgccgccagccagctgtgcaaggaggccatgggcaagctgtacaacttcagcaccagcagcagaagccaggacagagaggccctgagccaggaggtgatgagcgtgatcgcccaggtgaaggagcacctgcaggtgcagagcttcagcaacgtggacgacagaagctacgtgcccgagagcttcgagtgcagactggacaagctgatcctgcacggccagggcgacttccagaagatcctggacacctacagccagcaccacaccagcgtgtgcgaggtgttcgagagcgactgcggcaacaacaagaacgagcagaaggacgccaagaccggcgtgtgcatcaccgccctgaagaccgagatcaagaacatcgacaccgtgagcaccacccaggagaagccccactgccagagagacaccggcatcagcagcagcctgatgggcaagaacgtgcagagagagctgagaagaggcggcagaagaaactggacccacagcgacgccttcagagtgagcctggaccaggacgtggagaccgagaccgagcccagcgactacagcaacggcgagggcgccgtgttcaacaagagcctgagcggcagccagaccagcagcgcctggagcaacctgagcggcttcagcagcagcgccagctgggaggaggtgaactaccacgtggacgacagaagcgccagaaaggagcccggcaaggagcacctggtggacacccagtgcagcaccgccctgagcgaggagctggagaacgacagagagggcagagccatgcacagcctgcacagccagctgcacgacctgagcctgcaggagcccaacaacgacaacctggagcccagccagaaccagccccagcagcagatgcccctgacccccttcagcccccacaacacccccggcatcttcctggcccccggcgccggcctgctggagggcgcccccgagggcatccaggaggtgagaaacatgggccccagaaacaccagcgcccacagcagacccagctacagaagcgccagctggagcagcgacagcggcagacccaagaacatgggcacccaccccagcgtgcagaaggaggaggccttcgagatcatcgtggagttccccgagaccaactgcgacgtgaaggacagacagggcaaggagcagggcgaggagatcagcgagagaggcgccggccccaccttcaaggccagccccagctgggtggaccccgagggcgagaccgccgagagcaccgaggacgcccccctggacttccacagagtgctgcacaacagcctgggcaacatcagcatgctgccctgcagcagcttcacccccaactggcccgtgcagaaccccgacagcagaaagagcggcggccccgtggccgagcagggcatcgaccccgacgccagcaccgtggacgaggagggccagctgctggacagcatggacgtgccctgcaccaacggccacggcagccacagactgtgcatcctgagacagccccccggccagagagccgagacccccaacagcagcgtgagcggcaacatcctgttccccgtgctgagcgaggactgcaccaccaccgaggagggcaaccagcccggcaacatgctgaactgcagccagaacagcagcagcagcagcgtgtggtggctgaagagccccgccttcagcagcggcagcagcgagggcgacagcccctggagctacctgaacagcagcggcagcagctgggtgagcctgcccggcaagatgagaaaggagatcctggaggccagaaccctgcagcccgacgacttcgagaagctgctggccggcgtgagacacgactggctgttccagagactggagaacaccggcgtgttcaagcccagccagctgcacagagcccacagcgccctgctgctgaagtacagcaagaagagcgagctgtggaccgcccaggagaccatcgtgtacctgggcgactacctgaccgtgaagaagaagggcagacagagaaacgccttctgggtgcaccacctgcaccaggaggagatcctgggcagatacgtgggcaaggactacaaggagcagaagggcctgtggcaccacttcaccgacgtggagagacagatgaccgcccagcactacgtgaccgagttcaacaagagactgtacgagcagaacatccccacccagatcttctacatccccagcaccatcctgctgatcctggaggacaagaccatcaagggctgcatcagcgtggagccctacatcctgggcgagttcgtgaagctgagcaacaacaccaaggtggtgaagaccgagtacaaggccaccgagtacggcctggcctacggccacttcagctacgagttcagcaaccacagagacgtggtggtggacctgcagggctgggtgaccggcaacggcaagggcctgatctacctgaccgacccccagatccacagcgtggaccagaaggtgttcaccaccaacttcggcaagagaggcatcttctacttcttcaacaaccagcacgtggagtgcaacgagatctgccacagactgagcctgaccagacccagcatggagaagccctgcacctag

SEQ ID NO: 72561 - DNA, 1149 bp, Artificial Sequence
  Description of Artificial Sequence: Synthetic coding sequence
atggccctgcagggcatcagcgtggtggagctgagcggcctggcccccggccccttctgcgccatggtgctggccgacttcggcgccagagtggtgagagtggacagacccggcagcagatacgacgtgagcagactgggcagaggcaagagaagcctggtgctggacctgaagcagcccagaggcgccgccgtgctgagaagactgtgcaagagaagcgacgtgctgctggagcccttcagaagaggcgtgatggagaagctgcagctgggccccgagatcctgcagagagagaaccccagactgatctacgccagactgagcggcttcggccagagcggcagcttctgcagactggccggccacgacatcaactacctggccctgagcggcgtgctgagcaagatcggcagaagcggcgagaacccctacgcccccctgaacctgctggccgacttcgccggcggcggcctgatgtgcgccctgggcatcatcatggccctgttcgacagaaccagaaccggcaagggccaggtgatcgacgccaacatggtggagggcaccgcctacctgagcagcttcctgtggaagacccagaagctgagcctgtgggaggcccccagaggccagaacatgctggacggcggcgcccccttctacaccacctacagaaccgccgacggcgagttcatggccgtgggcgccatcgagccccagttctacgagctgctgatcaagggcctgggcctgaagagcgacgagctgcccaaccagatgagcatggacgactggcccgagatgaagaagaagttcgccgacgtgttcgccgagaagaccaaggccgagtggtgccagatcttcgacggcaccgacgcctgcgtgacccccgtgctgaccttcgaggaggtggtgcaccacgaccacaacaaggagagaggcagcttcatcaccagcgaggagcaggacgtgagccccagacccgcccccctgctgctgaacacccccgccatccccagcttcaagagagaccccttcatcggcgagcacaccgaggagatcctggaggagttcggcttcagcagagaggagatctaccagctgaacagcgacaagatcatcgagagcaacaaggtgaaggccagcctgtag

SEQ ID NO: 72562 - DNA, 597 bp, Artificial Sequence
  Description of Artificial Sequence: Synthetic coding sequence
atggccctgcagggcatcagcgtggtggagctgagcggcctggcccccggccccttctgcgccatggtgctggccgacttcggcgccagagtggtgagagtggacagacccggcagcagatacgacgtgagcagactgggcagaggcaagagaagcctggtgctggacctgaagcagcccagaggcgccgccgtgctgagaagactgtgcaagagaagcgacgtgctgctggagcccttcagaagaggcgtgatggagaagctgcagctgggccccgagatcctgcagagagagaaccccagactgatctacgccagactgagcggcttcggccagagcggcagcttctgcagactggccggccacgacatcaactacctggccctgagcggcggcagaaacagcatcttcaagttcttcagcgtggagaacagcgagatcgagagcgtgggcagcaccagcagaaccgagcacgtgggctggtggagcaccttcctgtacgacctgcaggacagcagatggggcatccacggctgctggagcaacagaacccccgtgctgagagccgccgaccagagaacctggaccaaggtgtag

SEQ ID NO: 72563 - DNA, 690 bp, Artificial Sequence
  Description of Artificial Sequence: Synthetic coding sequence
atggccctgcagggcatcagcgtggtggagctgagcggcctggcccccggccccttctgcgccatggtgctggccgacttcggcgccagagtggtgagagtggacagacccggcagcagatacgacgtgagcagactgggcagaggcaagagaagcctggtgctggacctgaagcagcccagaggcgccgccgtgctgagaagactgtgcaagagaagcgacgtgctgctggagcccttcagaagaggcgtgatggagaagctgcagctgggccccgagatcctgcagagagagaaccccagactgatctacgccagactgagcggcttcggccagagcggcagcttctgcagactggccggccacgacatcaactacctggccctgagcggcggcagaaacagcatcttcaagttcttcagcgtggagaacagcgagatcgagagcgtgggcagcaccagcagaaccgagcacgtgggctggtggagcaccttcctgtacgacctgcaggacagcagatggggcatccacggctgctggagcaacagaacccccgtgctgagagccgccgaccagagaagcctgatcccctacttcaacctgtacctgcagttcctgaacatcagcatgcagaacctgttcaaggtgcacaccctgctgagaccctgctacttcctgggccagaagtag

SEQ ID NO: 72564 - DNA, 1185 bp, Artificial Sequence
  Description of Artificial Sequence: Synthetic coding sequence
atggccctgcagggcatcagcgtggtggagctgagcggcctggcccccggccccttctgcgccatggtgctggccgacttcggcgccagagtggtgagagtggacagacccggcagcagatacgacgtgagcagactgggcagaggcaagagaagcctggtgctggacctgaagcagcccagaggcgccgccgtgctgagaagactgtgcaagagaagcgacgtgctgctggagcccttcagaagaggcgtgatggagaagctgcagctgggccccgagatcctgcagagagagaaccccagactgatctacgccagactgagcggcttcggccagagcggcagcttctgcagactggccggccacgacatcaactacctggccctgagcggcgtgctgagcaagatcggcagaagcggcgagaacccctacgcccccctgaacctgctggccgacttcgccggcggcggcctgatgtgcgccctgggcatcatcatggccctgttcgacagaaccagaaccggcaagggccaggtgatcgacgccaacatggtggagggcaccgcctacctgagcagcttcctgtggaagacccagaagctgagcctgtgggaggcccccagaggccagaacatgctggacggcggcgcccccttctacaccacctacagaaccgccgacggcgagttcatggccgtgggcgccatcgagccccagttctacgagctgctgatcaagggcctgggcctgaagagcgacgagctgcccaaccagatgagcatggacgactggcccgagatgaagaagaagttcgccgacgtgttcgccgagaagaccaaggccgagtggtgccagatcttcgacggcaccgacgcctgcgtgacccccgtgctgaccttcgaggaggtggtgcaccacgaccacaacaaggagagaggcagcttcatcaccagcgaggagcaggacgtgagccccagacccgcccccctgctgctgaacacccccgccatccccagcttcaagagagaccccttcatcggcgagcacaccgaggagatcctggaggagttcggcttcagcagagaggagatctaccagctgaacagcgacaagatcatcgagagcaacaaggccggcagcaagttctggatcctgtaccccacccacagcaacatccagaagtag

SEQ ID NO: 72565 - DNA, 1002 bp, Artificial Sequence
  Description of Artificial Sequence: Synthetic coding sequence
atggccgccggctgctgcggcgtgaagaagcagaagctgagcagcagcccccccagcggcagcggcggcggcggcggcgccagcagcagcagccactgcagcggcgagagccagtgcagagccggcgagctgggcctgggcggcgccggcaccagactgaacggcctgggcggcctgaccggcggcggcagcggcagcggctgcaccctgagccccccccagggctgcggcggcggcggcggcggcatcgccctgagccccccccccagctgcggcgtgggcaccctgctgagcacccccgccgccgccaccagcagcagccccagcagcagcagcgccgccagcagcagcagccccggcagcagaaagatggtggtgagcgccgagatgtgctgcttctgcttcgacgtgctgtactgccacctgtacggctaccagcagcccagaacccccagattcaccaacgagccctaccccctgttcgtgacctggaagatcggcagagacaagagactgagaggctgcatcggcaccttcagcgccatgaacctgcacagcggcctgagagagtacaccctgaccagcgccctgaaggacagcagattcccccccatgaccagagacgagctgcccagactgttctgcagcgtgagcctgctgaccaacttcgaggacgtgtgcgactacctggactgggaggtgggcgtgcacggcatcagaatcgagttcatcaacgagaagggcagcaagagaaccgccacctacctgcccgaggtggccaaggagcagggctgggaccacatccagaccatcgacagcctgctgagaaagggcggctacaaggcccccatcaccaacgagttcagaaagaccatcaagctgaccagatacagaagcgagaagatgaccctgagctacgccgagtacctggcccacagacagcaccaccacttccagaacggcatcggccaccccctgcccccctacaaccactacagctag

SEQ ID NO: 72566 - DNA, 633 bp, Artificial Sequence
  Description of Artificial Sequence: Synthetic coding sequence
atggtggtgagcgccgagatgtgctgcttctgcttcgacgtgctgtactgccacctgtacggctaccagcagcccagaacccccagattcaccaacgagccctaccccctgttcgtgacctggaagatcggcagagacaagagactgagaggctgcatcggcaccttcagcgccatgaacctgcacagcggcctgagagagtacaccctgaccagcgccctgaaggacagcagattcccccccatgaccagagacgagctgcccagactgttctgcagcgtgagcctgctgaccaacttcgaggacgtgtgcgactacctggactgggaggtgggcgtgcacggcatcagaatcgagttcatcaacgagaagggcagcaagagaaccgccacctacctgcccgaggtggccaaggagcagggctgggaccacatccagaccatcgacagcctgctgagaaagggcggctacaaggcccccatcaccaacgagttcagaaagaccatcaagctgaccagatacagaagcgagaagatgaccctgagctacgccgagtacctggcccacagacagcaccaccacttccagaacggcatcggccaccccctgcccccctacaaccactacagctag

SEQ ID NO: 72567 - DNA, 891 bp, Artificial Sequence
  Description of Artificial Sequence: Synthetic coding sequence
atggccgccggctgctgcggcgtgaagaagcagaagctgagcagcagcccccccagcggcagcggcggcggcggcggcgccagcagcagcagccactgcagcggcgagagccagtgcagagccggcgagctgggcctgggcggcgccggcaccagactgaacggcctgggcggcctgaccggcggcggcagcggcagcggctgcaccctgagccccccccagggctgcggcggcggcggcggcggcatcgccctgagccccccccccagctgcggcgtgggcaccctgctgagcacccccgccgccgccaccagcagcagccccagcagcagcagcgccgccagcagcagcagccccggcagcagaaagatggtggtgagcgccgagatgtgctgcttctgcttcgacgtgctgtactgccacctgtacggctaccagcagcccagaacccccagattcaccaacgagccctacgccctgaaggacagcagattcccccccatgaccagagacgagctgcccagactgttctgcagcgtgagcctgctgaccaacttcgaggacgtgtgcgactacctggactgggaggtgggcgtgcacggcatcagaatcgagttcatcaacgagaagggcagcaagagaaccgccacctacctgcccgaggtggccaaggagcagggctgggaccacatccagaccatcgacagcctgctgagaaagggcggctacaaggcccccatcaccaacgagttcagaaagaccatcaagctgaccagatacagaagcgagaagatgaccctgagctacgccgagtacctggcccacagacagcaccaccacttccagaacggcatcggccaccccctgcccccctacaaccactacagctag

SEQ ID NO: 72568 - DNA, 2862 bp, Artificial Sequence
  Description of Artificial Sequence: Synthetic coding sequence
atgtgcaaccccgaggaggccgccctgctgagactggaggaggtgttcagcgccaccctggcccacgtgaacagcctggtgctgcagcccctgctgcccgccgcccccgaccccagcgacccctggggcagagagtgcctgagactgctgcagcagctgcacaagagcagccagcagctgtgggaggtgaccgaggagagcctgcacagcctgcaggagagactgagataccccgacagcaccggcctggagagcctgctgctgctgagaggcgccgacagagtgctgcaggcccacatcgagtacatcgagagctacaccagctgcatggtggtgcaggccttccagaaggccgccaagagaagaagcgagtactggagaggccagagaaaggccctgagacagctgctgagcggcgtgagcagcgagggcagcgtgggcgccagcctgggccaggccctgcaccagcccctggcccaccacgtgcagcagtacgtgctgctgctgctgagcctgggcgacaccatcggcgagcaccaccccaccagagagctggtggtgaacgccgtgaccctgttcggcaacctgcagagcttcatgaagcaggagctggaccaggccgtggccacccaggccctgtggcacaccctgagaggcagactgagagacgtgctgtgcacccccgcccacagactgctgcaggacagccaggacgtgcccgtgaccgtggcccccctgagagccgagagagtgctgctgttcgacgacgccctggtgctgctgcagggccacaacgtgcacaccttcgacctgaagctggtgtgggtggaccccggccaggacggctgcaccttccacctgctgacccccgaggaggagttcagcttctgcgccaaggacagccagggccaggccgtgtggcagtggaaggtgacctgggccgtgcaccaggccctgcacggcaagaaggacttccccgtgctgggcgccggcctggagcccagccagccccccgactgcagatgcgccgagtacaccttccaggccgagggcagactgtgccaggccacctacgagggcgagtggtgcagaggcagaccccacggcaagggcaccctgaagtggcccgacggcagaaaccacgtgggcaacttctgccagggcctggagcacggcttcggcatcagactgctgccccaggccagcgaggacaagttcgactgctacaagtgccactggagagagggcagcatgtgcggctacggcatctgcgagtacagcaccgacgaggtgtacaagggctacttccaggagggcctgagacacggcttcggcgtgctggagagcggcccccaggccccccagcccttcagatacaccggccactgggagagaggccagagaagcggctacggcatcgaggaggacggcgacagaggcgagagatacatcggcatgtggcaggccggccagagacacggccccggcgtgatggtgacccaggccggcgtgtgctaccagggcaccttccaggccgacaagaccgtgggccccggcatcctgctgagcgaggacgacagcctgtacgagggcaccttcaccagagacctgaccctgatgggcaagggcaaggtgaccttccccaacggcttcaccctggagggcagcttcggcagcggcgccggcagaggcctgcacacccagggcgtgctggacaccgccgccctgccccccgaccccagcagcacctgcaagagacagctgggcgtgggcgccttccccgtggagagcagatggcagggcgtgtacagccccttcagagacttcgtgtgcgccggctgccccagagacctgcaggaggccctgctgggcttcgacgtgcagagcagcagagagctgagaagaagccaggactacctgagctgcgagagaacccaccccgaggacagcgtgggcagcatggaggacatcctggaggagctgctgcagcacagagagcccaaggccctgcagctgtacctgagaaaggccctgagcaacagcctgcaccccctgggcaagctgctgagaaccctgatgctgaccttccaggccacctacgccggcgtgggcgccaacaagcacctgcaggagctggcccaggaggaggtgaagcagcacgcccaggagctgtgggccgcctacagaggcctgctgagagtggccctggagagaaagggccaggccctggaggaggacgaggacaccgagaccagagacctgcaggtgcacggcctggtgctgcccctgatgctgcccagcttctacagcgagctgttcaccctgtacctgctgctgcacgagagagaggacagcttctacagccagggcatcgccaacctgagcctgttccccgacacccagctgctggagttcctggacgtgcagaagcacctgtggcccctgaaggacctgaccctgaccagcaaccagagatacagcctggtgagagacaagtgcttcctgagcgccaccgagtgcctgcagaagatcatgaccaccgtggaccccagagagaagctggaggtgctggagagaacctacggcgagatcgagggcaccgtgagcagagtgctgggcagagagtacaagctgcccatggacgacctgctgcccctgctgatctacgtggtgagcagagccagaatccagcacctgggcgccgagatccacctgatcagagacatgatggaccccaaccacaccggcggcctgtacgacttcctgctgaccgccctggagagctgctacgagcacatccagaaggaggacatgagactgcacagactgcccggccactggcacagcagagagctgtggtag

SEQ ID NO: 72569 - DNA, 903 bp, Artificial Sequence
  Description of Artificial Sequence: Synthetic coding sequence
atggaggacatcctggaggagctgctgcagcacagagagcccaaggccctgcagctgtacctgagaaaggccctgagcaacagcctgcaccccctgggcaagctgctgagaaccctgatgctgaccttccaggccacctacgccggcgtgggcgccaacaagcacctgcaggagctggcccaggaggaggtgaagcagcacgcccaggagctgtgggccgcctacagaggcctgctgagagtggccctggagagaaagggccaggccctggaggaggacgaggacaccgagaccagagacctgcaggtgcacggcctggtgctgcccctgatgctgcccagcttctacagcgagctgttcaccctgtacctgctgctgcacgagagagaggacagcttctacagccagggcatcgccaacctgagcctgttccccgacacccagctgctggagttcctggacgtgcagaagcacctgtggcccctgaaggacctgaccctgaccagcaaccagagatacagcctggtgagagacaagtgcttcctgagcgccaccgagtgcctgcagaagatcatgaccaccgtggaccccagagagaagctggaggtgctggagagaacctacggcgagatcgagggcaccgtgagcagagtgctgggcagagagtacaagctgcccatggacgacctgctgcccctgctgatctacgtggtgagcagagccagaatccagcacctgggcgccgagatccacctgatcagagacatgatggaccccaaccacaccggcggcctgtacgacttcctgctgaccgccctggagagctgctacgagcacatccagaaggaggacatgagactgcacagactgcccggccactggcacagcagagagctgtggtag

SEQ ID NO: 72570 - DNA, 2862 bp, Artificial Sequence; identical to SEQ ID NO: 72568
  Description of Artificial Sequence: Synthetic coding sequence

SEQ ID NO: 72571 - DNA, 12504 bp, Artificial Sequence
  Description of Artificial Sequence: Synthetic coding sequence
atggagcccgaggacctgccctggcccggcgagctggaggaggaggaggaggaggaggaggaggaggaggaggaggaggaggaggccgccgccgccgccgccgccaacgtggacgacgtggtggtggtggaggaggtggaggaggaggccggcagagagctggacagcgacagccactacggcccccagcacctggagagcatcgacgacgaggaggacgaggaggccaaggcctggctgcaggcccaccccggcagaatcctgccccccctgagccccccccagcacagatacagcgagggcgagagaaccagcctggagaagatcgtgcccctgacctgccacgtgtggcagcagatcgtgtaccagggcaacagcagaacccagatcagcgacaccaacgtggtgtgcctggagaccaccgcccagagaggcagcggcgacgaccagaagaccgagagctggcactgcctgccccaggagatggacagcagccagaccctggacaccagccagaccagattcaacgtgagaaccgaggacaccgaggtgaccgacttccccagcctggaggagggcatcctgacccagagcgagaaccaggtgaaggagcccaacagagacctgttctgcagccccctgctggtgatccaggacagcttcgccagccccgacctgcccctgctgacctgcctgacccaggaccaggagttcgcccccgacagcctgttccaccagagcgagctgagcttcgcccccctgagaggcatccccgacaagagcgaggacaccgagtggagcagcagacccagcgaggtgagcgaggccctgttccaggccaccgccgaggtggccagcgacctggccagcagcagattcagcgtgagccagcaccccctgatcggcagcaccgccgtgggcagccagtgccccttcctgcccagcgagcagggcaacaacgaggagaccatcagcagcgtggacgagctgaagatccccaaggactgcgacagatacgacgacctgtgcagctacatgagctggaagaccagaaaggacacccagtggcccgagaacaacctggccgacaaggaccaggtgagcgtggccaccagcttcgacatcaccgacgagaacatcgccaccaagagaagcgaccacttcgacgccgccagaagctacggccagtactggacccaggaggacagcagcaagcaggccgagacctacctgaccaagggcctgcagggcaaggtggagagcgacgtgatcaccctggacggcctgaacgagaacgccgtggtgtgcagcgagagagtggccgagctgcagagaaagcccaccagagagagcgagtaccacagcagcgacctgagaatgctgagaatgagccccgacaccgtgcccaaggcccccaagcacctgaaggccggcgacaccagcaagggcggcatcgccaaggtgacccagagcaacctgaagagcggcatcaccaccacccccgtggacagcgacatcggcagccacctgagcctgagcctggaggacctgagccagctggccgtgagcagcctggagaccaccaccggccagcacaccgacaccctgaaccagaagaccctggccgacacccacctgaccgaggagaccctgaaggtgaccgccatccccgagcccgccgaccagaagaccgccacccccaccgtgctgagcagcagccacagccacagaggcaagcccagcatcttctaccagcagggcctgcccgacagccacctgaccgaggaggccctgaaggtgagcgccgcccccggcctggccgaccagaccaccggcatgagcaccctgaccagcaccagctacagccacagagagaagcccggcaccttctaccagcaggagctgcccgagagcaacctgaccgaggagcccctggaggtgagcgccgcccccggccccgtggagcagaagaccggcatccccaccgtgagcagcaccagccacagccacgtggaggacctgctgttcttctacagacagaccctgcccgacggccacctgaccgaccaggccctgaaggtgagcgccgtgagcggccccgccgaccagaagaccggcaccgccaccgtgctgagcaccccccacagccacagagagaagcccggcatcttctaccagcaggagttcgccgacagccaccagaccgaggagaccctgaccaaggtgagcgccacccccggccccgccgaccagaagaccgagatccccgccgtgcagagcagcagctacagccagagagagaagcccagcatcctgtacccccaggacctggccgacagccacctgcccgaggagggcctgaaggtgagcgccgtggccggccccgccgaccagaagaccggcctgcccaccgtgcccagcagcgcctacagccacagagagaagctgctggtgttctaccagcaggccctgctggacagccacctgcccgaggaggccctgaaggtgagcgccgtgagcggccccgccgacggcaagaccggcacccccgccgtgaccagcaccagcagcgccagcagcagcctgggcgagaagcccagcgccttctaccagcagaccctgcccaacagccacctgaccgaggaggccctgaaggtgagcatcgtgcccggccccggcgaccagaagaccggcatccccagcgcccccagcagcttctacagccacagagagaagcccatcatcttcagccagcagaccctgcccgacttcctgttccccgaggaggccctgaaggtgagcgccgtgagcgtgctggccgcccagaagaccggcacccccaccgtgagcagcaacagccacagccacagcgagaagagcagcgtgttctaccagcaggagctgcccgacagcgacctgcccagagagagcctgaagatgagcgccatccccggcctgaccgaccagaagaccgtgcccacccccaccgtgcccagcggcagcttcagccacagagagaagcccagcatcttctaccagcaggagtggcccgacagctacgccaccgagaaggccctgaaggtgagcaccggccccggccccgccgaccagaagaccgagatccccgccgtgcagagcagcagctacccccagagagagaagcccagcgtgctgtacccccaggtgctgagcgacagccacctgcccgaggagagcctgaaggtgagcgccttccccggccccgccgaccagatgaccgacacccccgccgtgcccagcaccttctacagccagagagagaagcccggcatcttctaccagcagaccctgcccgagagccacctgcccaaggaggccctgaagatcagcgtggcccccggcctggccgaccagaagaccggcacccccaccgtgaccagcaccagctacagccagcacagagagaagcccagcatcttccaccagcaggccctgcccggcacccacatccccgaggaggcccagaaggtgagcgccgtgaccggccccggcaaccagaagacctggatccccagagtgctgagcaccttctacagccagagagagaagcccggcatcttctaccagcagaccctgcccggcagccacatccccgaggaggcccagaaggtgagccccgtgctgggccccgccgaccagaagaccggcacccccacccccaccagcgccagctacagccacaccgagaagcccggcatcttctaccagcaggtgctgcccgacaaccaccccaccgaggaggccctgaagatcagcgtggccagcgagcccgtggaccagaccaccggcacccccgccgtgaccagcaccagctacagccagtacagagagaagcccagcatcttctaccagcagagcctgcccagcagccacctgaccgaggaggccaagaacgtgagcgccgtgcccggccccgccgaccagaagaccgtgatccccatcctgcccagcaccttctacagccacaccgagaagcccggcgtgttctaccagcaggtgctgccccacagccaccccaccgaggaggccctgaagatcagcgtggccagcgagcccgtggaccagaccaccggcacccccaccgtgaccagcaccagctacagccagcacaccgagaagcccagcatcttctaccagcagagcctgcccggcagccacctgaccgaggaggccaagaacgtgagcgccgtgcccggccccggcgacagaaagaccggcatccccaccctgcccagcaccttctacagccacaccgagaagcccggcagcttctaccagcaggtgctgccccacagccacctgcccgaggaggccctggaggtgagcgtggcccccggccccgtggaccagaccatcggcacccccaccgtgaccagccccagcagcagcttcggcgagaagcccatcgtgatctacaagcaggccttccccgagggccacctgcccgaggagagcctgaaggtgagcgtggcccccggccccgtgggccagaccaccggcgcccccaccatcaccagccccagctacagccagcacagagccaagagcggcagcttctaccagctggccctgctgggcagccagatccccgaggaggccctgagagtgagcagcgcccccggccccgccgaccagaccaccggcatccccaccatcaccagcaccagctacagcttcggcgagaagcccatcgtgaactacaagcaggccttccccgacggccacctgcccgaggaggccctgaaggtgagcatcgtgagcggccccaccgagaagaagaccgacatccccgccggccccctgggcagcagcgccctgggcgagaagcccatcaccttctacagacaggccctgctggacagccccctgaacaaggaggtggtgaaggtgagcgccgcccccggccccgccgaccagaagaccgagaccctgcccgtgcacagcaccagctacagcaacagaggcaagcccgtgatcttctaccagcagaccctgagcgacagccacctgcccgaggaggccctgaaggtgccccccgtgcccggccccgacgcccagaagaccgagacccccagcgtgagcagcagcctgtacagctacagagagaagcccatcgtgttctaccagcaggccctgcccgacagcgagctgacccaggaggccctgaaggtgagcgccgtgccccagcccgccgaccagaagaccggcctgagcaccgtgaccagcagcttctacagccacaccgagaagcccaacatcagctaccagcaggagctgcccgacagccacctgaccgaggaggccctgaaggtgagcaacgtgcccggccccgccgaccagaagaccggcgtgagcaccgtgaccagcaccagctacagccacagagagaagcccatcgtgagctaccagagagagctgccccacttcaccgaggccggcctgaagatcctgagagtgcccggccccgccgaccagaagaccggcatcaacatcctgcccagcaacagctacccccagagagagcacagcgtgatcagctacgagcaggagctgcccgacctgaccgaggtgaccctgaaggccatcggcgtgcccggccccgccgaccagaagaccggcatccagatcgccagcagcagcagctacagcaacagagagaaggccagcatcttccaccagcaggagctgcccgacgtgaccgaggaggccctgaacgtgttcgtggtgcccggccagggcgacagaaagaccgagatccccaccgtgcccctgagctactacagcagaagagagaagcccagcgtgatcagccagcaggagctgcccgacagccacctgaccgaggaggccctgaaggtgagccccgtgagcatccccgccgagcagaagaccggcatccccatcggcctgagcagcagctacagccacagccacaaggagaagctgaagatcagcaccgtgcacatccccgacgaccagaagaccgagttccccgccgccaccctgagcagctacagccagatcgagaagcccaagatcagcaccgtgatcggccccaacgaccagaagacccccagccagaccgccttccacagcagctacagccagaccgtgaagcccaacatcctgttccagcagcagctgcccgacagagaccagagcaagggcatcctgaagatcagcgccgtgcccgagctgaccgacgtgaacaccggcaagcccgtgagcctgagcagcagctacttccacagagagaagagcaacatcttcagcccccaggagctgcccggcagccacgtgaccgaggacgtgctgaaggtgagcaccatccccggccccgccggccagaagaccgtgctgcccaccgccctgcccagcagcttcagccacagagagaagcccgacatcttctaccagaaggacctgcccgacagacacctgaccgaggacgccctgaagatcagcagcgccctgggccaggccgaccagatcaccggcctgcagaccgtgcccagcggcacctacagccacggcgagaaccacaagctggtgagcgagcacgtgcagagactgatcgacaacctgaacagcagcgacagcagcgtgagcagcaacaacgtgctgctgaacagccaggccgacgacagagtggtgatcaacaagcccgagagcgccggcttcagagacgtgggcagcgaggagatccaggacgccgagaacagcgccaagaccctgaaggagatcagaaccctgctgatggaggccgagaacatggccctgaagagatgcaacttccccgcccccctggccagattcagagacatcagcgacatcagcttcatccagagcaagaaggtggtgtgcttcaaggagcccagcagcaccggcgtgagcaacggcgacctgctgcacagacagcccttcaccgaggagagccccagcagcagatgcatccagaaggacatcggcacccagaccaacctgaagtgcagaagaggcatcgagaactgggagttcatcagcagcaccaccgtgagaagccccctgcaggaggccgagagcaaggtgagcatggccctggaggagaccctgagacagtaccaggccgccaagagcgtgatgagaagcgagcccgagggctgcagcggcaccatcggcaacaagatcatcatccccatgatgaccgtgatcaagagcgacagcagcagcgacgccagcgacggcaacggcagctgcagctgggacagcaacctgcccgagagcctggagagcgtgagcgacgtgctgctgaacttcttcccctacgtgagccccaagaccagcatcaccgacagcagagaggaggagggcgtgagcgagagcgaggacggcggcggcagcagcgtggacagcctggccgcccacgtgaagaacctgctgcagtgcgagagcagcctgaaccacgccaaggagatcctgagaaacgccgaggaggaggagagcagagtgagagcccacgcctggaacatgaagttcaacctggcccacgactgcggctacagcatcagcgagctgaacgaggacgacagaagaaaggtggaggagatcaaggccgagctgttcggccacggcagaaccaccgacctgagcaagggcctgcagagccccagaggcatgggctgcaagcccgaggccgtgtgcagccacatcatcatcgagagccacgagaagggctgcttcagaaccctgaccagcgagcacccccagctggacagacacccctgcgccttcagaagcgccggccccagcgagatgaccagaggcagacagaaccccagcagctgcagagccaagcacgtgaacctgagcgccagcctggaccagaacaacagccacttcaaggtgtggaacagcctgcagctgaagagccacagccccttccagaacttcatccccgacgagttcaagatcagcaagggcctgagaatgcccttcgacgagaagatggacccctggctgagcgagctggtggagcccgccttcgtgccccccaaggaggtggacttccacagcagcagccagatgcccagccccgagcccatgaagaagttcaccaccagcatcaccttcagcagccacagacacagcaagtgcatcagcaacagcagcgtggtgaaggtgggcgtgaccgagggcagccagtgcaccggcgccagcgtgggcgtgttcaacagccacttcaccgaggagcagaacccccccagagacctgaagcagaagaccagcagccccagcagcttcaagatgcacagcaacagccaggacaaggaggtgaccatcctggccgagggcagaagacagagccagaagctgcccgtggacttcgagagaagcttccaggaggagaagcccctggagagaagcgacttcaccggcagccacagcgagcccagcaccagagccaactgcagcaacttcaaggagatccagatcagcgacaaccacaccctgatcagcatgggcagacccagcagcaccctgggcgtgaacagaagcagcagcagactgggcgtgaaggagaagaacgtgaccatcacccccgacctgcccagctgcatcttcctggagcagagagagctgttcgagcagagcaaggcccccagagccgacgaccacgtgagaaagcaccacagccccagcccccagcaccaggactacgtggcccccgacctgcccagctgcatcttcctggagcagagagagctgttcgagcagtgcaaggccccctacgtggaccaccagatgagagagaaccacagccccctgccccagggccaggacagcatcgccagcgacctgcccagccccatcagcctggagcagtgccagagcaaggcccccggcgtggacgaccagatgaacaagcaccacttccccctgccccagggccaggactgcgtggtggagaagaacaaccagcacaagcccaagagccacatcagcaacatcaacgtggaggccaagttcaacaccgtggtgagccagagcgcccccaaccactgcaccctggccgccagcgccagcaccccccccagcaacagaaaggccctgagctgcgtgcacatcaccctgtgccccaagaccagcagcaagctggacagcggcaccctggacgagagattccacagcctggacgccgccagcaaggccagaatgaacagcgagttcaacttcgacctgcacaccgtgagcagcagaagcctggagcccaccagcaagctgctgaccagcaagcccgtggcccaggaccaggagagcctgggcttcctgggccccaagagcagcctggacttccaggtggtgcagcccagcctgcccgacagcaacaccatcacccaggacctgaagaccatccccagccagaacagccagatcgtgaccagcagacagatccaggtgaacatcagcgacttcgagggccacagcaaccccgagggcacccccgtgttcgccgacagactgcccgagaagatgaagacccccctgagcgccttcagcgagaagctgagcagcgacgccgtgacccagatcaccaccgagagccccgagaagaccctgttcagcagcgagatcttcatcaacgccgaggacagaggccacgagatcatcgagcccggcaaccagaagctgagaaaggcccccgtgaagttcgccagcagcagcagcgtgcagcaggtgaccttcagcagaggcaccgacggccagcccctgctgctgccctacaagcccagcggcagcaccaagatgtactacgtgccccagctgagacagatcccccccagccccgacagcaagagcgacaccaccgtggagagcagccacagcggcagcaacgacgccatcgcccccgacttccccgcccaggtgctgggcaccagagacgacgacctgagcgccaccgtgaacatcaagcacaaggagggcatctacagcaagagagtggtgaccaaggccagcctgcccgtgggcgagaagcccctgcagaacgagaacgccgacgccagcgtgcaggtgctgatcaccggcgacgagaacctgagcgacaagaagcagcaggagatccacagcaccagagccgtgaccgaggccgcccaggccaaggagaaggagagcctgcagaaggacaccgccgacagcagcgccgccgccgccgccgagcacagcgcccaggtgggcgaccccgagatgaagaacctgcccgacaccaaggccatcacccagaaggaggagatccacagaaagaagaccgtgcccgaggaggcctggcccaacaacaaggagagcctgcagatcaacatcgaggagagcgagtgccacagcgagttcgagaacaccaccagaagcgtgttcagaagcgccaagttctacatccaccaccccgtgcacctgcccagcgaccaggacatctgccacgagagcctgggcaagagcgtgttcatgagacacagctggaaggacttcttccagcaccaccccgacaagcacagagagcacatgtgcctgcccctgccctaccagaacatggacaagaccaagaccgactacaccagaatcaagagcctgagcatcaacgtgaacctgggcaacaaggaggtgatggacaccaccaagagccaggtgagagactaccccaagcacaacggccagatcagcgacccccagagagaccagaaggtgacccccgagcagaccacccagcacaccgtgagcctgaacgagctgtggaacaagtacagagagagacagagacagcagagacagcccgagctgggcgacagaaaggagctgagcctggtggacagactggacagactggccaagatcctgcagaaccccatcacccacagcctgcaggtgagcgagagcacccacgacgacagcagaggcgagagaagcgtgaaggagtggagcggcagacagcagcagagaaacaagctgcagaagaagaagagattcaagagcctggagaagagccacaagaacaccggcgagctgaagaagagcaaggtgctgagccaccacagagccggcagaagcaaccagatcaagatcgagcagatcaagttcgacaagtacatcctgagcaagcagcccggcttcaactacatcagcaacaccagcagcgactgcagacccagcgaggagagcgagctgctgaccgacaccaccaccaacatcctgagcggcaccaccagcaccgtggagagcgacatcctgacccagaccgacagagaggtggccctgcacgagagaagcagcagcgtgagcaccatcgacaccgccagactgatccaggccttcggccacgagagagtgtgcctgagccccagaagaatcaagctgtacagcagcatcaccaaccagcagagaagatacctggagaagagaagcaagcacagcaagaaggtgctgaacaccggccaccccctggtgaccagcgagcacaccagaagaagacacatccaggtggccaaccacgtgatcagcagcgacagcatcagcagcagcgccagcagcttcctgagcagcaacagcaccttctgcaacaagcagaacgtgcacatgctgaacaagggcatccaggccggcaacctggagatcgtgaacggcgccaagaagcacaccagagacgtgggcatcaccttccccacccccagcagcagcgaggccaagctggaggagaacagcgacgtgaccagctggagcgaggagaagagagaggagaagatgctgttcaccggctaccccgaggacagaaagctgaagaagaacaagaagaacagccacgagggcgtgagctggttcgtgcccgtggagaacgtggagagcagaagcaagaaggagaacgtgcccaacacctgcggccccggcatcagctggttcgagcccatcaccaagaccagaccctggagagagcccctgagagagcagaactgccagggccagcacctggacggcagaggctacctggccggccccggcagagaggccggcagagacctgctgagacccttcgtgagagccaccctgcaggagagcctgcagttccacagacccgacttcatcagcagaagcggcgagagaatcaagagactgaagctgatcgtgcaggagagaaagctgcagagcatgctgcagaccgagagagacgccctgttcaacatcgacagagagagacagggccaccagaacagaatgtgccccctgcccaagagagtgttcctggccatccagaagaacaagcccatcagcaagaaggagatgatccagagaagcaagagaatctacgagcagctgcccgaggtgcagaagaagagagaggaggagaagagaaagagcgagtacaagagctacagactgagagcccagctgtacaagaagagagtgaccaaccagctgctgggcagaaaggtgccctgggactag

SEQ ID NO: 72572 - DNA, 7686 bp, Artificial Sequence
  Description of Artificial Sequence: Synthetic coding sequence
atggagcccgaggacctgccctggcccggcgagctggaggaggaggaggaggaggaggaggaggaggaggaggaggaggaggaggccgccgccgccgccgccgccaacgtggacgacgtggtggtggtggaggaggtggaggaggaggccggcagagagctggacagcgacagccactacggcccccagcacctggagagcatcgacgacgaggaggacgaggaggccaaggcctggctgcaggcccaccccggcagaatcctgccccccctgagccccccccagcacagatacagcgagggcgagagaaccagcctggagaagatcgtgcccctgacctgccacgtgtggcagcagatcgtgtaccagggcaacagcagaacccagatcagcgacaccaacgtggtgtgcctggagaccaccgcccagagaggcagcggcgacgaccagaagaccgagagctggcactgcctgccccaggagatggacagcagccagaccctggacaccagccagaccagattcaacgtgagaaccgaggacaccgaggtgaccgacttccccagcctggaggagggcatcctgacccagagcgagaaccaggtgaaggagcccaacagagacctgttctgcagccccctgctggtgatccaggacagcttcgccagccccgacctgcccctgctgacctgcctgacccaggaccaggagttcgcccccgacagcctgttccaccagagcgagctgagcttcgcccccctgagaggcatccccgacaagagcgaggacaccgagtggagcagcagacccagcgaggtgagcgaggccctgttccaggccaccgccgaggtggccagcgacctggccagcagcagattcagcgtgagccagcaccccctgatcggcagcaccgccgtgggcagccagtgccccttcctgcccagcgagcagggcaacaacgaggagaccatcagcagcgtggacgagctgaagatccccaaggactgcgacagatacgacgacctgtgcagctacatgagctggaagaccagaaaggacacccagtggcccgagaacaacctggccgacaaggaccaggtgagcgtggccaccagcttcgacatcaccgacgagaacatcgccaccaagagaagcgaccacttcgacgccgccagaagctacggccagtactggacccaggaggacagcagcaagcaggccgagacctacctgaccaagggcctgcagggcaaggtggagagcgacgtgatcaccctggacggcctgaacgagaacgccgtggtgtgcagcgagagagtggccgagctgcagagaaagcccaccagagagagcgagtaccacagcagcgacctgagaatgctgagaatgagccccgacaccgtgcccaaggcccccaagcacctgaaggccggcgacaccagcaagggcggcatcgccaaggtgacccagagcaacctgaagagcggcatcaccaccacccccgtggacagcgacatcggcagccacctgagcctgagcctggaggacctgagccagctggccgtgagcagcctggagaccaccaccggccagcacaccgacaccctgaaccagaagaccctggccgacacccacctgaccgaggagaccctgaaggtgaccgccatccccgagcccgccgaccagaagaccgccacccccaccgtgctgagcagcagccacagccacagaggcaagcccagcatcttctaccagcagggcctgcccgacagccacctgaccgaggaggccctgaaggtgagcgccgcccccggcctggccgaccagaccaccggcatgagcaccctgaccagcaccagctacagccacagagagaagcccggcaccttctaccagcaggagctgcccgagagcaacctgaccgaggagcccctggaggtgagcgccgcccccggccccgtggagcagaagaccggcatccccaccgtgagcagcaccagccacagccacgtggaggacctgctgttcttctacagacagaccctgcccgacggccacctgaccgaccaggccctgaaggtgagcgccgtgagcggccccgccgaccagaagaccggcaccgccaccgtgctgagcaccccccacagccacagagagaagcccggcatcttctaccagcaggagttcgccgacagccaccagaccgaggagaccctgaccaaggtgagcgccacccccggccccgccgaccagaagaccgagatccccgccgtgcagagcagcagctacagccagagagagaagcccagcatcctgtacccccaggacctggccgacagccacctgcccgaggagggcctgaaggtgagcgccgtggccggccccgccgaccagaagaccggcctgcccaccgtgcccagcagcgcctacagccacagagagaagctgctggtgttctaccagcaggccctgctggacagccacctgcccgaggaggccctgaaggtgagcgccgtgagcggccccgccgacggcaagaccggcacccccgccgtgaccagcaccagcagcgccagcagcagcctgggcgagaagcccagcgccttctaccagcagaccctgcccaacagccacctgaccgaggaggccctgaaggtgagcatcgtgcccggccccggcgaccagaagaccggcatccccagcgcccccagcagcttctacagccacagagagaagcccatcatcttcagccagcagaccctgcccgacttcctgttccccgaggaggccctgaaggtgagcgccgtgagcgtgctggccgcccagaagaccggcacccccaccgtgagcagcaacagccacagccacagcgagaagagcagcgtgttctaccagcaggagctgcccgacagcgacctgcccagagagagcctgaagatgagcgccatccccggcctgaccgaccagaagaccgtgcccacccccaccgtgcccagcggcagcttcagccacagagagaagcccagcatcttctaccagcaggagtggcccgacagctacgccaccgagaaggccctgaaggtgagcaccggccccggccccgccgaccagaagaccgagatccccgccgtgcagagcagcagctacccccagagagagaagcccagcgtgctgtacccccaggtgctgagcgacagccacctgcccgaggagagcctgaaggtgagcgccttccccggccccgccgaccagatgaccgacacccccgccgtgcccagcaccttctacagccagagagagaagcccggcatcttctaccagcagaccctgcccgagagccacctgcccaaggaggccctgaagatcagcgtggcccccggcctggccgaccagaagaccggcacccccaccgtgaccagcaccagctacagccagcacagagagaagcccagcatcttccaccagcaggccctgcccggcacccacatccccgaggaggcccagaaggtgagcgccgtgaccggccccggcaaccagaagacctggatccccagagtgctgagcaccttctacagccagagagagaagcccggcatcttctaccagcagaccctgcccggcagccacatccccgaggaggcccagaaggtgagccccgtgctgggccccgccgaccagaagaccggcacccccacccccaccagcgccagctacagccacaccgagaagcccggcatcttctaccagcaggtgctgcccgacaaccaccccaccgaggaggccctgaagatcagcgtggccagcgagcccgtggaccagaccaccggcacccccgccgtgaccagcaccagctacagccagtacagagagaagcccagcatcttctaccagcagagcctgcccagcagccacctgaccgaggaggccaagaacgtgagcgccgtgcccggccccgccgaccagaagaccgtgatccccatcctgcccagcaccttctacagccacaccgagaagcccggcgtgttctaccagcaggtgctgccccacagccaccccaccgaggaggccctgaagatcagcgtggccagcgagcccgtggaccagaccaccggcacccccaccgtgaccagcaccagctacagccagcacaccgagaagcccagcatcttctaccagcagagcctgcccggcagccacctgaccgaggaggccaagaacgtgagcgccgtgcccggccccggcgacagaaagaccggcatccccaccctgcccagcaccttctacagccacaccgagaagcccggcagcttctaccagcaggtgctgccccacagccacctgcccgaggaggccctggaggtgagcgtggcccccggccccgtggaccagaccatcggcacccccaccgtgaccagccccagcagcagcttcggcgagaagcccatcgtgatctacaagcaggccttccccgagggccacctgcccgaggagagcctgaaggtgagcgtggcccccggccccgtgggccagaccaccggcgcccccaccatcaccagccccagctacagccagcacagagccaagagcggcagcttctaccagctggccctgctgggcagccagatccccgaggaggccctgagagtgagcagcgcccccggccccgccgaccagaccaccggcatccccaccatcaccagcaccagctacagcttcggcgagaagcccatcgtgaactacaagcaggccttccccgacggccacctgcccgaggaggccctgaaggtgagcatcgtgagcggccccaccgagaagaagaccgacatccccgccggccccctgggcagcagcgccctgggcgagaagcccatcaccttctacagacaggccctgctggacagccccctgaacaaggaggtggtgaaggtgagcgccgcccccggccccgccgaccagaagaccgagaccctgcccgtgcacagcaccagctacagcaacagaggcaagcccgtgatcttctaccagcagaccctgagcgacagccacctgcccgaggaggccctgaaggtgccccccgtgcccggccccgacgcccagaagaccgagacccccagcgtgagcagcagcctgtacagctacagagagaagcccatcgtgttctaccagcaggccctgcccgacagcgagctgacccaggaggccctgaaggtgagcgccgtgccccagcccgccgaccagaagaccggcctgagcaccgtgaccagcagcttctacagccacaccgagaagcccaacatcagctaccagcaggagctgcccgacagccacctgaccgaggaggccctgaaggtgagcaacgtgcccggccccgccgaccagaagaccggcgtgagcaccgtgaccagcaccagctacagccacagagagaagcccatcgtgagctaccagagagagctgccccacttcaccgaggccggcctgaagatcctgagagtgcccggccccgccgaccagaagaccggcatcaacatcctgcccagcaacagctacccccagagagagcacagcgtgatcagctacgagcaggagctgcccgacctgaccgaggtgaccctgaaggccatcggcgtgcccggccccgccgaccagaagaccggcatccagatcgccagcagcagcagctacagcaacagagagaaggccagcatcttccaccagcaggagctgcccgacgtgaccgaggaggccctgaacgtgttcgtggtgcccggccagggcgacagaaagaccgagatccccaccgtgcccctgagctactacagcagaagagagaagcccagcgtgatcagccagcaggagctgcccgacagccacctgaccgaggaggccctgaaggtgagccccgtgagcatccccgccgagcagaagaccggcatccccatcggcctgagcagcagctacagccacagccacaaggagaagctgaagatcagcaccgtgcacatccccgacgaccagaagaccgagttccccgccgccaccctgagcagctacagccagatcgagaagcccaagatcagcaccgtgatcggccccaacgaccagaagacccccagccagaccgccttccacagcagctacagccagaccgtgaagcccaacatcctgttccagcagcagctgcccgacagagaccagagcaagggcatcctgaagatcagcgccgtgcccgagctgaccgacgtgaacaccggcaagcccgtgagcctgagcagcagctacttccacagagagaagagcaacatcttcagcccccaggagctgcccggcagccacgtgaccgaggacgtgctgaaggtgagcaccatccccggccccgccggccagaagaccgtgctgcccaccgccctgcccagcagcttcagccacagagagaagcccgacatcttctaccagaaggacctgcccgacagacacctgaccgaggacgccctgaagatcagcagcgccctgggccaggccgaccagatcaccggcctgcagaccgtgcccagcggcacctacagccacggcgagaaccacaagctggtgagcgagcacgtgcagagactgatcgacaacctgaacagcagcgacagcagcgtgagcagcaacaacgtgctgctgaacagccaggccgacgacagagtggtgatcaacaagcccgagagcgccggcttcagagacgtgggcagcgaggagatccaggacgccgagaacagcgccaagaccctgaaggagatcagaaccctgctgatggaggccgagaacatggccctgaagagatgcaacttccccgcccccctggccagattcagagacatcagcgacatcagcttcatccagagcaagaaggtggtgtgcttcaaggagcccagcagcaccggcgtgagcaacggcgacctgctgcacagacagcccttcaccgaggagagccccagcagcagatgcatccagaaggacatcggcacccagaccaacctgaagtgcagaagaggcatcgagaactgggagttcatcagcagcaccaccgtgagaagccccctgcaggaggccgagagcaaggtgagcatggccctggaggagaccctgagacagtaccaggccgccaagagcgtgatgagaagcgagcccgagggctgcagcggcaccatcggcaacaagatcatcatccccatgatgaccgtgatcaagagcgacagcagcagcgacgccagcgacggcaacggcagctgcagctgggacagcaacctgcccgagagcctggagagcgtgagcgacgtgctgctgaacttcttcccctacgtgagccccaagaccagcatcaccgacagcagagaggaggagggcgtgagcgagagcgaggacggcggcggcagcagcgtggacagcctggccgcccacgtgaagaacctgctgcagtgcgagagcagcctgaaccacgccaaggagatcctgagaaacgccgaggaggaggagagcagagtgagagcccacgcctggaacatgaagttcaacctggcccacgactgcggctacagcatcagcgagctgaacgaggacgacagaagaaaggtggaggagatcaaggccgagctgttcggccacggcagaaccaccgacctgagcaagggcctgcagagctag

SEQ ID NO: 72573 - DNA, 1944 bp, Artificial Sequence
  Description of Artificial Sequence: Synthetic coding sequence
atggccgcccccgccggcggcggcggcagcgccgtgagcgtgctggcccccaacggcagaagacacaccgtgaaggtgacccccagcaccgtgctgctgcaggtgctggaggacacctgcagaagacaggacttcaacccctgcgagtacgacctgaagttccagagaagcgtgctggacctgagcctgcagtggagattcgccaacctgcccaacaacgccaagctggagatggtgcccgccagcagaagcagagagggccccgagaacatggtgagaatcgccctgcagctggacgacggcagcagactgcaggacagcttctgcagcggccagaccctgtgggagctgctgagccacttcccccagatcagagagtgcctgcagcaccccggcggcgccacccccgtgtgcgtgtacaccagagacgaggtgaccggcgaggccgccctgagaggcaccaccctgcagagcctgggcctgaccggcggcagcgccaccatcagattcgtgatgaagtgctacgaccccgtgggcaagacccccggcagcctgggcagcagcgccagcgccggccaggccgccgccagcgcccccctgcccctggagagcggcgagctgagcagaggcgacctgagcagacccgaggacgccgacaccagcggcccctgctgcgagcacacccaggagaagcagagcaccagagcccccgccgccgcccccttcgtgcccttcagcggcggcggccagagactgggcggcccccccggccccaccagacccctgaccagcagcagcgccaagctgcccaagagcctgagcagccccggcggccccagcaagcccaagaagagcaagagcggccaggacccccagcaggagcaggagcaggagagagagagagacccccagcaggagcaggagagagagagacccgtggacagagagcccgtggacagagagcccgtggtgtgccaccccgacctggaggagagactgcaggcctggcccgccgagctgcccgacgagttcttcgagctgaccgtggacgacgtgagaagaagactggcccagctgaagagcgagagaaagagactggaggaggcccccctggtgaccaaggccttcagagaggcccagatcaaggagaagctggagagataccccaaggtggccctgagagtgctgttccccgacagatacgtgctgcagggcttcttcagacccagcgagaccgtgggcgacctgagagacttcgtgagaagccacctgggcaaccccgagctgagcttctacctgttcatcaccccccccaagaccgtgctggacgaccacacccagaccctgttccagccccagctgggcgacagagtggcccccttcaccctgggccccagcctgaagagatgcctgggccccgagcagagaaccagactgcccgtggtgggcgacggcggcgacgtggacagcggcagactgctgttctggggccccagcagaggcagagccagccccagcaccggccagcccccctgccaccccgtgtgcagacccagcagcccccccagccccagacccagcagcggcgaccccagcagagtgaaggccggccacaagcacgtgggcaccggcagagccaacctgttccccgccgccctggtgcacctgggcgccgaggagcccgccggcgtgtacctggagcccggcctgctggagcacgccatcagccccagcgccgccgacgtgctggtggccagatacatgagcagagccgccggcagccccagccccctgcccgcccccgaccccgcccccaagagcgagcccgccgccgaggagggcgccctggtgccccccgagcccatccccggcaccgcccagcccgtgaagagaagcctgggcaaggtgcccaagtggctgaagctgcccgccagcaagagatag

SEQ ID NO: 72574 - DNA, 1662 bp, Artificial Sequence
  Description of Artificial Sequence: Synthetic coding sequence
atggccgcccccgccggcggcggcggcagcgccgtgagcgtgctggcccccaacggcagaagacacaccgtgaaggtgacccccagcaccgtgctgctgcaggtgctggaggacacctgcagaagacaggacttcaacccctgcgagtacgacctgaagttccagagaagcgtgctggacctgagcctgcagtggagattcgccaacctgcccaacaacgccaagctggagatggtgcccgccagcagaagcagagagggccccgagaacatggtgagaatcgccctgcagctggacgacggcagcagactgcaggacagcttctgcagcggccagaccctgtgggagctgctgagccacttcccccagatcagagagtgcctgcagcaccccggcggcgccacccccgtgtgcgtgtacaccagagacgaggtgaccggcgaggccgccctgagaggcaccaccctgcagagcctgggcctgaccggcggcagcgccaccatcagattcgtgatgaagtgctacgaccccgtgggcaagacccccggcagcctgggcagcagcgccagcgccggccaggccgccgccagcgcccccctgcccctggagagcggcgagctgagcagaggcgacctgagcagacccgaggacgccgacaccagcggcccctgctgcgagcacacccaggagaagcagagcaccagagcccccgccgccgcccccttcgtgcccttcagcggcggcggccagagactgggcggcccccccggccccaccagacccctgaccagcagcagcgccaagctgcccaagagcctgagcagccccggcggccccagcaagcccaagaagagcaagagcggccaggacccccagcaggagcaggagcaggagagagagagagacccccagcaggagcaggagagagagagacccgtggacagagagcccgtggacagagagcccgtggtgtgccaccccgacctggaggagagactgcaggcctggcccgccgagctgcccgacgagttcttcgagctgaccgtggacgacgtgagaagaagactggcccagctgaagagcgagagaaagagactggaggaggcccccctggtgaccaaggccttcagagaggcccagatcaaggagaagctggagagataccccaaggtggccctgagagtgctgttccccgacagatacgtgctgcagggcttcttcagacccagcgagaccgtgggcgacctgagagacttcgtgagaagccacctgggcaaccccgagctgagcttctacctgttcatcaccccccccaagaccgtgctggacgaccacacccagaccctgttccaggccaacctgttccccgccgccctggtgcacctgggcgccgaggagcccgccggcgtgtacctggagcccggcctgctggagcacgccatcagccccagcgccgccgacgtgctggtggccagatacatgagcagagccgccggcagccccagccccctgcccgcccccgaccccgcccccaagagcgagcccgccgccgaggagggcgccctggtgccccccgagcccatccccggcaccgcccagcccgtgaagagaagcctgggcaaggtgcccaagtggctgaagctgcccgccagcaagagatag

SEQ ID NO: 72575 - DNA, 1050 bp, Artificial Sequence
  Description of Artificial Sequence: Synthetic coding sequence
atggtgcccgccagcagaagcagagagggccccgagaacatggtgagaatcgccctgcagctggacgacggcagcagactgcaggacagcttctgcagcggccagaccctgtgggagctgctgagccacttcccccagatcagagagtgcctgcagcaccccggcggcgccacccccgtgtgcgtgtacaccagagacgaggtgaccggcgaggccgccctgagaggcaccaccctgcagagcctgggcctgaccggcggcagcgccaccatcagattcgtgatgaagtgctacgaccccgtgggcaagacccccggcagcctgggcagcagcgccagcgccggccaggccgccgccagcgcccccctgcccctggagagcggcgagctgagcagaggcgacctgagcagacccgaggacgccgacaccagcggcccctgctgcgagcacacccaggagaagcagagcaccagagcccccgccgccgcccccttcgtgcccttcagcggcggcggccagagactgggcggcccccccggccccaccagacccctgaccagcagcagcgccaagctgcccaagagcctgagcagccccggcggccccagcaagcccaagaagagcaagagcggccaggacccccagcaggagcaggagcaggagagagagagagacccccagcaggagcaggagagagagagacccgtggacagagagcccgtggacagagagcccgtggtgtgccaccccgacctggaggagagactgcaggcctggcccgccgagctgcccgacgagttcttcgagctgaccgtggacgacgtgagaagaagactggcccagctgaagagcgagagaaagagactggaggaggcccccctggtgaccaaggccttcagagaggcccagatcaaggagaagctggagagataccccaagagaagaagcctgagcctgagccccagactggagagcgtggtgcccagccagctgaccgccagcagcgccagcagagtgcaggtggtgctgctgccccagccccccaagtag

SEQ ID NO: 72576 - DNA, 981 bp, Artificial Sequence
  Description of Artificial Sequence: Synthetic coding sequence
atggagttcctgagcgagaagttcgccctgaagagcccccccagcaagaacagcgacttctacatgggcgccggcggccccctggagcacgtgatggagaccctggacaacgagagcttctacagcaaggccagcgccggcaagtgcgtgcaggccttcggccccctgcccagagccgagcaccacgtgagactggagagaaccagcccctgccaggacagcagcgtgaactacggcatcaccaaggtggagggccagcccctgcacaccgagctgaacagagccatggacaactgcaacagcctgagaatgagccccgtgaagggcatgcaggagaagggcgagctggacgagctgggcgacaagtgcgacagcaacgtgagcagcagcaagaagagaagacacagaaccaccttcaccagcctgcagctggaggagctggagaaggtgttccagaagacccactaccccgacgtgtacgtgagagagcagctggccctgagaaccgagctgaccgaggccagagtgcaggtgtggttccagaacagaagagccaagtggagaaagagagagagatacggccagatccagcaggccaagagccacttcgccgccacctacgacatcagcgtgctgcccagaaccgacagctacccccagatccagaacaacctgtgggccggcaacgccagcggcggcagcgtggtgaccagctgcatgctgcccagagacaccagcagctgcatgaccccctacagccacagccccagaaccgacagcagctacaccggcttcagcaaccaccagaaccagttcagccacgtgcccctgaacaacttcttcaccgacagcctgctgaccggcgccaccaacggccacgccttcgagaccaagcccgagttcgagagaagaagcagcagcatcgccgtgctgagaatgaaggccaaggagcacaccgccaacatcagctgggccatgtag

SEQ ID NO: 72577 - DNA, 1032 bp, Artificial Sequence
  Description of Artificial Sequence: Synthetic coding sequence
atggaccccgagcactgcgcccccttcagagtgggccccgcccccggcccctacgtggccagcggcgacgagccccccggcccccagggcacccccgccgccgccccccacctgcaccccgccccccccagaggccccagactgaccagattccccgcctgcggccccctggagccctacctgcccgagcccgccaagccccccgccaagtacctgcaggacctgggccccggccccgccctgaacggcggccacttctacgagggccccgccgaggccgaggagaagaccagcaaggccgccagcttcccccagctgcccctggactgcagaggcggccccagagacggccccagcaacctgcagggcagccccggcccctgcctggccagcctgcacctgcccctgagccccggcctgcccgacagcatggagctggccaagaacaagagcaagaagagaagaaacagaaccaccttcagcaccttccagctggaggagctggagaaggtgttccagaagacccactaccccgacgtgtacgccagagagcagctggccctgagaaccgacctgaccgaggccagagtgcaggtgtggttccagaacagaagagccaagtggagaaagagagagagatacggcaagatccaggagggcagaaaccccttcaccgccgcctacgacatcagcgtgctgcccagaaccgacagccacccccagctgcagaacagcctgtgggccagccccggcagcggcagccccggcggcccctgcctggtgagccccgagggcatccccagcccctgcatgagcccctacagccacccccacggcagcgtggccggcttcatgggcgtgcccgcccccagcgccgcccaccccggcatctacagcatccacggcttcccccccaccctgggcggccacagcttcgagcccagcagcgacggcgactacaagagccccagcctggtgagcctgagagtgaagcccaaggagccccccggcctgctgaactggaccacctag

SEQ ID NO: 72578 - DNA, 1236 bp, Artificial Sequence
  Description of Artificial Sequence: Synthetic coding sequence
atgaacgccgagacctgcgtgagctactgcgagagccccgccgccgccatggacgcctactacagccccgtgagccagagcagagagggcagcagccccttcagagccttccccggcggcgacaagttcggcaccaccttcctgagcgccgccgccaaggcccagggcttcggcgacgccaagagcagagccagatacggcgccggccagcaggacctggccacccccctggagagcggcgccggcgccagaggcagcttcaacaagttccagccccagcccagcaccccccagccccagccccccccccagccccagccccagcagcagcagccccagccccagccccccgcccagccccacctgtacctgcagagaggcgcctgcaagaccccccccgacggcagcctgaagctgcaggagggcagcagcggccacagcgccgccctgcaggtgccctgctacgccaaggagagcagcctgggcgagcccgagctgccccccgacagcgacaccgtgggcatggacagcagctacctgagcgtgaaggaggccggcgtgaagggcccccaggacagagccagcagcgacctgcccagccccctggagaaggccgacagcgagagcaacaagggcaagaagagaagaaacagaaccaccttcaccagctaccagctggaggagctggagaaggtgttccagaagacccactaccccgacgtgtacgccagagagcagctggccatgagaaccgacctgaccgaggccagagtgcaggtgtggttccagaacagaagagccaagtggagaaagagagagagattcggccagatgcagcaggtgagaacccacttcagcaccgcctacgagctgcccctgctgaccagagccgagaactacgcccagatccagaaccccagctggctgggcaacaacggcgccgccagccccgtgcccgcctgcgtggtgccctgcgaccccgtgcccgcctgcatgagcccccacgcccacccccccggcagcggcgccagcagcgtgaccgacttcctgagcgtgagcggcgccggcagccacgtgggccagacccacatgggcagcctgttcggcgccgccagcctgagccccggcctgaacggctacgagctgaacggcgagcccgacagaaagaccagcagcatcgccgccctgagaatgaaggccaaggagcacagcgccgccatcagctgggccacctag

SEQ ID NO: 72579 - DNA, 630 bp, Artificial Sequence
  Description of Artificial Sequence: Synthetic coding sequence
atgagaagcaccatcctgctgttctgcctgctgggcagcaccagaagcctgccccagctgaagcccgccctgggcctgccccccaccaagctggcccccgaccagggcaccctgcccaaccagcagcagagcaaccaggtgttccccagcctgagcctgatccccctgacccagatgctgaccctgggccccgacctgcacctgctgaaccccgccgccggcatgacccccggcacccagacccaccccctgaccctgggcggcctgaacgtgcagcagcagctgcacccccacgtgctgcccatcttcgtgacccagctgggcgcccagggcaccatcctgagcagcgaggagctgccccagatcttcaccagcctgatcatccacagcctgttccccggcggcatcctgcccaccagccaggccggcgccaaccccgacgtgcaggacggcagcctgcccgccggcggcgccggcgtgaaccccgccacccagggcacccccgccggcagactgcccacccccagcggcaccgacgacgacttcgccgtgaccacccccgccggcatccagagaagcacccacgccatcgaggaggccaccaccgagagcgccaacggcatccagtag

SEQ ID NO: 72580 - DNA, 627 bp, Artificial Sequence
  Description of Artificial Sequence: Synthetic coding sequence
atgagaagcaccatcctgctgttctgcctgctgggcagcaccagaagcctgcccctgaagcccgccctgggcctgccccccaccaagctggcccccgaccagggcaccctgcccaaccagcagcagagcaaccaggtgttccccagcctgagcctgatccccctgacccagatgctgaccctgggccccgacctgcacctgctgaaccccgccgccggcatgacccccggcacccagacccaccccctgaccctgggcggcctgaacgtgcagcagcagctgcacccccacgtgctgcccatcttcgtgacccagctgggcgcccagggcaccatcctgagcagcgaggagctgccccagatcttcaccagcctgatcatccacagcctgttccccggcggcatcctgcccaccagccaggccggcgccaaccccgacgtgcaggacggcagcctgcccgccggcggcgccggcgtgaaccccgccacccagggcacccccgccggcagactgcccacccccagcggcaccgacgacgacttcgccgtgaccacccccgccggcatccagagaagcacccacgccatcgaggaggccaccaccgagagcgccaacggcatccagtag

SEQ ID NO: 72581 - DNA, 2256 bp, Artificial Sequence
  Description of Artificial Sequence: Synthetic coding sequence
atgcccgccctgggctgggccgtggccgccatcctgatgctgcagaccgccatggccgagcccagccccggcaccctgcccagaaaggccggcgtgttcagcgacctgagcaaccaggagctgaaggccgtgcacagcttcctgtggagcaagaaggagctgagactgcagcccagcagcaccaccaccatggccaagaacaccgtgttcctgatcgagatgctgctgcccaagaagtaccacgtgctgagattcctggacaagggcgagagacaccccgtgagagaggccagagccgtgatcttcttcggcgaccaggagcaccccaacgtgaccgagttcgccgtgggccccctgcccggcccctgctacatgagagccctgagccccagacccggctaccagagcagctgggccagcagacccatcagcaccgccgagtacgccctgctgtaccacaccctgcaggaggccaccaagcccctgcaccagttcttcctgaacaccaccggcttcagcttccaggactgccacgacagatgcctggccttcaccgacgtggcccccagaggcgtggccagcggccagagaagaagctggctgatcatccagagatacgtggagggctacttcctgcaccccaccggcctggagctgctggtggaccacggcagcaccgacgccggccactgggccgtggagcaggtgtggtacaacggcaagttctacggcagccccgaggagctggccagaaagtacgccgacggcgaggtggacgtggtggtgctggaggaccccctgcccggcggcaagggccacgacagcaccgaggagccccccctgttcagcagccacaagcccagaggcgacttccccagccccatccacgtgagcggccccagactggtgcagccccacggccccagattcagactggagggcaacgccgtgctgtacggcggctggagcttcgccttcagactgagaagcagcagcggcctgcaggtgctgaacgtgcacttcggcggcgagagaatcgcctacgaggtgagcgtgcaggaggccgtggccctgtacggcggccacacccccgccggcatgcagaccaagtacctggacgtgggctggggcctgggcagcgtgacccacgagctggcccccggcatcgactgccccgagaccgccaccttcctggacaccttccactactacgacgccgacgaccccgtgcactaccccagagccctgtgcctgttcgagatgcccaccggcgtgcccctgagaagacacttcaacagcaacttcaagggcggcttcaacttctacgccggcctgaagggccaggtgctggtgctgagaaccaccagcaccgtgtacaactacgactacatctgggacttcatcttctaccccaacggcgtgatggaggccaagatgcacgccaccggctacgtgcacgccaccttctacacccccgagggcctgagacacggcaccagactgcacacccacctgatcggcaacatccacacccacctggtgcactacagagtggacctggacgtggccggcaccaagaacagcttccagaccctgcagatgaagctggagaacatcaccaacccctggagccccagacacagagtggtgcagcccaccctggagcagacccagtacagctgggagagacaggccgccttcagattcaagagaaagctgcccaagtacctgctgttcaccagcccccaggagaacccctggggccacaagagaacctacagactgcagatccacagcatggccgaccaggtgctgccccccggctggcaggaggagcaggccatcacctgggccagataccccctggccgtgaccaagtacagagagagcgagctgtgcagcagcagcatctaccaccagaacgacccctggcacccccccgtggtgttcgagcagttcctgcacaacaacgagaacatcgagaacgaggacctggtggcctgggtgaccgtgggcttcctgcacatcccccacagcgaggacatccccaacaccgccacccccggcaacagcgtgggcttcctgctgagacccttcaacttcttccccgaggaccccagcctggccagcagagacaccgtgatcgtgtggcccagagacaacggccccaactacgtgcagagatggatccccgaggacagagactgcagcatgcccccccccttcagctacaacggcacctacagacccgtgtag

SEQ ID NO: 72582 - DNA, 2313 bp, Artificial Sequence
  Description of Artificial Sequence: Synthetic coding sequence
atgcccgccctgggctgggccgtggccgccatcctgatgctgcagaccgccatggccgagcccagccccggcaccctgcccagaaaggccggcgtgttcagcgacctgagcaaccaggagctgaaggccgtgcacagcttcctgtggagcaagaaggagctgagactgcagcccagcagcaccaccaccatggccaagaacaccgtgttcctgatcgagatgctgctgcccaagaagtaccacgtgctgagattcctggacaagggcgagagacaccccgtgagagaggccagagccgtgatcttcttcggcgaccaggagcaccccaacgtgaccgagttcgccgtgggccccctgcccggcccctgctacatgagagccctgagccccagacccggctaccagagcagctgggccagcagacccatcagcaccgccgagtacgccctgctgtaccacaccctgcaggaggccaccaagcccctgcaccagttcttcctgaacaccaccggcttcagcttccaggactgccacgacagatgcctggccttcaccgacgtggcccccagaggcgtggccagcggccagagaagaagctggctgatcatccagagatacgtggagggctacttcctgcaccccaccggcctggagctgctggtggaccacggcagcaccgacgccggccactgggccgtggagcaggtgtggtacaacggcaagttctacggcagccccgaggagctggccagaaagtacgccgacggcgaggtggacgtggtggtgctggaggaccccctgcccggcggcaagggccacgacagcaccgaggagccccccctgttcagcagccacaagcccagaggcgacttccccagccccatccacgtgagcggccccagactggtgcagccccacggccccagattcagactggagggcaacgccgtgctgtacggcggctggagcttcgccttcagactgagaagcagcagcggcctgcaggtgctgaacgtgcacttcggcggcgagagaatcgcctacgaggtgagcgtgcaggaggccgtggccctgtacggcggccacacccccgccggcatgcagaccaagtacctggacgtgggctggggcctgggcagcgtgacccacgagctggcccccggcatcgactgccccgagaccgccaccttcctggacaccttccactactacgacgccgacgaccccgtgcactaccccagagccctgtgcctgttcgagatgcccaccggcgtgcccctgagaagacacttcaacagcaacttcaagggcggcttcaacttctacgccggcctgaagggccaggtgctggtgctgagaaccaccagcaccgtgtacaactacgactacatctgggacttcatcttctaccccaacggcgtgatggaggccaagatgcacgccaccggctacgtgcacgccaccttctacacccccgagggcctgagacacggcaccagactgcacacccacctgatcggcaacatccacacccacctggtgcactacagagtggacctggacgtggccggcaccaagaacagcttccagaccctgcagatgaagctggagaacatcaccaacccctggagccccagacacagagtggtgcagcccaccctggagcagacccagtacagctgggagagacaggccgccttcagattcaagagaaagctgcccaagtacctgctgttcaccagcccccaggagaacccctggggccacaagagaacctacagactgcagatccacagcatggccgaccaggtgctgccccccggctggcaggaggagcaggccatcacctgggccagaaccgagggcggccagcccagagccctgagccaggccgccagccccgtgcccggcagataccccctggccgtgaccaagtacagagagagcgagctgtgcagcagcagcatctaccaccagaacgacccctggcacccccccgtggtgttcgagcagttcctgcacaacaacgagaacatcgagaacgaggacctggtggcctgggtgaccgtgggcttcctgcacatcccccacagcgaggacatccccaacaccgccacccccggcaacagcgtgggcttcctgctgagacccttcaacttcttccccgaggaccccagcctggccagcagagacaccgtgatcgtgtggcccagagacaacggccccaactacgtgcagagatggatccccgaggacagagactgcagcatgcccccccccttcagctacaacggcacctacagacccgtgtag

SEQ ID NO: 72583 - DNA, 1884 bp, Artificial Sequence
  Description of Artificial Sequence: Synthetic coding sequence
atgagagccctgagccccagacccggctaccagagcagctgggccagcagacccatcagcaccgccgagtacgccctgctgtaccacaccctgcaggaggccaccaagcccctgcaccagttcttcctgaacaccaccggcttcagcttccaggactgccacgacagatgcctggccttcaccgacgtggcccccagaggcgtggccagcggccagagaagaagctggctgatcatccagagatacgtggagggctacttcctgcaccccaccggcctggagctgctggtggaccacggcagcaccgacgccggccactgggccgtggagcaggtgtggtacaacggcaagttctacggcagccccgaggagctggccagaaagtacgccgacggcgaggtggacgtggtggtgctggaggaccccctgcccggcggcaagggccacgacagcaccgaggagccccccctgttcagcagccacaagcccagaggcgacttccccagccccatccacgtgagcggccccagactggtgcagccccacggccccagattcagactggagggcaacgccgtgctgtacggcggctggagcttcgccttcagactgagaagcagcagcggcctgcaggtgctgaacgtgcacttcggcggcgagagaatcgcctacgaggtgagcgtgcaggaggccgtggccctgtacggcggccacacccccgccggcatgcagaccaagtacctggacgtgggctggggcctgggcagcgtgacccacgagctggcccccggcatcgactgccccgagaccgccaccttcctggacaccttccactactacgacgccgacgaccccgtgcactaccccagagccctgtgcctgttcgagatgcccaccggcgtgcccctgagaagacacttcaacagcaacttcaagggcggcttcaacttctacgccggcctgaagggccaggtgctggtgctgagaaccaccagcaccgtgtacaactacgactacatctgggacttcatcttctaccccaacggcgtgatggaggccaagatgcacgccaccggctacgtgcacgccaccttctacacccccgagggcctgagacacggcaccagactgcacacccacctgatcggcaacatccacacccacctggtgcactacagagtggacctggacgtggccggcaccaagaacagcttccagaccctgcagatgaagctggagaacatcaccaacccctggagccccagacacagagtggtgcagcccaccctggagcagacccagtacagctgggagagacaggccgccttcagattcaagagaaagctgcccaagtacctgctgttcaccagcccccaggagaacccctggggccacaagagaacctacagactgcagatccacagcatggccgaccaggtgctgccccccggctggcaggaggagcaggccatcacctgggccagataccccctggccgtgaccaagtacagagagagcgagctgtgcagcagcagcatctaccaccagaacgacccctggcacccccccgtggtgttcgagcagttcctgcacaacaacgagaacatcgagaacgaggacctggtggcctgggtgaccgtgggcttcctgcacatcccccacagcgaggacatccccaacaccgccacccccggcaacagcgtgggcttcctgctgagacccttcaacttcttccccgaggaccccagcctggccagcagagacaccgtgatcgtgtggcccagagacaacggccccaactacgtgcagagatggatccccgaggacagagactgcagcatgcccccccccttcagctacaacggcacctacagacccgtgtag

SEQ ID NO: 72584 - DNA, 750 bp, Artificial Sequence
  Description of Artificial Sequence: Synthetic coding sequence
atgcccgccctgggctgggccgtggccgccatcctgatgctgcagaccgccatggccgagcccagccccggcaccctgcccagaaaggccggcgtgttcagcgacctgagcaaccaggagctgaaggccgtgcacagcttcctgtggagcaagaaggagctgagactgcagcccagcagcaccaccaccatggccaagaacaccgtgttcctgatcgagatgctgctgcccaagaagtaccacgtgctgagattcctggacaagggcgagagacaccccgtgagagaggccagagccgtgatcttcttcggcgaccaggagcaccccaacgtgaccgagttcgccgtgggccccctgcccggcccctgctacatgagagccctgagccccagacccggctaccagagcagctgggccagcagacccatcagcaccgccgagtacgccctgctgtaccacaccctgcaggaggccaccaagcccctgcaccagttcttcctgaacaccaccggcttcagcttccaggactgccacgacagatgcctggccttcaccgacgtggcccccagaggcgtggccagcggccagagaagaagctggctgatcatccagagatacgtggagggctacttcctgcaccccaccggcctggagctgctggtggaccacggcagcaccgacgccggccactgggccgtggagcaggtgtggtacaacggcaagttctacggcagccccgaggagctgtag

SEQ ID NO: 72585 - DNA, 2256 bp, Artificial Sequence; identical to SEQ ID NO: 72581
  Description of Artificial Sequence: Synthetic coding sequence

SEQ ID NO: 72586 - DNA, 1014 bp, Artificial Sequence
  Description of Artificial Sequence: Synthetic coding sequence
atgcccgccctgggctgggccgtggccgccatcctgatgctgcagaccgccatggccgagcccagccccggcaccctgcccagaaaggccggcgtgttcagcgacctgagcaaccaggagctgaaggccgtgcacagcttcctgtggagcaagaaggagctgagactgcagcccagcagcaccaccaccatggccaagaacaccgtgttcctgatcgagatgctgctgcccaagaagtaccacgtgctgagattcctggacaagggcgagagacaccccgtgagagaggccagagccgtgatcttcttcggcgaccaggagcaccccaacgtgaccgagttcgccgtgggccccctgcccggcccctgctacatgagagccctgagccccagacccggctaccagagcagctgggccagcagacccatcagcaccgccgagtacgccctgctgtaccacaccctgcaggaggccaccaagcccctgcaccagttcttcctgaacaccaccggcttcagcttccaggactgccacgacagatgcctggccttcaccgacgtggcccccagaggcgtggccagcggccagagaagaagctggctgatcatccagagatacgtggagggctacttcctgcaccccaccggcctggagctgctggtggaccacggcagcaccgacgccggccactgggccgtggagcaggtgtggtacaacggcaagttctacggcagccccgaggagctggccagaaagtacgccgacggcgaggtggacgtggtggtgctggaggaccccctgcccggcggcaagggccacgacagcaccgaggagccccccctgttcagcagccacaagcccagaggcgacttccccagccccatccacgtgagcggccccagactggtgcagccccacggccccagattcagactggagggcaacgccgtgctgtacggcggctggagcttcgccttcagactgagaagcagcagcggcctgcaggtgctgtag

SEQ ID NO: 72587 - DNA, 582 bp, Artificial Sequence
  Description of Artificial Sequence: Synthetic coding sequence
atggaggccaagatgcacgccaccggctacgtgcacgccaccttctacacccccgagggcctgagacacggcaccagactgcacacccacctgatcggcaacatccacacccacctggtgcactacagagtggacctggacgtggccggcaccaagaacagcttccagaccctgcagatgaagctggagaacatcaccaacccctggagccccagacacagagtggtgcagcccaccctggagcagacccagtacagctgggagagacaggccgccttcagattcaagagaaagctgcccaagtacctgctgttcaccagcccccaggagaacccctggggccacaagagaacctacagactgcagatccacagcatggccgaccaggtgctgccccccggctggcaggaggagcaggccatcacctgggccagataccccctggccgtgaccaagtacagagagagcgagctgtgcagcagcagcatctaccaccagaacgacccctggcacccctggagcctgagcagcttcttcaccaccaccagaaccctgaagatgagaacctggtggcccggctag

SEQ ID NO: 72588 - DNA, 2256 bp, Artificial Sequence; identical to SEQ ID NO: 72581
  Description of Artificial Sequence: Synthetic coding sequence

SEQ ID NO: 72589 - DNA, 1191 bp, Artificial Sequence
  Description of Artificial Sequence: Synthetic coding sequence
atgctgcccagcctgcaggagagcatggacggcgacgagaaggagctggagagcagcgaggagggcggcagcgccgaggagagaagactggagccccccagcagcagccactactgcctgtacagctacagaggcagcagactggcccagcagagaggcgacagcgaggacggcagccccagcggcaccaacgccgagacccccagcggcgacgacttcagcctgagcctggccgacaccaacctgcccagcgaggtggagcccgagctgagaagcttcatcgccaagagactgagcagaggcgccgtgttcgagggcctgggcaacgtggccagcgtggagctgaagatccccggctacagagtgggctgctactactgcctgttccagaacgagaagctgctgcccgagaccgtgaccatcgacagcgagagaaaccccagcgagtacgtggtgtgcttcctgggcggcagcgagaagggcctggagaccttcagactggagctggacaagtacatccagggcctgaagaacaacatgaactgcgaggccagaggcctggagagccacatcaagagctacctgagcagctggttcgaggacgtggtgtgccccatccagagagtggtgctgctgttccaggagaagctgaccttcctgctgcacgccgccctgagctacacccccgtggaggtgaaggagagcgacgagaagaccaagagagacatcaacagattcctgagcgtggccagcctgcagggcctgatccacgagggcaccatgaccagcctgtgcatggccatgaccgaggagcagcacaagagcgtggtgatcgactgcagcagcagccagccccagttctgcaacgccggcagcaacagattctgcgaggactggatgcaggccttcctgaacggcgccaagggcggcaaccccttcctgttcagacaggtgctggagaacttcaagctgaaggccatccaggacaccaacaacctgaagagattcatcagacaggccgagatgaaccactacgccctgttcaagtgctacatgttcctgaagaactgcggcagcggcgacatcctgctgaagatcgtgaaggtggagcacgaggagatgcccgaggccaagaacgtgatcgccgtgctggaggagttcatgaaggaggccctggaccagagcttctag
